United States Patent 10,407,724 (METHODS AND COMPOSITIONS FOR SCREENING AND TREATING DEVELOPMENTAL DISORDERS) - sequence listing, part 64

SEQ ID NO: 1774 - DNA, 843317 bp, Homo sapiens
tttaaaatgctttatgatattttatttgatattattcagtaatacaggttttgtggcaaatatgcatttctaaaagtgcataatgaaacattttatttttctagctcttgaatttgtcatagaaataagccatagattgttactttctgatttactacttatagattcatattgaagatgccatgaagaggagataaatgagtttatatgacactatttactgattatgaaaatagagaaatacaaaaatattatctaataataacaaaaaatatatttcttttaaacataaacactaaaacagagagtagtcaaactgatttggcacacttaatatatattatcaacattatatttttcattcttgaataatgaagcattgcatactttgagctttgttcaaacattagttgctataatcatgaaggtgactattaaaaccagtcagagcccgtatgtgcacagcaaaagagtggtaaccaggatctatcctatcatctcattttgttaggaacatagtttaaagagaaatgccattaaaagaggatgagtttgtacacccatctcacgcatgagtagtgaatggtatttagttagtaaatattctccctatcctctatccaacaccaaaaataagcaatttcagcgaaggggattttacttaataaagttctacaaactcaattttaggctttcttatcctgccatagcaaataattttttgactttcttcatttgtactttatggagctaactacattttcttagaaacagcattaaaattaaaggtaatttttaatgataaaatgtttccttggatacattttcttgtatgttaaagagtactttgtttcaaaatgcttaatttcacttacaattagaaatcaaatatggagcacagcatagggcaatttggaaactgtcacactaattgccacaaaaaagttaatttttcacataagacaactggcagtgaacatccaattaactgccacacagttatttaactactatcctcagaaaagaattattctattttatgaccactaattgaatggtcattgacatgagacattttttacacttacaaatgtattttgaaattacatatttttatttagaaaatgtatatttgttttaatttggaaagagctgaacacaaggatcatgattttaaaagatcagcatatgtaggtgacatgaaagttcacagcaactgtttcacaaatcaccttaacacaccggattcacagataagggtacgcctctctttggttcataaggtgttgtcctggaaaccattttgatgcagtcgacaatagggcaaacactgagacacagagtacagcctgtacaagtgtcggttatggtgggcaggtgggtttctggatcaaactgtatagcctgcaaacagaaatagagggtattgatgtcactgaccacaaaggtcaacaatgtccccattttagcgttaacatttttctctgctgcagaggagccacactatgagacaactacgtccagctctatggtgcaactatagcaacagttgagctgacagaggaggaaaaaaagagcgagaaaagaaatccttttaaattaaaaacacaatgtttaaaattccttaggggtatttttcttcattgtgtgaggaaaatatgtcataacatagtcactctctagttttctttgttctgagcagagttcgggtctttccagttctaccaggatggggcgtcttctacctgtggattttgggggactttcacacgtcctccttttcctcttcacactctttgttcttgacagtggaaaagtgttactgtcagattctgaggcaatgaatacatttgtttggatttcaaataatgcatgtagtttttagaagaaagcagaagaaaaaaattagcttaacagtcagctttgagttttgaagatttccaagctgactctagtcattgtccaccacgaaggggaaaaacactgaatggagagccaggaaaactgatgtccagtcctggccctgacactattgagcccagattaccacagccaggcctccagctctgaaacggcttaggattttgagaaattttacaattttccttcccccgtcttcctctattccctccctcccttcctccctcccttcctctctttttctttccatgaagcaatgtagaataagcaattaagaatacctagtatgaaattcaggaccgagttttttttaaaaaaagatatgatgattattttcccattaaagagaaacatttcaatgatgaaaaatgacatgtaagacctcagcggaagttacaggatttctatctaggagggatttcagggcagctacgtaggggtggatcatggtgtcagaggggatttaggaaacttgcctggcagtctcacttgcaaaaaaaatacaagagttttactcagactgtgtactactttgaagtgactaagtcggggctgaggaaattacaagggacaataagtgtctctccacccccatggtaccccttgaggccaggtctacaaatcttacattttcaaggaattgcattattttgatttttttcctgtctcataccaatgttataattcaattatatatgtgtgtatatatatatatagttgtttaaaaaattcccccctccaaatgaagctgcatgcaactatattttttctcttttatgcacatataaatgaaaataatattttcagagtaaatcatgatagttgcttaatatttttaaaaagtctgatctgtaaggaaataaacatatatttgaacaagaactatagctatagcaagtcatgagaatatctgtccacacaaattggtgctatgttttgtaaaacaacattttaaggtgctgtttggatgagtaaaaacgatttatcttccttaggtacccttttatataaatggaaactcaatgaagtaactgataaaaattaagactaatgcttagaaatatactttgaaaatctgcaaagatataaaactttatgttcaattaaaaattttggctttctatttttatcttctgagacagaagaatcaaagaactttctaagtcttttaaaatgcatacttgtgattttctttctcattactaagaagatttttctaaagttgttccaagtctagaattccacggtgggagccataagttctaagatttaagatattagagagctgatgctctgatagttataggacttcctgattgatctctgattggttaatttgaaagacgacatgaaagtaaatgtgatatggctagcactttataaaaataacggttaagacagcttttagctagaaaaaaggtgatgaattgagtaaaaatttggtgtagaactgtggaactaggaagaaaaattaatagtttttttttaaattaaaatatgtctgtcataagaatatgcaaaatcccaccatgagcagtatggaatctgcccctaggttgaataaggtacacaaacttctctttttaaacatggggacattttattatgaatttagaacattccattgatcatttcttaaaaagatctttttttacttatagcttgaaaaatataataaaaacaatattgtatagtttttagcaatttttaatagtttagtagttttccaaaactttaaaatttgctttctccaaactctacttcttaagaaattctttaactttcacaataaatcaggcttttgagaagaaacttatgtttaaaagtattgttatgatcattttttcattcatttctaaaattcaaccagttaaaagtcatagttgtgccaaactctttaaaaaatagcaggttataaatatataggaagtaaatgaagaagcaaattataagccaaagagaaattcacagaatgtgttttcaagagaatagcccactagaaggagtcaaatccccaatttttctttctttttctttttcttttcttttcttttctttttttttttttttttcctgcatggtagatgctctgctgaggactgaggagctggaaagtagctatggctcacttcatgagggaagaatacatctcttaggcttttccagcttcagaggaattcctgggaccaacctatacaactcgttggtgggaaagtgcttctttctgactgtagtaaaagcctaatcaatactgaatggaagagaactctcttttggcagaaggaatcatagcctttcagagtaatggccataaatggtagttctgttccctttcctctgtattaaagcataatgctttcctagtattcctaattttgtgtgcatttctcttttcagttggatttttctctctaatgttgtggctgatgaaatggtataaaaataattctgtgcattaaatgctggcatagttagtaaaagttacaagtttccttttaaaaaaagaccatattataagggtgacaggacagaaagatgtactgttgcagaagagcaatatttggcaccactggtttaaatttcacacatagcaacagaaaatgctttctgccgtaaaaacaagaagaaacatgtctcatagcattctaattccagcaggattcttacctggtagccagaatcattacaggtcatgtagcatttaccacagttgatacacatttcttcatcaatcatagccacaacttgctctacgttgctcaattcaccaaatgttccaaggtactgcagtgcttttcctattacatcctaaaaatagccactgaattacttagcaagctcattttaaaacattttcatgtaataattaatatcactcagcattttcctgtttttatacaatgttgcattatattaacttgggagactggatagtataattctcatagataagctttttatgataattatagcttagatgtttgtcttctgaaagatgggcaatatgcatgcctggcttagaaatacgagacctaattaactgcattcaataggtttttgactggataatttaaaacagcatttctgtggacagaaagaataaatgacacccgtgtgagttgttatggctaactttttctcatttttggaccttgaaggaccaaaagtaatacaaagtgacaaagggtaatacactatgctagaaaagtttagattgctcataatgaagggaatacgagtgtgaatgttatgcatttatttcactgcatgaggattttagattttaatttaaaaagtgctgtgatagaatactcacctgtcatgtcttgaagagtatgcaacattatttaaaaattctaatttatgttaatcgcttaggttgatccaataattaagtcagatgctcttttactttaaagaactagaattttcttcattcaccattgaagatctttcatgtgattacacattgctttgttcttcatactaattgggagtgtgcctaatatgtgaagcacagactatgtttcatcaacaataagaaacattttgcttcataaaacaaaacaaaagaatgtagcaatgtcaaattagcatgctgtcaagatttttgcttttgtttttaactattaacatgagaatcttgtttgaattcaaggtccatgttcaaggaggtttgactcttagttaaaatcatctttccatattctctttggtattgcattttctgctatttttataatcttgcttactcttctttacttttttttctatttgatctctaaattataatatactcattatcatggaatttcaaactgagacaaagtttacatttttatacagttcctttgtgtatctttcaagtgataagatgctagaaaacttccaatattgtcttccctattttctttataatgcattgaagttataatttcaactacactgcagtctgtttgtaggtgggcacttgacatccaaatcaatatttccattttgaaatgctcccataaactcaagatctacatttatcagctgcataatgagcactgtcattagagattggtacttcagattctctactcactgaacttatcatcaacaacacgaactgggtcttcctttgtatttctttagttttgtgaatagcattacgatttttccaatcacggagtcttggaatttcatagttatatgtcactacataacttgctccaatatctcctatctgttgccaagtctgggttccagatgtgcaatatcttttgaatcctttccatgtttactgccatctttaaacattattaatgaatttctcattaattttaatgcaattgtaagagactacttgataagtttcatcctcacattcttcctttcccactctaccctgggcaatgctgccaccttaatctaggatgtaagacacagactaaatttctcactaccttattcaaaaatctgttgaattaggcacaggcttaccacgctggcatttaaggctttctgcaaacatgtctttttctatcttatttctcagtttcaaacaccatgcacttcagctacactggaggacacacttttcaactgacccatctgagatctaacattaggttaaatcctctgtctaagatacctttcattcctaactccactttgcaaaatcccaagcatccttcaaagacatctcgaatgccactacttcatgaagatttccttaatccttccttcttctttcctaaccaaatgtgaggacgtgatctctctttcttcctctttctcaccttttccccttttcctcccttccttgccctctctcctccatatcctctttcttaaaaattttttttgatggccaatatctattatatggaactaatgacaacagataccttttgagttcttaatatatttcaggccagtgccatatgttttacacattttctcacttaaacctcatgcatttaatagttgatgatgtgactgagatttaaagtacccaattaagtaaatgatgaagcagggattgagaaccagtgttgcctgactttaaataccacgatcatcagcactctgctatgctgactcatttgttattctgtatttagcaaattctaattcatgttatggatattttctacatttagcttcccatgttgtggtctcttagtaagctttaattcatctgtgtatctcatgtggtgtatcctgtttctggagatcattgaaacacaatgggtacgcaaatatttgttaacataaatataaattttatatatctatacactaaacctataatatggtagtaggcacatagtgggatgaagtaatagctattttactgaacatttttattgatatgagtattttaaatacaaaataatcatagtcaaagtatctgaatatgtgtaatatttcccagtactattttaaaataataaattcaagaggtcactatctggctgtaaaagcccatttatatgtgatagaaaataattttttaaatctagtaaataaatcaacccaaagagttgtttcactgaatcagataatggtgactaaaatcatcaataaatattcaaatgatgattatacaggaaactctctaggcagtcaacaagtgtataagccttcttcaaaagaaacgttgtatatgccttagaaattttacgtggagcaagtccacattctgtgtacattaaatatgccttttcctctaaattggagatttgcttttgtcatttattaaaacatcattgtttaatgtgaagccaatgtggagcctctagaagttattagcacatggtgttaacaattcatcccttattaagtacaattttttaagaaaattatatttttttctttatctggaagaggataaaagaatgacaactattttaaatcattttgggaaagagtagcaaaaaaaattattccatgtggctaagaatgtggacatttgttttaatcccaaagcctccaggtagtactaccagcttatgaatacccttgagtagatgtcctggaatctggagttggctgaaagatgcataaaatcagtaagtcacatatggctagtctccagcccctcttgtacacacatctgtggagatcagggaacccatattcattattccaattcattattacacccatttggatgtatgaaggttcagcagtatggtgtagccatccctgattagtggaaatggttatatgtagatatgtatgtggagaaagcaatgttaaatcttttaaattatagatgataacacttaattttaatgtaggtgttcaaggaatggatgttgcaaagtactacagaattccaagatcccattattatcaatttattacttgtttgagataattaaaagttgtcgttgttttgttttgttttgttttgtttgagacagagtctcgctctgttgcccaggctggagtgcagtggcgtgatctcggctcactgcaagctctgcctcctgggttcaagcgattctcctccctcagcctcccaagtagctggggctacaggcgcccgccaccacgcccggctaatttttgtatttttagtagagccgggtttcaccatattggcccggctggtctcaaactcttgaccttgtgtccacccgccttggcctcccaaagtgctgggattacaggcgtgagccacggcgcctggccaagtttttttttttttttttaatagaccagtcaatgtttctgtttgatataaagtttaaggccaaagagtgaggaactagacagccctgattccgtccctgatgtttcattctgaatttattacgactaatattaatttattagttttggtctatttttaatagctgatggaagtattttcaaactgtgattatctagcatgttagctgttctttctagcttcaagtcttcatatttgattagcatgtatcatatcagtttctactgcatgcctatggctctcgccctatcttaaagtaaaacaaaagtcataagatgaaccattgtaagtcacactgtcgtaaagtagaaagaaaaatcataagatgaaccattgttaagttcttaatatgaaccattgtaaaataaaaaaaaaatcataagataaaccattgtaggtcaggactgtctgcactttgtacaacttctgcaaataagtatccttcaaaaaccaggacccagaacagcatgctgtgggcagtcactatgacttctaacccaaaaacattcaatatttaaattatttggatgtagctatttaatcatttaactatttccttatctgtaccattaccaatgtcatatctttttatggtatattcacttcttgcctaatgcatctttcaaaacagaaaatgagataattcagtttgctcttactgaatttatgctgatttttaacttcttcctttactaatgctcccaagtcaaaagctgaatgacgtttgtaggattcctttggggttagatctcaatctttctgatttgtttccatcttttccctacttcccctacaacatccacctttttctttgggaaagaacctggagcaacatttatttttcatcagtgtggtatagtgatctcttacaaaagcacttaaaaatatagcaggtgccttattctggatattctatatatgccctctgagcagaaggcagacaggagtactgtacagtaagaaaaggacatcttaagtttaaatttggcagaactctaataactaaggactcggcttgaatatgctgagagcagagggcagagacaaagtatgatccagaaaatgaagtattagattggccggcgagggtgagagaagcaagtaaatcaagagatggaatagcggcaagtgagacttttggaaccaaagtagtgagagcggcttgggtgagagggagattattagtgagagagtcagatgagtaaggattggccaggagcaaagttggttcagtacctgtctgtggccctgatcactgtattttttctatctgggatgagctcaggctttaaagtggtaatgtcttgcaagacactttggatttaaattcatttaatgaaggtaagtgtatttctacaatatccttaggtatcttaggttttaactctcaaatatattttctctactctttttagttctgataaaattctttatgggattctagaaagataataggagtcaaacagttctctctaattataatttaacagtgtaccacctgctctaagtagtgagtattaatagacaaaatatgttgctatttttcctaatattttctccaaactcagatcatttgaggctttagcacttctgacctgtccttaaatcttgatgccacccttttatttcatcattggtaatgtgatctgtcttttctcatataagcaccaaacactgagttatctaaatgcataacctttttcttacttcttaggaaacttagtgattatataatcaaatttgtacttgtcagcttctcatttttcttgatccatcttcaggttagagttgctgactataagataatatctattgttttctctgaacttcctgaaattaggtttactaaaggtgggatacttgcatttctaagctcagacttcctttcattggcctaataaactctaagttaacgtggaatggttactttccttcaagattcctttagctgccattttcttcaaacagacttttttagccagaaataagccaaagcagcaagtcccctcattacttgtctctcttttgtgagactgaatttccaacaaggcaattcaataatttttccgatgttttgcctttagtggagtgggatttccatctgaagtttgcaaaggctttcatcactcctctgtcttgcctgtccctattaaccatctggttacaaggtctctgaggcagtcccagggtaacattttgtttttctttcatttcactctcctgcagctgcttcctccatactccaccctgaggtttgtggatttccatgcatgtgtataatttttttgatagatactgcttctcccctagcccttccatcagacccatttattccagacaagatacacctttccatgccataatctggtcaggaatcacatttctacaaatccccataagacttaagggattattttaccaaattctcttcagtttttaaagttcagtttgataattttcatctgctatgtgttggtacagggacaagtgagaatattaaccttgttcccagcccatttctctggtatcttttggaaattgctgggcaaggcctccactatttttctttctgttccctcctgtttatgctccatagtatccaatatggtcttgcagttttatctgagtactcttctctttcctttcacaattcaattgaaataataaagcactcgatcaggctgactggtgtcccgccaacactgtcttgccagtcttatgagatgcagtccatctcttactagaagcagcaggaagaagagatgaaaacatcactagtgcccctaaaccattcattttcctacgcagaaattcaaagacgttagagatacattcccggcttcataaagagaatgagaattcattctcatatatatcaacagaagtggaaagcattcgggggactttataagtcttggcagactctcaagtctctgttatatgctgcctgggaataaagcacgtttctcatttaactgggccaaatgtgcacactgtcacttcagttctctcagcgaggaaacgaaactgcctcctgtaggaggcattgtctggtttcttttctctagcacaggtgaacctgtagaatatgtcaggagcttcttcagaaggtccttgttcatcttttagaaggaaatctttatactcattgcaggaggccaggtttctttttcttcttttatctcattctttcccatcagccttccagtacttcttttgataccctcttcttcctcagaatctttttctttctgtttcccttatggaattggtagcttcataatatgggccatacgcatggtaaatgctatgctattatgcattggaaatgaagatgtggtgttgataaaagggaaatcatgcagatgccaggctgtccccagggccccagatcattcccaggggtaggacggagggcctctgaggccattttgtttgttttttttttttttttttttttactttcaaggggctaggagaatcaggatgtatgttgtctagcaaagatttctggttctcaaggactctctagtccctggataacactgggcataaccatgcttgatgttcaaatgaaattcatagcagtttaatcagttgatcccattgcttttttatattctgttattaatactgatttataaaacccagttattttcctcattattgcttctcagttctgtgctttctatgaattccaatttaacaaaagaatgagtttaccattttgatgtcactatctgcttgatccagggattatgtattggatttaaggtcccatggctgcaggttattacaagtatgtttgaatactgtgctttgcaaacatactgatttgcttgaaatgccaccttccttttctttcttatttctatgtttcatgagagacagcagaggacagtgcttaagggcccaaggtttagagctaccctttggaatcaaatcttggctttgatatcttcctagctgtgtgaccttaggaaagttatttaacctttctgtttatcaattgcttactccataatagcacagagggttattgtgaggattaaatgagctaattcgcaagcacgtagtgatgcttgaaacctcataagtactcaataaatattagcttttattattaattctctgcttaattaacactaatttattaaactccattttaaatatcaccatctctgtgaagctttccacaattacccaaggcagaactaatccctttcactcctctgttttcccagagcattttgtacatatttgattgaactgtaaataatttttaacatgtgtctttctcccttgctagactatgagctccataaggatagacgtctttctttttaaaattcacgttgtattcctagtttctagcacaatttctggattgcagcaagtgcataataaatatatgttagcactacatctccatcgagattacaaacatcctgagccttggaccatgccgtgtctgtttttttgaatctcctgcagtccttagcacactgctggtcacacagcaaatactaaatacatacttgctgattgactgatattgaaactgcctacctctgaagaaatagaccattaagtcattaaggcatttgaaaggaaaaaagaacaaaagatgagatctactgagcatagcttgcttagaaatattattgttgcattcccaaccagggaagatggggtagatcagaaacttgaatgcatgactgaaaaacttgttcagacaagaggggcttagttaactttgtgggacactggggttctttctacagcagatggggaataatgtgctgtggaagctgagaggataaacaaagcagtgtcatggagtttaaactatcgaacagaggaatctataaagaggccagcagagaggagggaagaaacaagctaaaataaacagatgggtggacagagaaaatattaagcatgaaaacagataacccaggtcctccaggaaaaagggaagtaggaaaaatggtatgtcaagaaagaagaaacactctagggaaaacactgaagtaatcatgtagcagcaattacatggcgtgcctgggtgtgtgctaaaaaacagcaataacaaccacaataaaaggacaagaagcaatgtctgattcatgtgcagacagaaaatgactttaaagggaatgtggccgttaatatcaacgtggactgaaaaatcacacagccacatcatctagatgtggtctgaaataatgggcaaaatggcagggacttgtataaaaatgacaataactgtggctcctagaatttgaatagagctgtgctgtgtataatactttcacacatatcttttcatttaaaacaatggagttgaggccttctgacattatccagtatatattttccctcctgccaatcccttgcctggactgttacaatagcttctaactggtctccttgtttctgcccttgcccctctagcaaactgtatcaacactgcagccagaaagatcctttgcaaaaataagccagatcatatcagtcttcctttctaaaagccttactggtttcctgccaaggactttgctatttcagggtctttgcactttctgttcattctgaatgcagtgttcttcccctggatacccacatcattcattccctcacttttttaggtgtttgcccatatgccattaaacaggcaggtgttccctggccagtctctctagtaatttttattctcctaagcttgttctattttctccattacacttgtcaccatctgacatattatgtattcatctgtttatttgtcattgtctgtttctccctactaaactgtgagctccatgagagctgggattttcactactggattgtgccaatgactgctatagtaccggaacatagtggttgcacattaaagattattggacaaattaagaaacatacatggatgaatttgacaactgttgccaactagaggtggaatttcattgattgcatatgcgagacaaaatgaaacaatacaaagtattggtaaaacaatcggtgctttctgaccttgtggaccactttcctattcttaagacttcctttttgtatttcttccacactatcattttattttggttatccttctctttctttgatcacttcttcacatttgttcctccagaactccctacttcttcatagagtattaggttaagtaagaaataagaaaatacatgtgcagcttctatcttgggtctggaacacagtgggcgttggaaatgtcagctctttctcctttatatcctccagcataggcccataattcctttatcaatttcaatacattcaaatctaagtttttcatgctacaccccaaactcccctcaaacctaaaacactaacatcaaaaccttaactcattatcttttatttttctttatctctgtggaaccataaaaaagctggacatcttagtcttcttattatcagctctttactatacctatgcctaatataatgagaatcactgactcttggaggaagaattaacaagactttattaatttcatctctgtttccattaccatagccaattaccaaatccaggaccacattatggcatacctgaaatattctcagttccccattcccttctaatctctacttagtctacagggctccttaaatgtcacttcctcaaggaggctttcattggccccttcaatctaaattaggtctcactatgaaacagattctatatatcttgcattttttctatgtagctcatatcaaaaaataattttatcttgttagtgtgattccttaatatctgtctctttctatattctgtatgctttatgaggacagaagctgtgtatgttttatttattgccctgcagaagctcaattcctagtgcattgcttatctcatggtaggtatgcaataaagatttcctgaaaaatacataggcttcttcaaaacttccaacttttttggcctccagagctttatgtatttctattttcattcttcagttcattttattggacaaaatggaaatgaatagtcatcttaacgtggatttctttcaaactgttcatttcaaatattatagctaatagtaacatttatttaggacacatttggtgcaggcaccatgctaaaagcacttcacacatcatctaatttataactctatgaggcagatacttttattatttccatttcacagattagttagctgaggcaagttcatgcagctatgaaacggcaatgccatagtttgaacctaggcagtgtgacagagtagtcccatgcctaattcaggaaattctttcaccataaatataatctgttaaaattttacaaactttgctttgtatttcaatgagggcaatagtttctgaagacatttttatggtcactttctttaaatatgtctgcttgttaaaatgacactgggaagtccaaattcagcttcatgacacgtctctcctcttatgcaagatatcttaatatattgtttagactcctttccctctctgcttgccaaagatgtagtttccttaatcatgccctttctggcagcttcagctattctctcccaaacatatgcaagcatatgcaagcctggatcgttctcatataaacaaaacaatcttttcctctactcgattcctcttcttatccctttcctactgacctttctcaagttactgaaagtgtattctgcacactttgttgttactttctcagtcttcattcattcctcaaattatcacctcctggattctacttctcatcattccattgaagctgcttcttgggtcaggaaaagctaaaatgtgatgggtctgaaggttatgctaaggagcttaccttaggattacggttacaatgggggaattttaagcaagggataaaacaaacagtcctacatttttaaaagactccttcataatagttggagaatggattagataaggaggacaaaagaaagcaggacagttaatataatgttttagaattccaggaaagaatacgtaagcaacacactgaggcctcagcattatgtaaagaatgtaagaggagggagatgtaagagataagaacaatagtcattgctgactagcttgtgaataggatgagtaataagatgacatccaggctgaactgcagctttttgagttaggtaagatggggttcattgagacagaggactcaggaggaagagcaggtttggaaggaatgggaatcagtttagttctaagtatgatggctactgggttccttggtcagacgatgcaggtggaggtgaccccaagatatggtgacacaagtctgaagtatagaaaagatgtctcggatggagaatagttgagtcattgtgtaggaaacgtttagatttatcataaaggaagattatacagagagaaggaagcagagaggtgaatacagacaccaacatcatgttctttcaatccttttctactttccccaacctgttcttcagcttccatcatatgagactacacgctgctctctgaactcagtgattttctcaaggcccaccttcccctacctcttccatgaggttaatatcagaaggaaaaaggaatcatattaaacatatttcaaagtaaaggatcaaagctacaggacaagaaataattttgttttgtagaagtgtaaaaggggtattttaagtttggtattaattaaataaggagtttagaacccagaattttgaatttaattagaagttttcatttataaagatttaaaaattgtttattatggcacaaataattacttacggcataaaacttttttctagagattgaccatccttattagaaccttgtctaattcatttttgatttgtccttgaaaagttttggaaaactttgagaggttgaaaatttgaatataaagtaaatgatgcaatttatggtacatttttgtcactgaattataatttgagagatgaaagggatccctttaaaatgcaaatattgaggtcttggaacaactgtctatttggaaaaaaataaagttataactgtacatgatactttagagccaaacaaattttagagaaattgaagtaaaatacaaatattaaaatcctaaaacaactagatggggtaaatactgatataatcttatggtagaaaaggttaacctaagcaaacaaacggcaaaaatcacaaaatgagcctttgctagagatgattacacaaattaaagcttctgtgtgtgtatgtatatgtatatatatacatatatacacacacacagttttatagtataatataaatataaatacacagttttatatttataatacagttatttgttataacagatttaatctctaattttctaaagagataactgcatttataaaaactgaaaatgcttgcttccccgaaaacctcgccactatcagctactattttgttttttgacagggcacagcatctgcctagaaatgacaacaggtggaatgagtatggacattctggggagaaggccaaggtagtggaaaatccaccagacattgagaaaatctaccacagctgcccattaagatgttgacactgataaggtctaagatgctggtaagatggtatctacaatgtcttgaggcttatgtaacatgtaacaccaaggacatttcactctggataacctccaaagtaagacaacttaggagaggaacataaacttgcactatttttaataagatgccttattcctctttgatacttcagaaatctttatctacatccaagacttcacaattctttggtttaattctgactttgatttttttttgattaatgatctacaggctttcatgcaaccacagattttttgtttgctctgttttgttttttgtctaagttatcaatatttaatatacaatctctgaaagatttgagggctagaaaaggtaaaaatgctttcataatcatattgcacttcttttatttcaaatataaataatatcttcctttagaaatttttacacctaaggaaaagatgcctagagatggagattttacatttaattcaaattgattaagaagagagagaaagctgggagaattcctattgagaggtgaagccagctggacttcctgggtccagtgggacttggagaacttttcttacaagaggattgtaaaatgcaccaatcagcactctgtaactaggattgtaaaatgcatcaatcagtgctctgtaaaaacataccaatcagcactctgtaaaatgcacaaatcagtgctctgtaaaacgcacgaatcagcagggtcctaaaagtagccaatcacagggaggattgaaaaaagggcactctgataggacaaaaacagaatatgggaggggacaataagggaataaaagctggccaccccaaccagcagtggcaacctgctggggtccctttccatgctgtggaagctttgttctttcgctcttcggaataaatcttgctgctgctcactctttgggtccttgccacatttaagagctgtaacactcactgcgaaggtccacggcttcattctcgaagtcagcgagaccatgaacccctgggcaggaaccaattccagacacactatatctccaaatcatatagtagtcatagccacacattggcaaaaaggctcgtgaagggctgtaggttctggccttcgcattccattagtgttcagtttgttcagttcatacttttagtggcacaaaaataatttaacatgaacaactcaagagacgatttggggcttttatgctgttaaaagtcccaaatgttcattttatttagaatgatggcattgaagtgctggcacgctttgtggtcagccactccctttgccctttcggaactctgtattgctgaaattttggaacattgagtctggaccactgtttttagcatgagatacattttttttttcttcataggtagaaggaatttttaagggttccagtctccagttgactgctaaagatgaatttcagtgaggtctacttgagaacacataaaagcaagcttttcagctgatatttcaaacagaaaatggagatgtaggagtagagtgtcatcaaacacagaagaatgaatttcagtaactgcaaactacattttagtgatgatgatttcagacagaatgccatccagtaacacctccatttttctcattatgactgcttggaaacaatactgtcttgagggtgacagaaaaaaagaaggcgtggttacaaaagggttacctgaggaatcctggtggtgatgtcactgttttgcatcttgactgtggtggtggatacatgaacctccatacatgacaaaattgtacagaactaaatacaacacacacatagaagtaaaactggaaaaacttgaataggattggtagattgtgtctgtgtcagtatgctggttgtgttatcatactatagttttgcaacatgcaaaacaggtgaaactggataaagggtacacaagacctctctgtattatttcttacaactacatgtgaatctacatttctgtcaaaatgaaaagtttaaggaaaaaaatcaagaaaggtaacacatactcataattctatcttagtgtaatttttgttattaccagaaaataatctcctgagacccaaataaatgtccaggctttccagaggccaaaccagagaaagtttttccaaaactttcaagtgatcacattgatattgatgtgcttattgataattgagttgtactacatgactaatacaagatatcttggagttaattatgtattaaaataatttttaagtgactataagaaaactaggaatttcatcttaatatctcctgatacatttaatgtatataaaaatttccatgacatgcatgcttgccagtgttctaaaaagtataaaatatgcaaataaaaaaggttattttataatttaaatgcagttttcaccatggacagatgtttttaaaactttcattataattctaaaaccaaattagtgatacatttaagcagtaaataaacattttaactatatttgtatatttaaccagtaaagtaggcatacttatatagttggcataatttttaccttgatggtaggaataggccttttggggataaaacagtttctcttaagtggtgaaaaagctacattttgttctttcagtctaatcttgttttctgctatgattttcttgcgctgttccagataaggtccaaaacttggcagtttctaaaaggaaaacacacaaataaggaagcatgttagctcagagaagagaaaaatgggaagatataaacatataaatattatcaacaaacaaatgtgtgtctagggattgtttcatgtatactgtaactaggtcttcactcattgttttggaccactagtcttctcggtatcaggttccgttaattattaaaaagaacacaacagtacaatacttttaccaaatatgtatgtattacatatacaaatgttaattaaaatacatttctaaatggaagaaagttcacaatggcaaaccaaacccattcacataaaacaacagctattagttaaaccatttgtttggtttgtatagacagaaggtgaaacctattgatgcttttttccccttcatcaggtttttagcatgatatagacacagttgtagtccctgacaaatgcttttgtcaatagcaaaggtacttcgccaaagttctcatctgtatctctattttattgtgttcaaattcttactacatctctttaaagattgtaactaatgttgattgcaacttactggaatagctgaaaaacaaaaatggtaaaaatattgatttctctgtacagaaaacaaattttattttgcatggaggcaaaaatagaaatgaaaaggagaggaaatattacagtgcttaaacaaactccatcagtattcaaaatcacatcacggagctttaaatttcaaggttatccaattgtactttacaaagttcatttagaaagatacctgggcgtcatggaaaaatgctaagtggtttcaagttaacacgaaaatgccctcataccattcattatcccacaattattttctcttcactttgtccttcccctcttctagaaactttgatcttcacttttactgacacatactgctggtgatagacatcactgaattccaaatgttttgtgtcggcctgtaacctggaattggtaggtctctttcataagactgcaaaaataccctctctctcctgcagaataaagtccatttatctagctgatggaggtttggaaaactacagcactcgaaggtcatcctgatctctgacctagcaagtattttggtgaaaaatcacacttgtttcaaaacactggcctccacatttcagcttgcataacgccccaggaaaatgagttctctggtcctctagagacctcagtagagtaggtaagctaaacttaaaccatgttccaattaagccgaactgcaaactgcaactgtaattcatgttagcaaagaacatacttatgtagaaatatctaagattgttacttccattatcaattcattataattatgtcaacaagtcaagtaaatggaaacaatgttatgaatgccaaactaatttatatacaatgagactagaactgagtacttcatctctacaccttaatgctttcttaatttgtaatatttaattgttgcagtaatatgaaatgataggatggagggagatagtattttgtatccattttgctataaaacaagtgatactgacttgctaaaagcataaaataaataagagtataaaacaagtccttatcacatatataagcatccttaaaagacaatgcttttatgaaatggctttttcttggggcatatgaggtatatgaggtgttagggattacacttggtgccaaaaaaatgcctttggggtcagataacaccacataaggtggcgagcacacgtccacatgatataaatcttcagaatgtcaccccctgcgtgcttctcttatacctcaggggcatctcaatcctaatctaatatactcaaagactatcaagaacggttaagtgttgaaacatatgacctctggttctagcagatgcctcaggttagcaggctccatgaaaatcggaaccattattttccctgttggggtttacatggttctctgtttggactttaccttactcaacatcatctaatttcacctaagagttttgtaaaggccattcaaaagaaatcattcttgcaaccttttaatctatcttcctttaaatgtacatcagaggatagtatattttttcatttagattattatttatccaaatgcagacaatgaatgtagttaaatttaaaccataatgatttcaaattatttcaacaatggtaataagaacaataaatttttgaaaatcttttgatgctgaatataatacagcctgtgtaaatatccaacagcctgatattttctgtcattttttgcaatgattgaccacatttgccatacataaattatgttacacagccttcccctggctaacatgctaagtttctaatgtgctaattggttttataattagtcctaaagagagaatctcaatttaacataaagattcctacaggattttctttgtgcattggttagaagaattaatggactaaaaggaaaacttgccaattttttttaattgaaagcaaaaaaaaaaataccaaatatcagtgactgctccttccaccttccaccaagcatctccacatcaaattgggttcatttttgtttaattcctcactgctacatggagctctcagagactaaggtatagtaccagcttccaaaacttcaaggctgctgtagacattttgctttccttattagtttgaaaatttaagtgctttaaaaaatatgttgtatatattaaagtggtcctaaggctatttaagtactgaacattttaaaagtaaagttttccgaaaacaaaaaaacatcaattctctcccgcaacaaaggatcaaccgatcacctttacacatactacatttaggcatacatttgtgttttgatcttgcaaaaaaaaaaaaaaaaaaaaaaaggaagaaggataaagcaagcaagcaagcaaaacaaagctaagaaagagtgaagatgaatgcatagttggccactgtgtgtgtgtgcaatcagtgatgattaataaagcatttagttcaaatctctgcctgaacatatagttaattgatttcctattgcaggaggagaagcagcaggacctgacagtgccagcagcaggagcttttcctcttcattcattattttcttacagaaaagttgtagcctgcggtaactcaaagtgagaggttttgagcgtcatgctatatttcttaaacaaaggaaaaagttctttaggactatcaaaagctgctttgtaactgatgaactgaacaaagctcagaaatggtgtgagttttgtttcaatagtttctccagggattcatcattgatgaatttgttctcaccagaaaggctaaatcctactcatttaaagataacagtatcttacactaaaactgtctctatccagatataaaaaaagcattacattgccgatagaaaagtgacaacataatgaatcaacaatgataccttaagccagcaaagctttaaggtaaagaagtctatttggattataatttattcatggatcaatctaaagttaattgagcatattatgaagtagaaaagcgttcttgtttgtaatagaagcaagcacttgtatcttccagtttaaactgcataatttttatgagaatggcagcaagttgcctaatagcactagtctgtagtactgtaatggatcaactttattttcttaatcacactctcttatctaattggaaaccataacaagaagacaagtaattactttgatatctaaattgtaatatgtgaaagatgaaaatatttccggcttatatcagaatatatcactcagtatcatatatatatatatatatatatatgtatatatgtatcttattcagtataaacctgaaatctattatctatctatctatctatctatctatctatctatctcctttatacctatttcgtgtgtgtgtgtgtgtgtgtctatacaactgacagactaaaggataagttacatgtaaaggatatctaaaagttgacttttttttcccaaaagacatgtttgcatatgacatagctctattatttatcagtcttttgacatttattcaacaaatacagtattgaatatccactctgggccaggaactgtcctgtgctacactaaaggctaaacaatttccagacagtgtagtacaaattatcattgttattaattttgtaagtatcttttgctattcattaagggctagtgtcagattgaattatatgtcaaatatacctggttgttgcagttatctcaaggaataatatgccagactccttggaaaactgtttgaactcaataaaatgaccaataattgcagagaaaaatgaagaaaataaatgttcaaagagttgatctttaaaaacctcaaaaagctaattgaagtagttcttggatacctaaaataaaaaatatgggagcagtgtggtataatggttgagagcatgggttctctgagtctgtttcattatctataaaatggccattgtgaggtttaaataaagtaatccaggtaaagttcctaactcaccctaatttcaatctctgctcagcatgattcaaggtagcacaggagatagagatgagaagtatcttttctgttctgtagtttctgaattcagttacttttcttctttcctcttttcaattatgaaagtaatcagttacttacatttgatgctgatttttatttcaaaatcagttttagcatggtttagaatcagaagctcagattttcccatatgtaagtggcatgtaatgcttaatcaccgatataacagtaagcaatgtttcatgatattatcaaatttggacagtggaacacaataaaaagacagagacagaaagtccatctacatattacacgttaccatagtgctatgtgatggctaatgatgcaaatcagtacactggcattggacatgtaaaatatatgaaatatgagtattagtttaacctgataaatgtaagctacaacttttgatcaaatatgtgatatctaaattggtcaaaagcagagatagttcatgtttcatagtgaaagtagaaagtcaacattcacatagtgatgagggaaataatttagaagtcaaatttgcattaaaatcagttttgcactcattagctgtgtgactatgagccaattactttactattctgctactaattttccttatcaatgaaatgagaatgacagtatcaaactcacgatgttggtataagcattaaatggaataatatttgcaaaatgcatgcctgccaatttattcccataagccttaactgcttctattgcattgtgtactgtgctctgtgtttccatgtttgctcatgcatcccctctgccagaataccccatcttgtctttttcacctggtacatgccaattaggctatttagtttcagctcagtcttcataacacctaagtaatctcctttaccgattaccctccctgcccagtggtttagaatatcctgggcatattttaatctctgtgcctactgcactgccttatcatcattagcttatgtgtccatctgcccagcttgagatcctagacaggtaactttgatccagcacataataggtgctgaatataatttttcaaagcttaatgaatgaatgaataaatgaatgaatgaatatcttgaatatatttacaaaatctttctggttgtttgaattgtcaaacaatcccaaacaattactttcagaaacaaattaaagtatataaataggttttcaaatatgacatgaagtaaaaaatcgtacttacagaaaagctgtgattcatacattcagaaaacatttataaggagccagacacttgaaatttatatagaaaggatagtgtgtgaccttaaagagactatattaataacaattgcaataccctgtgggctgtggcagaagtgacacaaactgttatatgagcagtgacaatgtgtatctaacgcaggctgaggggtcagagattttctagaagaggtgtcatccgagctaaactctgaaggataaggtgaaggtaggatggcaagtggtgcagtggaggcgtgaggtcaggaaaggtgaagagaatcctccaggtggaataaacagcagagggagaagggtgacaatttggaaaaggcaccggggagccaatggactgctaaccctctgttccatcgttcataagctacaagagggtgaggcacttcacctgtgaaaagcaggcagaacacattttgttgtgaagtgatgaagtcggatcatgaattaggaataatgtcaatcaagagaagaaagtctaacattcatggaatgccagcaaaggatgatggaaataagacttgctttctgctaagtgctgtgcaggtgctggggcccaggccacaaagaggaccaggaggctgttccttccaaaagcagtttatagccttatgaagaggattgagtcatattcaaaggaactcagataagaacattattattttcatattgaaacaatttaaataactcatatcaggtctctctttaaaaactgtcattttttaaagtaagtatttttgaagaaatacctctaggttgggatttaggaaatgtggtattgatggcatgttttaggagaaaccagaacaaagagatggtccaagcattatgcatggagaaatgtagaattttgaaggagagggggaatagaaaagagaggagagggtaaaaggaagtgtgaaaagagagggcaagagagaaggagcacagcctgttggtatgaggctgaaggacttttataaacagggagagccactatttaattttaagatgtttgcattgctccaatctaaatcctcctccatagtctttatctaagaacatctgctacacacttacatgtcttggtgagacatttggaggaaaatcagggaaacagggttgagtttcatggttgggttggcatatagctgaaaagaatagaaaccaacaggagggaggtttgagggagattcagaattcaatgacagctggaatttatagccagaagcaacctagagaacagaatctctggggatttggtagcaatttccagaaggacaggactgggtaaagtcagctgacatgtggcttacatacgtcattgtaaggagaaataagtagaggacgacatgcacaaacaatctgatgtaacccagatccaatgagcaattaattccaactcagaggttaatacaatctttacagtgaaggaggaatttaaactatgctgaaaaattctgaaaggggaaagcagtgcctagttgtaggaggagaagagaagtaaggaaatgaagtgaaggaactacaggatgagcttatccttatatggctaaaatatactaaatgtcagggagatagtgggggatgaagctggaatatctatagatagggctctgaattctgggcaaagtgtttggattttattctttagggtgtatgggaacaccagatatttgaaaatgtgtgaccagatcctcatagtggcagaaggaagggtggactgtaggatgatggcggtagcaaaaagggagaatcatccagaatgttggagatgggattctggtagtggtaggaaagtgaactagatgagttctaaggtcatcattattttcaaagctgttatagtagaaaattaaaaaagggttctatggtgtaacggttaattttatatatcatcttgactgggttaagagatgatgcccagggagctggtaaaacattatttgtgggtgtgtttgtcagagtgtttccagaagcagttagcatttggatcagtagaccaagtaaagaaaatacgccctgagtaaagagaatgtgggcgggcatcccccaattggttgatggactgcatagaacagaaaggtggaggaaaggcaaattattctttcttctggagtgagagctaggacatccatcttcgcatgctcttggatatcagagctctaggttcttgggcctttggactgtaggccttatagcactcgcccagccatctcctccaccatctgctgcccccctcatctcccagtcctgaggcctgcagattcaggcatagagttaagtatgccattggctcccccagtttttaggccttcagagtcaggctgaattacactacaagctttccttgttctccagcttgcagatggcacgtcatgggacttcctggcctctataacaacgtgagccaattcccatattaaattcccttttacatacctatatataaccaatgggttacatacagatataacctataacctgttggctataataatataaccaattggctgcatatagatatatgagggaattgaatatataacctattagttatgtatggatatataagagggaatctaatatgttaaattggctctgtttctctggagaactctaatacacgtagtattcgggaaacagagaaccaacactgactacctgtccccacaccaaggctccaatattgatcttcactcccacactgcctgctgactgcctcaccctgactcacaatggcttctgccttgaaactcctgcatgctgtcattcttcctgacagacttctatttccacctctttgttggtcatctttctgcagatgacccctcctttatcaccatcccctgctcaatcagattcttgacttttaaaattacataggaactttgttaactggggcctgcatagtctatgagctgccaaagacttacttcttagtcaaaaggaacataaagcaatgttggtggacaacctgggaagggtaaaatgacttagttttactttccttgcattctaaaggacctttgcttatattttgtagagatgatgaggtaggggaggtgacatggggaaaatcaatttcctcaaaaatggctgagaggggattataaatttaacaagggagagggaaggaactgcaccatcatcatcaccttcacgaatatatcagcttattaactgatcatggctatataccagacactttgcaaagcacatgagtacattatctcttccttattgcaaagaagataaagaatatccatgagttgggtattctagtgtccatttatacacaacaacactgaggggcataaagactaagtaacttgctacaattaattcaaatccaagtctgcctgatagactctgtgctatcctgccactcatacttctttgtagtcctcacaaagttttgtataaggtaggtgtttaatatgctctttatttatttaaagaagcatactacctacatactccattccttgaaatctatgcttcctgttttacttattccacaaattttgaagggaaaatgtttcacacagtagaaaccattaaaaaaaatgctgaacacataccaagcaaaatatctgaattagtttggtcctgtttattactggcctcaagtttaatgagctcaagttaatacaggtgaaaggccagggtgttacatgcagaagttaatgaaataccatagagctgctgagaaaacgattagcagccaaatgtgaatttaatatacttcatcttcaagaagcaatgccccatgggaggcatcttgctgggggaggtaatgtggcatattggaaacagcactcacttgggaattaggagatggggctctgatcttcactttgctgtcagctggttttgtgacctatggcagcctgatgactccctctgtgtctcagttttctcaccggtaacatgagggggtttgactacatgatctatgaggtccctcccagtgatatgatctgttttgttttcaaattcacaattagaattccttagggtttatgcctaggtggcatcacattgtctgtgaatgaaacatcagattgagtcataaattataactctttccatcctacttaactatagaacattctgagtctattaggctataacatatggatatcatggatcatgtttatcaaacttccaaggttggatgggttcataaactgttttagacttcattagtaaaaggtaaaactaaagatattgtagctattttacctcattactaaataatgaaatctgtatagaaaattaatagaactaaaaatatttttttaatgaaagctattataaatctgtatgaattgggaaattcatacagttcataactaacattacactgtaattatcttgacaaagtttgatgtctagttacaaactcatctgagacacactctatagaaaatcaaccacaaatattagaagtgaatataaatgataacaggcatgaaattactaaagaggtaagaataaaatatagatacacatgtggatgcatttggtacatattagagttttaggatttgggagaaaaaatagaaccttctactaaagcaatgcaatatgcagaatgatcattgatcttagaacgcagaaactagctgaatgacctggggcaagccacttgccctctgtaagcctcaattttcatctgtataaaacagaaataacaatgatcaccttgcccatttgttcttcaccacaactatttaaaataggaaaagcattaatagatgattaaaatacagacagctgttactattttgaaaactctaaagcattatagaaccaaagtattattacattgtgcataaatctcatttatgcacaatataataaataatgtaaagatgtgagtgctctgaattataaaaatgtcacagagtattaacaatacataaagaaagattttctcagcaacagtccttccagtgccttaggagtacttggatgaaataatttgcttttgaaacccaccttcaaaatgctactgctttcatggctaaatgttgcatagaatgtcaagggcaaaaaccaatgagggaaaatggaataaaaattgccttacacaatggaatggaagcaaaggaaaacagaaaaatgaggtgatgaggaaaatgggactgctataaatatggagtaaaaaagcatacaggattcaggctatatttggagcaagactaggttaatcaattttcttccatatttatgcaatatgatacctaatatcctcctatgcagaaacacctgttttaatcccttttacagcacaggacataaaatattacattttgatccatctaaaaccctatttagagttacagttcagagcatactggaatgaaatgatcatcattttgaaagtcaatttttagtagttctatgctaagcagcagatttatattggaaagaaaataaaaggaagtataagttttttaatataaaaaatatctttctaatataattaattagcatacatgtatgaaatattaaacatgggaaaatatattttatacatttggcagagtgctccacaaataatagcttctccatgcagctacagaatacagtaacaaacatccataaatcagaattcatctcaaatctaggtctcccaactccaagcctagtgccactccctctacattggccatgaacttcctgaagtttttgggctactgttttgcccaacaatacttaaagtttttggtgttttaggaaaagatactgagggaaggacctaataaactacatccttgggaaagactccttctttcagatgtatttgttgagtatttacaatttgtctagtacatgctatgcgctgaccattgaagacataatggagaataaaacagatatgatctccttcctcagggaatatgtaatcacttttagtgcaatagaattaaacataaacaatcccactcacctgcactttcaccctctgtcttctcttccactactaagagaggtatcctatgtcctttaaaagactccactcatggactccacctcacgtaccctgtgatcatctgaaggaatttgcttctgtcatttttatctttgactattcaacaattcaccctcatttttacattattttcattagcacacagatatactttagcgtctgtcatcctaaaaacaaatatgctaagcataacaaaacaatttctgtgaccctacagccactttcaggcatcattaatttacttcccttcaaacttcttttaagcatttttaatagtgtctgtcttcacaccttcacctcctattcactcctcaacatatccttttcaggaatttgtcctccattccaaacaattgaaatgcttccataatgaagctaacaacaatctttattgtgcaaatcctgtggccacatttttgtttgtgctcatctaactttatctctcagcatcattaaacttagttgacccttctttctttcttaaaacactatcctatggctgggcacagtgatttattcctgtaatcccagcacttcataggctgaggcgggaggataacttgagcctaggggtttgagaccagcctgggcaacatagagagaccccatctctatttaaaaaaaataaacaaaacccccactattctgtttttcatcctacgtcacttctaagtgtctcctttgctgggtagtacatacaccccaaatctctctacttttcaccatttccattgatatggctctagtccaaggctcaattgcctcatccttgggctactgcaatagcctcctaaccaatctacctgctttctcttttgacttggtataacgtatcctccttatagtagcctgagaagttgtcttaaatagaaactatgacagatgattcctctgcttaaaatccttcaatgatttcattgctcttagaataaaattggaaaacatcaccatgactgtaggtttatctggcccctgcccacctcttcaatatattttaaccactgtcccctttattcactacactccagccatattgttcttgctattcttgacaagtcttataagatcatatgaccttagggcctttacatttactgggtttttttttttggtctgcatccagatctttgcatagttggatccttcacatgttttaggactcagataaaatgtcacctcctcagagaggcactctcggaccacccaatctagagtaggcctttcaaatcacactcttcacatctcctttttaaaaatattcacatcgtttatttgcttacttttaaaaatctccaacccctctaaaaggtactagattaaaatgttcactaatcttatttactaatttccagaaccttgagcaatgcctggctcattgcacactcttgaatgaatgaaggtactgggtaattgtacatttatacacagtacagtcttgaacttagcttggcttccaattctggctccatttttactaggtttttgacttagtcgtgttttacttaacttttgtaagatctcagtttcctcactcataaaatgggaataatattttataaggttgtaaagattatataatttatataaattgtatagagtgaagccagagcttcatacacaataggcacttaataggcctctttgccatcattatagaaattcttatcatcaacattatttttattatagaaattctagcaatgtctcatagctttttattaactttgtgaattacttatgtacacagtgacactatattaatgtatttattttttaaaaatgtgcttttaaaatattttgccttgtgcttaatattacgatatagtaaacatttcccatcccttcagcaaaccatttctccagcatttataagggaagtcaatggattaagcatgttgtacgtgatggagaactgcttatttcacatttagactgcatacactgtataaagtcaggattgctcatacagttatgtaattttgtgctccacatgtttaaataagtaaaattaagaaaatgaagatttgatagttgacaagtaaatgtaaacactagtgcttaaagaatgaaagcaagaccattctgtagcctaaactagatgctgtcatctgtgggggttagggaagatgctaagatctgagcctgctaccatgctacttcacgaacatctggcagtgtgtcacttcacaggcaacaacatcttctctaaacagaagagacttgaattcatcagggattcctgtagtacagtatatgcttaagttaagtacctgctttcccgtgatttccatagattatcatattcatgacactgtggagtgaaagcattcttctcactctctaactagaacatgaaaaagaaattaaaacattggcaggcactttgtctccagtttgttggacaagtaagaaaaggactttccatccattaatgtaaatgaaattcggtcaacttagagcatttaaacaaagatgacatcagcctgtctattaataaattcttgacaggataacaattacatttgtagttgactgtttttctttcaataaatgtaggtcagtgggtatttttaaggaatgtatttaaaataaattcgcaaaccccaataacttttctcctcatctctgttaacccagaaagtaactttaacatgcacattcttgcttcttaagagtggttttcagaacattgtggtcaaagcctttttaacacatgtgactgtgtaattaaatatgtgtgtgcctactgtgcatatacacacatatacatacaatgcatatccataatacatatatggtatctatattctaccccaatattttgaactgaatcctatagaaagatttaaagctacagcgggctctctgttatctagggatggtttttccatttagggataatctgggcccttgtgttactgcttctttctgacttgtgcatttctttcattattgactatcagaaaggaaaggtaagaaaaggtaataaattgatctagctggttagtcctctagccttaggaatccatttcgtagaggaagaagaagtgaatttaatgaataaattgagtttggggggattatgtgtggaattcactaatctacctggcccaataccccattagttagatttgagaaagtaagtttctaaacagaatcaggatgagattttcaatttcattttgtggaacgtctttccaagacaatgtgttttctttgtctaggggagttttggagatggtatatgttgatatatttgaatatcagttataagtactaccaaaacagtgaataattttaccttcatttattacaaattaaaagcacagctctatatttcatcacatttaagatgctatcatacattgtttattaatacaataaacaagaaaatataaggaaaatatgttgtttaaaatattactaaaactttttcacattcagcatctggtaacttgacgatataatcaattgtaagacaaactgattcagaggtattaaaaatgaaaaaatgcatgtcttagatttggtaaaatgcattgtgttttctaaatacttactggctcagttctaagtctccttctcatcattgttagtagccataatacagtaatggcatctcattactcctagggcgatgctacatggaaattacatcatcattcctaaaaccctatttatgaatgaaagtccacattttggattataaaacttcaaaatttgccatcatagaaaagcaaagaataaaccttgttctacttccagcattatcccagaaaacgatgagtgactatcacaaagaaagagaggtgagggtggacattaccgtatgttcttgagtcgggttaagtccatacctgaaaacttctgagacaggtgtctttattgtttcttgactccattttcctatccatatctcttctactcttctagaggtatgtggtgctaaagaattttttaggttaaagactatgtacattatatatttgtatttgtgtcttctaatgtgaattcaaggagaaaatagcataagcaatatttgttccttcaaagaaactcaggatgtcctaaccattttataagagaatgatttccctcttgtatttctccatgaatgtctttgcatgagttaaatatttgaaaggttgacagacttagttatttctagaagaagtttctgttgatcagtgtgcaggggttaattctggcactgccccttagagatatttttctagggcagaatgagccacaaagagaaagatacacaggacagtgtcaatacagcatcactacgtcatttaatggctgatggtggttatggcagccaatagtctgaggaaagcagattttccctgaatgatgaaaaaaaacccatcatattcaataaaatcacaaacaaataccatatattcctgttaaccatccaatgatgaaactgtatatgtgaatacactaatgcattccttaaatgcaaattactgctaaatttctaagtaaactgtcttccacttcagagccattgtaatccatctcttatgtcagatgaactgtgagacttatccttctgatcgcataggatttactgctttttgtcattcatctctcacacttggtaatccttttacctcttccttccaagtttgtaatttaaatgcactctattcacaactgaaaaaaggaccatagtgtaaataggatgtctttaagttacggccaaagaagtcattactgcttatacaatggtgtgggttctattacacagaggacaatatgaggaggctcactcttcacttgctttcatcaatgttttgtgtcaacacacagaataaagggtgggtgctgaatttggggtcttcccttgctttgacttgtttcttatggtattgcaacattttgtgtttgagagaaaagtccttgactaccagcattggcccccatgagttcttcagtttgtcatcaacatggattctgattttattgtttgaaagttctaaaatagcaaattgacaaaattggtatttactcctgaaaatcctacgtggccatttcaaagagaagcacgtttagaagaattaaaaggtgcatgtaaaatgcttccataatatatttttaagtgaaagagaaagcaggattacagcagcacatacagtatgatcctaatatagtttttattatacttatgtattttcctaattttctacagtgagcacacactacttttataatgaggaaaatgttcttaaaagtattgtcttaaaagtcacactaacagaaatggttataaaaacctatgcaggaagaaaattacaatcattattatggtcacaattgttaccttatatgtttttaaaatatgaatctcaaatcgtaatttagaatggtagatatcaaagaaatgtatgctgtgggaggatgcatatgtaatgactacacagatggaaatatgataagtagacctgaggcccacttctaaaatatggttaaatacataataagtaagaaatgctcattcagttcagcaaagcactgcatatgtttgaggatatagattttttttattcctgagaatatgaaactcctacattttaggtctatatggggtgttggcaaattaatatcctccaagaattaaactgtgatgctaactttccaagaattaaaactataatgttagcttttattagagtgagttcttttctatttgcagctctcaaagaagaaatacatttaggaggatatacatatgagaatatttatatacaaaaacacagattaaaagtttgtcttcccaaataagttaaacatttaacttaaaccaatgtttgctgagcacctacaattttttaggtattgatccctctagctggctccctattcaatgagcacacccaaactgcctgcaccacgactgccttttaacgggggggctatagtgcatcttaccaagacacaagcttaggaggtccagatataaactatagctgatgtaaaatgacaaattggtcatgcacagtggcacacacctatagtcccagaacttcggggggccaaggaaggcagattacttgagcccaggagttgaaaaccagcctgggcaacatggtgaaacctgtctctacaaaaaatacaaaacttagctgggtgtggtggcatgcacctgtagttccagctactcggaaggctgaggtggaaggattgcttgagcccaggaggtcaaggctgcagggagccaggattgtgtcactgcaccccagcctgggcagcagaggaagaccctgtctcaaaataaataaataaataaaagatacaaatatataaatatacaaataaaatgacaaatcatggatttactatggaaatgggtagtttttctcacaggattaatttttgtacacaatctcctttctgcagtgttttatatacagataaatttgagttgtctttagatatctacctcagaaaatgctcaaaaaggcaactccaggccagtgactcacacctgtaattctagcacttcgggaggccgaggtgggtggatcacctgaggtcaggagttcgagaccagcctagccaacatggcgaaaccccatgtctactaaaaatacaaaaaaaaaaaaaaaaaaaattagccaggcatagtggtgtgtatctgtaatcccagctactcaggaggctgaggtaagagaatcgcttgaaccctggaggcagaggttgcagtgagcagagatcacaccactgcattccagcctggacaacagagcaggactccataaaaaaaaaatgcaactccagacccctggaataaaagcatatgacaggttgaatgtgctaacactacaaagtttccaaaataaaatctttattgattgattgactgaatgccttgtaattatcaagtgtcgctcatttatctgctgctttcaactatatgtgaacgtatggatgaagaaagacttcctgaacaatcttcactagaagatcgtttcagaaccatatgctaaagcaaagcttttttattgctatataactgcagaggacatttacaggaagctgggtcaagcactcttatcatgtttcttatgtactaattcaacctatttcctaaggtttacccacattcattctataaagttaatacagagacaattaggagaaagacaatccattgtatacatattgcaagaaacttttagtgtcgctagaatgtcgaagatgcaatttatcatactttctttagaacttttgcatctttattcataagtgaaaatggtctataattttggtctacaattttctgggttgtactattgtcaggatttagtattaaagttggtcaaggttcataaatttattagggagttttctgtacctttctataagttgtaattgttgaaataacatagaaactctgataaaacaattagctagtcagatgtgaaatcacttgtgcctgatatctttttaataataaattttaaaatttgcttccaattctatggatgattattgactacataatcaattttagtagtttttatttgacaagaaattactcctctctctagattttctgaccaaataattatatataacaccttttcactatttaattctctcctgcgtttgaggtaacagtagagaattaaaggattctgttttcattcttatagaatacatttttgcttcctttttgcttgagatttcattgtaattgtatatatctattgatcttttcttttcaaatgtcaccttttgttttatttttccttttctttcggttcttcctaagactgaccttgctgatgcaagggggaagtgacatcccttagaggccagcacatcgtctcccagtccaggcgggtcttccacccagactctgggcaccctgagctctcttgataatcttcagattttattgtgataacaccttctttttcccccttttgtttcccaccctgtcgttaaccttctgcttaaactctctttccatttctctttctttttaacatttttttttctaagccagaaacttttccaacatacaaagccatttaaaaacacacaggtagaaagcaagagataactataaagtagattccatgcttcctggcttctgcatggggcaggaactgaggagggcatcaaaaaaacatggttcaacaatataagctgcattgctgtttaagtgcctggaaacagcagtgcccattgaagagtactgaacgtggaatcaatactcaataaggagattcaggttctagggctttgttttaaatattttttctgccagattcaaaaattaactcttatctaaggaatcagtcaccaaatttcccttttactgtcgactcagaagtttagataactacatagaaccaaatggaagaaaaatattctaagttttataatcacatttatttgcttcaaaactttcaaaaaacttgtttgtttgtctttaataactcacattttggtggtttagcgcatatcatctgaggattgatgttgaatgagtaaattactgtgccagttgcaaacaggaaagaaaaaaaataatggaagaggatacaataatataataatatttagtgacaacgggagaaaatccctcattttttttcacagactttggggacagaaggttctttccttcaggtattgggaattttgaacaacaagcattcattagaaagcatactaagtgtgtgatttattgtgacttccagtgacataacagagctcaaacagaacaatatttatttgaaaaaaaagccatatggcagtgcattctataattctggcttatgaacattgagaagtgaatttttaggccatctacaatgggtctcagcactttagtatgtctccagaagtcaggtaacagctctccatgctagaaaaccattcaaagcaatgacatggaaattagcacacgagtgtcccgctttgcagcccagtcccttgatttctgtgatttgacaggaagatgatatcaaagactgcagaaaagtgttaagggacagctcaaatgctggtgtgtgtgtgtggtggagcaggtgagcagttaggattgtgtgtcatgggctgacaggagagggagtgtcaggctaccacgtgggtgaacatgggccctatcatagaaaatatgctttttgttaggattctcaatatctagaaggaggggcaacctttctggcatgaatgtgcaactgctgtgaggatccagtaaaaggtcttctcaggatttgtttaaaaaggtcagctcaggaactactgacccctctgacttcatcctgacagtttcagccctctcacaaaatcactcttgtcacttctagcctcctgtgcttttctgaaaacaaaaccctctaccacctgccatccattattccaccagcaagcaacatgcgctctcttcagctgatatttcaatttattcgtggttagatgtgcagtaatcctctgactgaagctgagggagcagtttaaagatttaaaacaaaacaaagccagtgcttcaaacatctcttcatgcaaagcttaccagatgcagaaatgtggctaattctcatccacacaaaagctaaacgaagacccgcagatggtcagtgcctgccctctgcagagggagaggcagggttggctccaagtaacaaataattatccaggccctttgtaaatcaagttgtaccacttctcctgtgagcatccacaaagacggctgcatatatttgctattagctccttctttgtctggggattttgttaatgccctttcttcatataagtttgtgtcgccttgttctcacatttgacaccaactgaaatagccttgcagaacctttgtttctattttcttcaaaatgtgtattcctcaatgaggtttcatcttaatctcttcttttcaaaaggatatgaattgaacatgcagagaatcagcctaacaggaccgattatcaatttccatttcctttcagcgcctttgccacccatgggccacctagacagctttccttgaagacaaagggtgtctgaaatggacaactttattttatataccagtctcttagcggacgacagagcctcatcgccagtaataaatccttctcctgacccttttatataatgcacagctgagctaaaaaggaaatcaatgttgcaattttaatttagcactttcattctgttaatttatctaaaaaatcctatgccacgactttaccttgtcaaaacagccaatttgtgtcaataggaaaatgtgaaaatgctctgagtctctcctctgcacccccaaccacgtttttagtagtatggctgtaaaaaccatggggcacatactaagccctccatgttttcctgtaagtacaaagcttcttttgcaaatggtgtgagctcagcaagttgaagaaatatggagggtctttagcgagaaaataatctgggaccacagtgttagttagctttgctaaagatgtttgtgaaactactaaaatggaatgccaagtgtctaagtatgtattaatggtgatgcctgagcatattagtcaactagggatattaaatcttgattaatctctggggagagttctaagtaataaataacactgtgttttctgtcaggggatcataaaataactctggttttactcttttctctctgtatttcacaactctagaataagccagggatagaaacttaatttactctgggaatgatgctgccacaggagaatgaggtcaactccacaccacactgcactagtgccatggtggagatgcagaggggtggagcccctgagcaggtgaggacctgctacctttccagtaggaatcttgtgtcaagaaattgtttcttcaagcctttattcaaatatcacattctcagtgggaactttcctaatcatcccattgacattaaaattcttccctgcctcctgccactcattggccttcactatatcccttccatgactttttcccctcttggcacttctgactttcaatatcactttataatttacttattttattatctatccccattccaatgatatgtaagtatactgctgtttactaaataatcctcagggtatgggactgtttttaacatactgcaggtgctcaaaaacatgtttcccaaagaattatcatgaggtcacttctggccagttgtttcttgggtgcaggaatggctgcattatataggttgatgcatgtaacaactctgttggaaagaaaaccacctcttgctttcagggtgcttttgaactctacaagagctgaacttggtacgggagaaggagccaaactccaaatccagggtaaggaattagcccaaaggtgggcttataaacagagtcagatcctgggacttatgtgtggctgaaataaaaaataaacctagttggtttgggctcgaaaaaaggcttcagctattagtccagcatgctgtaagcaaagtaattcaatgagggccattatagcataggtaccatgcttggcactgtaagacagacaacatcctggcctgggtctgcaagtagattatgatctagggaagtttacatacatgtttcagtctagagcagggcatggaatgtattatcatgggaaatcaaggagggtttgtccaagattcttgaatcttgaaggatggaaatgttttcagtaccagagatgagataaatggcattcaaggcaatgagaatgctgttaagggaagcagaatgcatttgaggagtagcaattagcctcatgtagcctacttcctttgtagatgtttgctggagtacggatgaaaagagagataattctagaaagataggtgactatcatatagaggctgggttttacatgttgtattattttattgggtaaccaggaatagctcttaaagaggagacagacttcattcagaagcctgtgctgtaggaaggatgctctattttggttttgtggcagtgatggggctagggataaatatgcttagtcaagtaaataagtatttagaagtactaggctataaagcttaagaactatggaatctatccaacttataactgtaaagcagtaaatgtagaatattctagaataaagagtcatacacttacatttcaaagacttcccatcagagactttgcaattttgctccttattctttctagtattcttaatctgaatggttaagaattcttcaaatgaaatctctttaacttaattataaccaatttcatcttatttcctcatatatgtacgcagataattaccacatggcattgcgaaaagtcagcctgttacatgcctgatgatactaagcaagtctactgttctttaaaaaaatgttgctttaatctttccttatatcacttactctatcccttcagttaaaaaaagaaactcttctctttactccttgctatctttatttttttttcctgaatattgacaataaaactgtatgtggacctgagaagaatgtgactactggagagactagtggatgatcatttcttgactcttttatgcaattgactttttagttctcaattgcactgctctgattagtcaaattaaatataaggttgcctatactctcagatatttttcttctatacttggatctcgttagatcagaccatcctctattatctttaaagtaaaggttaactaccatgtggccagggaatagtaaaacatgatgctgacacatttatttcagttttaaaggaaaaacctcagttttcagctgatgaaacataggctgaaaatcctaatgctaaccataacattgtaggttctcatttgaattccaaaaattgggtatctttacatagaagaaacatatttactctatatgtcggtcagtactaagatatacacacaaacagtttaccacacttcctgtagacaaaatttatttttttctaataaactctgcttctaacattaaggttaaatttaactagttcattgagactttgttctttattgtcctctgaaattggtattatgctatcaaataaatataagaaaaacagtaaaaattcatctgagtagggtttgaaatatagtaccttcaatagcccagaggactcacttacttttgaatctgataaacaaagtaaatatatgaagaaaaatatatatgctccttggcatcacatttatacactagcttatttacaaaatttttctttattggtcctttgaatgtaagaaaatccacaatctagatgcttaaaaaatggatgagaacatttattaagtaagaaaatatacatggacacatatatatgaatgcatatcaacatttacttttggttttaattctctcatttatctttcccaaatttattttatagtctatctaatctttaacagattttttgttgttgttgttagcttcattacaacatctgaaatatccaatttcctctatagttgctgctgtgtttcggcagacacctttattgagttatcagaggactgtgcaggttctgagccctgcagcatacagagtagcctgggtgattcaggtcaatgtgcaataatgaatctgggtccctgccaaatatggtctgccattgtgaagttctatctctctgcattttaaatcatgatggttttttgcatttcacttttccatggattttgcttcattaaacaactttggaaggagtattttgcactctcaatttttgcgtgaaagtcactgattaactggtgaatttatggtttgaaatgatgcaaggcctgatctgtaggaaccagaggaaaatttcctaatggacttcttcctgattttaccaaagcaaatgccctccacccccgccctgctctaaatagcacagatttctggtattttaatgtgtcattagtttgaccagacagattttagtccctaataaaataattctcctaactcttaggttatttatttcttaatactttgttgtgagataaggcagaaagacatgctaactgagctgcaatgcttcaacattatgactttagtaacttttctgagtaattttaaaaacatggagagctacagttacccaaaaaaacagttcaaggaaacaaaaggactagatttattccaagcacaggttcagtaggtcagtgtccacataataatctgtgctttgtattttccattatttcttttaacatgctttagtgtctacaaaggatgaaagaatatagactccattgtccacttggaatttaaccttcctatttggccagctactaggcacaaaatgtttgggttcagtggatataagtccactgaggaaagttagatgctactaaaattttcctgcatctttgcacaccccggatgatctatcccaccccaaatatttgtgcatccacacagtgaatagtttatctgatctcctcatagtgattttctggattacctttgctttatgaatttaagaaagtcacttacttctttttatctgctaaccaagaggttcataaatattctctaaaaacctgtgggctctaacatgggaagttagagagtacgtacttttcctagtgggtatgaaagaaaaactctaggttcaccctgaatagcatctggagggactgaattaatacagtaaaactgcaacttcaaaactctttttttagaatgttaatttaattttgaaacctttttaaaaggcttaaaggattctttttagataaactaacaagtggggaagaaataagccacttcttttgggaagttatcagtggtttcaggaccttgcagtggcaactggattttcagaaaagaagaaatattttaaaataatcccccatttttgactaagataagactgtttgcttgtgaatggagactcaacatgtataacatgtctcctatttatgtggatgaatcttgttttcaaaagactatcttgatcacatgagatcgtttttctcaacaaaaaaacagaaaaagtattacaccatagatgttctgatgcattttttctcactcatatccaacatctcatttgttatagaaaattaagtagatttgagtaaaaaggtataaaaaagaaattccagttttatgactttctagtacttataattattgtaactatgctgaatacttgcaaaggcctggagaatgagactcagtttactcaacaggccagaataagccagagaagcaattgctatggtctgactgtgtcctcccccaattcatatattgaaaccccaacctccaaagtgatggtagtaggaggtagggactttgggaagtgattaggtcatgagggtgaagtcctaaaaactgaaattaatgccttcataaaaaagatcttagaaagaccccttcctctttctaccatgtgaagttatagtgaaaagatggctgtttaggaaccagataataggccctcaccagacaccaaacctgctagcacctatattttggaataaatttctgtggtttataagcctgatttataatattttgacatagcagtctaaactactaagcaaaaaattatttttatatgaataggtacttttaagatagtttaaaatggttaattcggtttagtttagaaataatttatatcattcctttcttttgagatcattactggctaagtacaaaaagtaatttcaaaagtaaaacttttgagattaatagtacaatgataaacttcagccatgctcttgtctgacttgtcagaaattcccaatttttaaaaacaagtgagatttgctgtgcgtgtgaggctctttccagaactgctcttttggccctcattcttatggatgtggtattcagtggtgaatccaacctccacacatgagtatttgataaatttgctcaagtagaacttctagatgtatctgacacttgttcccatcctacttgttttttaattacctatagattataaggcatttttatatacatgttttattgaaagctctggatcttaacaaagcaagcacttgcttggatttgcctccctggcccctttctccacttgttcacactcaagcttgtaccaaatcaaattccttgcaggcccctaatgttccattacatatcatgcccctcagtctatgcacgtgcatgctgggtctcatatacccttcctccaacataatctaataggtgaatccttactatgtcctaggtcccaccttgatatggccttctccaggaagcactccctgatgacactcacttctatcacatctgagattaactcattcttagtatttactacactatactgagtacctgactttccctcaggcctaggacagaatcttgtaatattaatagcatgctgtctgtcacagacaactgttcaaatacattcgttgagtaaatgaacaggtgaatggtagctaaaacttcattttctctttagcgtgtcttttgcacatgatttccacatttcagtttttcttaaaattccctgggaacagcatcttgaaattttctcaaattttatattttctttaggacttttgtaccttgctctgcctgggcagtcctttattcattcaacaaatatttttgagttgtgtttatgtacaaagtactttacaaggttttctaaggaacccaaagataaatagtacttggatgttgctcacaaagggcttacagtctaattgaaaagggaagacaagtataaacgtagcaaatggcaagcttcatacaagggaagtgacacattcaattggaggataaggcaggccttcttggacacgaacaaggcctgacagcatatgcaaagtctggacattacagcataaagagaaaagacattccaagccgtgagatgatgtttgtgacaaagaggaaaacagaacatggaaactacagatcaaagcctgactggacctcagtgtttatgaagaagggtagcaatgctgatggtatgttgaaaagggagcctgggttggtccaggtaggggagggtcttggaagttacatttttgtaggcaaaggagactagtaaaagcttctgtgcagagttgtacatctctcattggctgactcttgcttcatcttcctacgcagcatttctgtacctaactcctttttctatgaagctacagaaacccctcgtatcccattccacctccttttcctattattttatgacattctaaataattctagaaattccaacttgaaggttgctagaaaggtattcatcaactcattttcccccatcctcattaagctctattacttacatcaggctcaaaatcccaacaattagtttctgcagtagtcccctactggcatctttccagtactaatttacttgctacagattatatatttttttagttattttgagacctttgacatcaacatttccatttctggagccatttccttgtcttacagctcctgtattgtttcttttttgaaacaccaactcatggctaaactccactgagcatcttcttggattatgggaagagtatattaaacagaggccattatcttccacacacggttccatgtactgcaataacaaaccatgtatgtattgctaatcttgcacagaccaagtacatagcagtcggcactcaataaatttgttgagtgcttaataaatgtgtgaatgaataagtgttggttcatgctggagtgcaggttcctcagtatcaagtattagtatttctattctgtatccttgaacactctcactgaaacaggcactaaataattctgattaaatgaatgcattaatcccttcagaaaaaggatgcctgcagaaaaatcccaaggaattgcaaacaagatgcaatgcaataagttttctcaccccaaaatatgtagagcatcatatatattatttaggctattacagaaacatacatattcttgagttctcatttactgatgcctggcatatatgctttcaataaagtatagccattgctgatttttttttaagcctgactcaaaggcttcatgtctttgaactaaacaagagttccgggtttttatgacttatacaaacaaacaagctgagtgtggttagagttatccgtgcctaatattttaattccattgttcaataattccaattcctttgcattagttttgctttagtatacccttataatactttcaaatatatctataaaactttacagcccttttccaatggcatatggtgtgtgttctgaagagaaacatgtttatgagctgaaagatgggaagaaaatgtaaaatgctcttacgggactcggggagggattgctgcctgcctgtgtagcaggaacactgcagtatatcaagactcttgcagactgaacagaagcccttctatttcaacaatgagcagaagtctggaattgtgctatgctaactttgatgctattagggtatttttgttttttgcttttttctctcctaaagattaaagtaaatatttcctgaaacaatatttgaatactgtatgttgtaggatagtatcaactgagatggagggaaggagagaaaagtagagtgtggatggaggagtgacaaaaaataccatttttctgtcctctcccactgaagcccacccaaactttgtccaagccggagcttgcaacattgttccttacagagcttatctgtagttattcttggaaacatgcaaatactcattctaaaaggtcctgctgtattcttttttttttttttttatggagtcttgctctgtcacccaggatggagtgcaatggcatgattttggatcactgcaacctccacctcccagttcaagagattctcctgcctcagccttgcaagtagctgggactacaggcacgtgccaccacacccagctaattttttgtattttttagtatagacagggtttcaccatgttggccaggctggtctcgaactcctaacctcaggtgatcctcctgccttggcctcccaaagtgctgggattacaggtgtgagccaccacacccggtcctgctgtattcttaaaatggtcatttgctgagtgctagattcaaattttcagttgcctcatatattccatcttggtcttccttgtcacgatcattgatatatagtaacacagctgcagagactagaaagcttcgtgtgacctctgacttctttgctgttgcccctagttggtcaccaagcacagtcattttcctctcccatctctctcactcactcttccccttcatttccgtggctcttccgcaggtttcaggcccttgaactgatctcacatggcctattccaatagtttcttagtcagtctcttttaatgctaggcttcctcactcaaattaccctctaacatgccaccacaagatggttatttcttttagaaagtctactgtcattgcatcctattgtagcatttttattctgctttttattatactttgcagttttaactcctgtttgcacccagtgactgtaaactgcatcttcatgtcatcttcaacatctccgttacccatttcacagtgtgttttaaatagactcaggattatctttacacagaatgttggttttgctcacgaggattctcctggtccataccctgacatttctaaatgtccagcctttcctgttgatattctattagaaggtaaaataaaaaggcactcactgcctttaaatagcaatacaggaaaatttcactgctactctcatgttgtccaccaccgagtcttgagcaaacatagatgtgaaaataaaatatttaaggagaatactttgaaggatccacttttctgaattctctaaattttatttctaggtgttctaaatttaagctagatctttagagatctggttagctggagagtcctttgcaaaattctttccatggttacgagtgagaaaagaaagtataaaatgctacattatggaacctgttgttgcatttgtatcagagatgtggttctagaacaaagtatcttctttgtatggacacatcagacatttcttgagggaatcctaccagaaggagatgctctttacctcttctattggtttatacctgtaggtcctgtggtctgcatgtgatctatatgtgattgctccactttttgcattagttactaggctgctcagagtattatttttaaactccctttattagggatatcatccctactactgataatatttagcttatgacttacatacacatagatactaactctattccatctccattttatctttttcactctaattcctaccatctgatcttttcctttcctttcctctcctctatccttttcttttttccttccttccttcctttccttccctccttccctctctccctctctctttctttctttcttcctttctttcttctttctcccttccttccttccttccttccttcctttccttccctccttccctctctccctctttctttctttcttcctttctttcttctttctccttccttccttccttccttccttccttccttccttccttccttccttctttcctccctccctccctcactccctccctccctctttctctctctctatctatctatctatctatctaacttctgcatgcccagttattacttaattactgaaaatcattatgacaagttttaagtatgaacagtgtttgggaataaatgaatatgctagtaagttctatttcctgtaaaggcagcactttacacatagaagatgctcaagaatttcctgattggattcccaaaatttcaaagcactaaaatatatcaaaaagaaaaaaaaaaggaacgctacaggtcagaggtaactagtcatttgaaataacctaaattggcttttggtcaaagttgagcacaacaatatggtactcatccttattggctttcatctattcttagtgagttatattccctaacttgaggtaaaaagtgaggtaatgtgtggtatttttccctgctataatcctcatacagaatatctgaaagagaatggtacttttcatgcatgtaataatacccaggcaccactatatcagctaactttgctagatagcagtcacaaaaaggccattaatatctctcttacctccacctgagaaaggttagtgctatgggatgtgcacaagaagaagatcaaagagcatgcattgctggtccctgctatatgtcagagcaagacaactgaaatacactgagaaggtcaagagcagtggaagctgaagagataactatttgtgtgtgtgtgtgaatgtttataggatctgaagaaacctgagcacaaacgtcagtcttcatgacctgatcacatatgactcaatacagaggtgaaatcaaggtgctcctactgaggagttcaaagtagagactccgaagaatgaagagtgcaatacgccaaggcatccaggtcctaacaggaagaaaatccatgaacaaaaccagcaatgaagaaaaaaagatcattcaaaatggaataattttagtttctagggttacctttttttgtatttttcacataacaaaaacttttttgtcacttattttcctttacttaaatgattttgaaatgaagacaaatggttgccagggtgcctacaatttaaaatatgtctgaaaaggtttctgtggcagtcccaattactgagctattaaaagtaaacacaactaaaaatttgaagaatatgcagaaagaagcctaggaaaatgttgattttgaaaaagcaaaaacaaaccacaaacatatttttaaaaacacacatacacaatgtaattcctttatgatcctcatcagactttcctacatctcagcattctttaggtcagtcagtcaaatcatcgctaaagctttcaccaacaggaacatcgttcctggcgttaatacttcagtgtaagaactgttactaataataaaattttatatactaagaattttttcctcaagtgatatacaaatgcctctacagataaatacaatgttgtatcttatcactaatctattctaccccacattcattaacatagctacggtacagtgtattgggttaggaaatgaatcagatggaggaaatcttcacagctccatatttctaatataaaataggaattgtgcataaacattttgtctttatatttttcaaatataacaataataactatagaacatttgacaaatggagaaatgtaaacaacaactactacataaatttagcactctaaaaattctatcataaattctatcattcttataggtccttcttccatctttttcatgtgcaaatcatcaagatgaaaaatgacttgcatatgtttgatcattttgcattttatcattaaaacacctgatccaataaatttactgtaatttaatcaattattttctatattgctcccaagtttttataatgactactatttcattagtaagcaatgatgaagagaacttctatatgcacattaaaatatattttggattatttacttagagttaattcaaatactttaaagaatttcttttccaaagagctgaacctatttctaaagtcatcaatatttatgacatcaacagtttcaaaccaatacttgatatttcttaatataacatgaatattattttttttgctccgttggtatgtgatgaaaaagtaaggccttagttttcctttcaattttttaaaaaactagttagcttgaacattttctaggttcttttttagatgtatttcttgttttgtaaactgactatagagtactaagatattttttaaaaaaatttagcttagccttttataaaataaaagcattaattctgccacacttattatatttttcccgaaatctgttgctagcctttttggatttgggttatatattacatacataaattttacaatttattaaagcagataaatatatttttggtcttctccttttttaattgctttctgatagtgataacatacaatggtatcatagctttattttattctactttttttatttgaaaaaataacttttttctctaacttatgcaggggaatctgcttgttagtgtctttttcctttttgttgcttttaaaaattgattacctatagaagcttggtaaatattcagttttattttcttctacatgtactttggtttgtttttatatctaactatctaatcctttgaaatttgttttggtatatggtatgagacacttttgatctttttcttctgtaattgctataccatatcacagagcacactgcaatttaaaaaatcctttcccattgttgtatgaaaacttctatgatacacattgacctattaggttacattttttatttaaaattatattgtaggcctggtgcggtggttcacacctgtaatctcagcactttgggaagctgaggtgggcagatcacttgaagtcaggagttcgagaccagcctggccaacatggtgaaatcccgtctctactaaaaatacaaaaaattagccaggtgttacggcatgcgcctgtagtcccagctactcaggaggctgaggtgggggaatcgctgaaacccgggaggtggaggttgcagtgagctgagatcacgccactgtactccagcctgggtcacagagccagactctgtttcaaaaaaaaaaaaaaaaatatatatatatatatatatatatatatatatatatatatatatatatatatattctaattatattaggtagagactgttaaggtgtaagtgtgagcagcaataataagctgataataatgtctttatcttttaggtaaagacttatggccaagctagggttttatatagctggctctaggctgaccataagttttcaaaaaatgggaagaacatcactttcaacatttaaattgagttattaatgtatttccatagcgaaaataaccctattaaacctgagtataaatatttgctttcctctgaaaaatgatcagattaaaataagccagaatttggtattctcacatcgtatgtatgagcatgagttctgaaacagattgcctgagtctagctctctggtctgctaccgacaggctggatagtttggcaaattatataccacctttgtatgctactttcctcatacgtgacaggatggtaataatagtcatgatttcttgcagttgtgataagaattaaatgaattgaattaacatttatgccattttaccaagtttggggaggaagaggaggaaacgtgtcaacaaaggcttccttaaagagggtgaccatttggttaaatcttaaaatatcagtagattttcactatttgaatgttctattttgacacgactttctgaagttggtggtggcccagttagcagagaatttttactacatacttttaaaggttcagcgcagctctgcagggccacgtgagatgttgcttcttattagtagccctcggcataatgatgaagtaagttaacgttgcctttgacacttaacctcctctcagtgaaaccaaggtatggatttgaaagtacctcagtgttgggagtttaaatagaaaaagatctgataaaataatttacgcaaaggtgaacagtacctagtgggttactctttccaggtggggtcttatatatatatattttttttatttaaaaagtgttttggagataattgatattttaaaaaatcagcctaaaagacagcttaatccaccatttttctgagtttccctaagcattaagtttggtcaccaagaagcaacgttcttagattttattagcttaggttcactcgagcatacttcttttgagttgatttagctaatccttagctttcactaaaaattgatatggtataggtatttgaaagacacttttgtatttttcacaaaaccccggctataggcattgtacagtaaattattaagtgttcattaaatatggatccatgtaacaaaattttcccaatatttactgccaggagcaaagtgttgtctcttaagacaaacctagacatccccttttatcagaccatgagagctataaaactcatgaatttctttagtttcttggctaccaataagtttacagcaaaacatgatgtcctgttttaataatatagcttatcttttgtttcccatacaagcacttcttgctttctaaataatttctgctgtgtcttaaattttaaaaattttattacctttaatgttttaaattggtaaactactttaaaagacatgtaggaacatgagtggaatagttgttgcctgtgttcctcatttgacccttactaaatattaatttttaaaaaatagtgtcttttttctttccaagtagatttcaaggttttatggtagaacaggatttcttgttttctatcctctatactcaccccacatgggtactcaatagctaaattgattgattgatagctgtcttttaaaagcagatgtctagacaggatttttaatgatggaccttgttaaaaaatgatggactaatagtggaaatactaggctgagagagtgtttctgttatttttcaaaattcctctacaatggactatggccattttctgcatgcaaggaagaacacagccaggatcaccgttctttaaatcagaaaggactttgatagagtccagttccctcagttcaaatgaggaaaccaaggcccgaggagttactatcattcccagaagtagcgagctgagtcaatataacgttaagactgaaatttaggcctccctgttgccagtctgatgttgtttgatgccaatccatttattcactttctgcttccacacaagaatgacttgcataattttaaaggttggaaatccagcatgatcctaaatcagagtctccattcataaaactctaagctttaaaaatgctaggaatcattacacaaataaaatcctgagcactcattgtgctatgctttgtgctaaacatgtttcttttttccatatagtcttcgcaatcaccctatgaggtcagtactgttattattcctgttttaaagacgagaaaatgagaggcatgtctcatgtttagcactgggattcagtggcactctcctacactgtgtggactgcctcgcgaatccagtcatgtatacacatgtgtgtgtttttccttttggacacgtaatgagattttttttcccatgccagactggggtatcttagtatctctctcatggaattctcaattcctacccacctaggtttttccctggaaacttcctgccatcaaagcaggaatgatatttagtgcttcagtattagaaggtcacaaattgtgctggaatccaagggagaatcacgtatttggatgaatcacgaacgaatagtctgaacttccccaaaaacactgtcagtaaaaataaggtgctgccattaaatgacacctttaaagaaggcaagaacgcaaatttatgacaagaagaaagaacttctgagccaaaatcagctagatcttttttgtttttttcaatgccatccttgacactggtaaagagtagtcagctaggtatttgtcgactagaaagaatcgttaaaatggacaactaaaaccatcatatttacaagtgacacaaatcagaaattgttggctaacaaatctccttattccatcactgtgatatttgctaaagctgaccacctattaatttttccagtggagcctaaggatatagcaaatgccaagtaaatagttcaatctgaaccaggtttattgttcatcggctggtgctgtggtactgtgccgtgcttgtgtcttttgttgctgtggaacagcaggccttccgggaatgctaagaatacagtgtcttcccagagctgattacaccagacacgggcctcaatgatgcatggaccagctaacacagtgccacacaaccccacaatgctttcagcatattcagtcatctgcctcggagagactgaaaatattactattgatttggcttggtgtttaatgtggttgttaaattttaaatccctgtacaatgaccaatactttgggtagtaatgtaattcttccaggtttatcatctctcttgaaacctgactatttagtacattgtgtagcattaaatttcagacaggggaataggttttaataacacaaacacttaataaaataactttccatgagctttctcataatggtattaacagggaaagacaatttctctcattgcgcttctctgcagacattctgtcggctctgtatctccatcagttttttcataatgtgctcttggcacacttactttaatattgctggtttgagagcactgtcttttttatccttgtcactaaatgtgatattttgagcactcaagatgcgctgcaagcaggcctaaagtatttatattgaaactacaatggcaaagcatgtaggatgatctacctctctgaaatgagcctttaggaaacaacttcatcttgggaacatctctggctacacaattgtaaaaatgggctgataattaaagtaccagggaacactccttccatattcactgtttataagcagagtggtcttggtgggtgcacaccttaacataaaggaagtaatacttacatcttgcttttgtcacaccgaggctgatatctccactaagtacacatccctaatccaagacgttagcaaacatatctcttatcagcagtacggctttcacaggcttttttcagtgtccaccaaccactttccattctggataaaggatgttagctaggtaagaggataagcacagttgtaatctggatattcaagctgacctaatggtagatgctggatgcacactgaacctggcctggcggaaacctgtttctatatgagaatggcatgtggaaacagggacagatggtggggtcagtaataaagaacttgtttgttgttgctgattggaggccatttcttctgccagcatgactccacagatttatcctggcattggtgaccaaggggagacaaacaatgttgttcaacaagcattctgaaagctaccatatggccagaaggaaatctctggagaatactaggatgtgctgtgttgtgctacactgtggtagtattgctcttaagcagtagggggcatggtgagttcatccggttagaagtataaatagaagtaactgaaaacagcaggaaatataatccggtgagcttgcgagctggtgagcagttgtgttgtgggctgcttttaagattatttgcttaataaactgcattagtttcattcttttgcatttttctcgcaaaaaatgttcataaaggttgggttctagggtgacaaagtgttgggaaattttgttgatttaaaaaacataaatatgaactaataagagagaagaattcatgttagtctagaagcttagttaattgggagtctctagaggagtcactcaagatagtgtttgctaattaaggcaatgcattttccagggatttggagaaggaagagctctcctctggctttctgtctgcttatgagttactgtgcagcaccagtgacgagctttcactgattccagtcacatgactgacttgggtagatgtattccaccctcataacaaaggcttgtgggtagtaaatattacctatcaaataaaacaccaaggtaattccagttaactcttttcaggaattctaaaattttgtcattgagtttggtcctttcgaaaaagaagtctgccagaattggatatttcttttttaagtttttggattagtaaatcttatccaaaatgtaaattaatttcctataatagctccaaattaagaattctacaattctgttgatcctattctgatcgatgccagattcggttcatcggtgatgaacaagtcagtcatggtgcctcagattccttccatctcatttctgatgctgtagctggatttctctaattataattggatcacgccagtgggatttttagaaaactgcaaagtgttttttgttcttctgagaaacaagttataaaaataaaaaaaaatttatgtattctgaaaatggcttcacaagatgaatcttttaaagaaaaatcaaaacattatgaaaaacctaataacactcataagtttagatatgcaaaagaaaatgaaacagtattaaaccccaagactgggttctattcatggatttaaaaaatcttggacctgtctttacaaaacttgagtttaaccaactgaagtatcattacatccttggttttaaacgtcattaccacactaccagatatttctagactgaaaagattttttatgtttacgaacaacagattaaaggcaaaggcagcattattgtaataggatgtcataagatgtttctcagtcttagatgaggccccaactatgaaaggaatgttggcaaatctccttctttctaaaggtggatcaggcaggacttggtgagatgtgattcaaatttactctgtaggtctgggatctttccctgtcacccatagctctaaggagaggcagagaagacactggagaaaagattatgtattgatagcccagaaaaagtgctgtaattttctctgctctctcctgtagaatgttctgtttccgctacctcaagccaagtgacagaagacactctaaatacaatcaagagtggggtacttgcccaaagaggcaactgacatttttttttttttttactctgggctacctatttgctacttggaaaaaatctgcctttatgggacacttgctgactgtagtgataccagtcttagcaacctgaacatggacatgcccctgggtgcttgggtgggtagctgtggagggttaaagtaaggaggctggtgtctgactactgctgagaaaggcctgtatgtcagaggttggttgtgagggttccctgatagtagggccagtagaggtgtttgcttatgatgacagagacaggagttttttttggggacactctggaaagctgctgcaatataactacattgaaagccctgccaaggagaggtaatcccagtagaaagagacttcaggggtgaaatgccgaagcataggaaatcataatgggcagagcagaaggtatcaccagggagacagaatgggaggctctgaagatcccacagaggtatcctttaagaaaaagagttggcacctgccctgattgcatcaatatcacaaccatgccataagagcactacacaatcatcttttagcctcatatgcttcatcctttcccagcacaatggaggaatcacaggtgacatggagaagtggagaagaaggatgggagagggaggcagaagataatcacagacgacctaagcatccggccttttctctactgatgctatagggcctagtgcaggttaaagcagagattgtttaaataagaggagagccacaagtttcctggctggactctttattatctgagggtgttctaatgtctggaagtgatcagaaaaactctgggattttatccatagccaagaagaggagcttagtgggttttaagagaataaagatgtttctggcttgttttgaaagtgcagctcatttggtacactataatactgttttttcccaataatcaagtaattaatttttgtgtgatgacatgaagccaaatgtaagtgtgagctgagtggatcatacgtctaatagatctgtaaacatgaggaggtagggaaagttcacttctgagtacatatcacatctgcaaaccttgtcatagtgatccaaaatggaatgggaagtactgaagatgtatagtgatctcgcttcatgtaggattgtgcttgcattttctaacacagtccctggcatataatggaagcttaataagtgtatgccagaccgaactgggaagctgggaagaccaagcgaggcacgaggtgcatagaaggtgactaacaggttcttgaattagaagggaactaagttagagcatgagcatggccactattcctctactctaccttacttacctccctgactttgtctcttattactccccctatctactctactccagacaccctactcttggctgatccttaaggcttttttactcgctattccttctgcctggaaatctcttctcacagacatccacgaggcttatttctcatttccttcacattttgctcatatgagactttctctaaaaggtccatactcactgctgtctaacctttaaaatgcaacctgtctcctgacttccatacttttgagctcccttgccttctccacccttcctgtttacatagcccttatcaccgaatatactatcatttattatctttactgtttgttcatttttatctcttttacttaaatataagttctacaagggtaggttccttttttaaatggataaatcccaagtgtctagaacagtggctgacacatggtaggaatttcagtcatcttagctgaatgaatggatggcaatagatgcccagaggcctctgtgtcgtgttaactggattccatttgaggcattacagaaccctccggggtcaggggaggagttactgactcctttgccaagtagccgcagtacatatccacagcctcctaccaaaatcagcattctgggtattctagaaccacacacgaaaactgcttaggaactctcaaatcaagtagcaggtcaaagaactcctttgattgactctttgttaggctgtttggagtaggatgtactaattagatttggaagcactcaaggtttatactttgagctttatccccatagaatgcagagagaatagaaatgtaaaccctagtaaaaattaaaataaattaacagaatcaatctagatagttcttcaagtcaacttgcactcaaagagtattgggccttttatggtgcaaataatcatattgtacattagggataagtaaatctatcttcagttagactttggcaagcatttctgcttttaaatgtgaaaagccaacttgaaaattctgacaaatatattttatagaaaacttcatgtaacattagaaaagaaaaagaaactagtttccttcatatggttctactacacatatagaattataaatacatgcgaatctctctttttctcaaggaccaaagaagagaaatgaaaagaaaaacaagaaaaaagaaacaaaagattccagagatgttgtcagtctctttcaaacagctcattctttggaaagcatatctccgtcagatttcattcttcatacttgtttcactttccttcatcagtagtagacttaaaacactgttactctctttataaaactttacataataatctgttatttttttttacagaaaaatagcaattcctcctcagccattctttgttggctaaactaatttaatttattctgtaagctaaataatgccagctctttatgcccttcctgactttcctgcttggcacttgaatagtcttgattcttttaaatttggttcttctaagattttctgatgaaatttgatgaaatattttgatgaaatatttgatcaataattctttagagacttatagaaaactttcaaaagctattgctttcatttttagtttttctcagtataaaatacatgttccttaaagaaaactgaggaaatatagaaaagaaaaagaaagaaaaattaccaagaatttctgctttcagaaatgtctggtaatatatgggtattatcatagcttttttttcctgtccacaaatgcatgctttttttaaataacaaaaacaggaattatatttagatatagcaaggtttcttgtttttttaacttaataacatgagcatttctaagggccataatatactatttttaatattattatgattattttgaaaataagtcactttcattctaccagggatgtttggaacaaggtgtgttttggaattccttcttgctagaatggctatattggaatcctgtagggcatcttgacatctgctttaggcacactgaaatgttcaatggcaagagtatttaggactgagaacatctgaccactcagagcaaattatttgaacttctaagtgaattaacccacaaaaatgacttgataaccactatctaatgctgattgagatatcgaaaccacttgtccacaggtggaaagagcctccaagataagtgaatctagattcctgagtaaggaaatttagtattacccagtgactgtaccaattagatagacccttctacctacagactcagtgtcaacctctataaaatagtaaatataatcctcacctcttttcacacaggagtttcttagaatttaagtttggcaaacactataaaaaatagctctgagtcacaagaaattgccatattgccaggctacttagctatttattacctcacacttttagtgtctgaggtgagtcaactttaaacaaaaaagcattttgaaaatggattttacagcccatcttcgtaaggccatttcttatatctcatctttcaaatttcatttgaccagaatttgggcaaagagaattattcttaatacatttgtaacggctgcttttatgtgtcatcaagaagagttgttcaccagccaatggtaactgactcttctgactctttatccccagttacagaccttccgaacaaggaaattattattcttgccatgattctctggtcatcaaaccctgctatgcatcaccatgaaacaaatatcaaataaaggataagtctcaggaaaaccccagaactggatttcaatgctcagatcctgaaaaagtattctctgattttaagacatttgctgattcaagtgactttttaaagcaaaaagacaacaaatgggtacgcttccttaatgcagagacataggcaaatgcctttctttcagctttacgcaaagatagaagaagaatctcttacattctgggcaaccatctggaactctattaattggtgtatgaagcaagctaaactataagctcagatgtaacatgaaacaaatatactcaattaatggaaggtaaaattacagtccccaaatggaaagaactacaagttctctggtcattctacacgaaaagttcattttgacatttcagttatattaacaatctgttcctgctttggtggtctggaaagaatgaacagcaatattcataatctctactatcaactttgctaaattttttccccaaagaccatctttattaccctgtaactttcactacttgaagtgttcccatttctacaataaatagattaaaatcaacagagaaaagcttcaaaaagtgacagggttgttggaatttttcttgggattgttatgactccttctttatacacaggtcatctgagtcataatgaaacaccaactattcagagtcacatgctgtgctttgtgcttttggttgatcagaaaagcagtgaacttgatcccatcactataatctgatgcagcaaggaagagtgataacaattattcttagctgatttatttttttcttacaaatcactttcttatgcacacagaactgccaaaatggcatcagttctctcactaaatcttgcaaataaaacagtatacctttcaacgtggtggctgagattgtgtgatgtggagaaaaggaagatatgcagagatgttagcatggccacagggtgatggtggtggtggtgctggggcaagtgtgcactactaataggagaagatgtcaaaaaaaatgaagcataataatagtgcaatttatccttgctaaacgtactgcagtgtgctataattaaatatgaaaacctaaatttatctctatgttcggttgtcattaatttaacagggagtgcacatgttctaatctaatggttgattttttttctccatgtgcagcatattaaaatgtatattagcctcaaggtgcataaacacaaaataatagaccaaaggttttggcctgtggagaaaaaaaatccatgctcaaaggccgtcaagtagctgtgatgcaggggagacactcacttagcctcattaagccaaagctctcttttgcttgtcttttgttctgcatgacagcagcctctttgttgtataataattcattccaagttcgttccaagctaccgaaactggtgaactgtggccattttaatgagaagtattggtggtatgcataatctggaagccacgtgggccagacaatcacagagcactgcagccagcaaaatgagatattgtcgaaatcacaaatttgtcaagttgtttttggacagggtattataataagcactaaaatatgcatcctattactctgcatctgccagtcaaagatcactgtaatgaatgcgtgctgcagggtataaccaggccgttttcctaagtaaaacaaaccacagagtacagaaaagaattgtgtgggtttttttttttttttttggcattgtttgacttttttttttttcctaatccttttgcaccaggagtcaggttctcctggcatggtgtccactgctagcagtgaatacacaggccctgctggtgccagggagttaacatgaatacattgcttttttaataggtgtgcttaccatctgagaatacaaaacctcaaactcaaggcttcaattgagtctactgaagaattcctgggagagaaaagggaaaaaggaggagaaaaaaatatctctcccaatgatcctaagccttatgttttatccttttctacttcaaatggcttagcctttgggacttgttttgttgtttgtttttctgtttgtttatttttgcttttttgtctgtctgttgatttatttgctttttagatgaacctaaagctttgggaagaaatgggtgagatgctaatctatcccagttctataatattaatagtttgtataagaaaactaatacaatgttgacaagtagagagagtattttcacttgcccataaaaatggtccttagggagagtgaccatatactttctcatctaaaccagaactcttttgagagtgaagggaagatattatcgataattacaggcacaaaaagcaagactgtcagagacaaactggcctatatgatcatcccaaccataagctcttgaattggcaaatgtaaaggaagcacaccatgtccaaaggccatacaatacatcctgttattctgggcagtctctatgaaacattcagggttatttgtttgtttgtttgtctgttctgttttcagccaatggactttccataaggtctggatggaaataaaatgattgttaaatctaagaatacggagaatactcttccattcttttctagccattttttaaaccttacggaaccttttttgtgtgtgtgatcaggaggcatgatgtgagacagagacatataaaagtatggtccatatggtatttataattggggctgcagtagaaagatgggtaaaaccaagtacaattactcaaataaatgtggatttggatggtaaatatgaatatatgtataaaatagatgctttcttagtttagaggagataaatatatccagtgggaaaaataaacaaagcttcctggggtaggtgagaattagtagaatttcaatggcaaggaaaataaagagtcagaagaactgcatgccatgagccaatgtattgaggctgttataggaaggaggagagcatgtttgaaaaccactttactgaaagataatttacatggaaggaagtaacaaaagtaagactgacaaaataggccaggtgcagtggctcacgcctgtaatcccagcactttgggaggccgaggccagtggaccatgaggtcaagagatggagaccatcctggccaacatggtgaaacgctgtctcttctgaaactacaaaaattagctgggcatgggggcatgctcgtagtcccagctactcaggaggctgaggcaggagaagaatcgcctgaactcaggaggcagagattgcagtgagctgagatcgcgccactgactccagcctggtgacagagtgagactctgtctcaaaaaacaaacaaacaaacaaacgaacaaacaaacaaaaaactggcaaaataggttgcagggagatcacaaacagccttgaatgccagatgaaagaatcccttacatttgttggtcaagaagtatcactgaatgctctgaatcagaaaataagctttggaaaaaataaactggcagtgatatgtaaagggtctggagaaggagaagctgggagaagaaagtctacagttatagcgcagaagagtggtcctaaaagcctaaaccaggatattgatatttgagataaagataagactatccaaaatgctccttccttttcctaaatatcccaactgtaagacttacacatatttctcaagttgtataaaatcttctcaatgtcctctacgtccttagcccatcagtccatcttattttcatgttaaactcttctgtgcatcatgtcaggctcagtgattgtggagcgagtaatagctctcttttactgtactttgagaatgggtagaatcaagagggtgagtgcaatattggtttatacaacttggtatagcctaagttggtaagcattttcttttaccctaagttacaaagtgtgtgcactttggatagatacatgactactttattgtagaggcacaggtttgagaagggagataagtgcaaggcaaaccagatccctgagtaggtctcgggagatataagctagaaactctgcccacagcctgaattatggaagcctgcaactgtaacaaatgtcctgggatgaaatgtctggagccttaagctgtcatgcatgacaagaacagctctttagtgccagaggtctctgtctctggggcactggtatatccctccattgcccatgtgttcttctgtttggtgtatgtgtagggtgtgtgtgtgtgtgtggggggggtgtgtgtgttcttttgggatatctgctttgaaatttcatcatcaaactaggcttttccctgatgaaagttccatactatagagaaaacatccacatttgcttgcagtttgtgcagcttaaactgaagacagatgtcttgtgcagcaaccacaatattttcatttatctcttaatagatttccatctaggaatcaaaagtctgattttatttttcaactctgatgatgaatactaagaattattttaattatagatctatttcattctgcaggaaataaggagaggcattttgaagtttttttctttaaagacctcaataatatttatcttctaaatgggattttcatacataccatgacaatcttatggattactacatattgggagatacctactatggaatccctggcaatatctagttttaattaaaatgaaatgtcataataatgtcatcccacattctggtgtcacgacaaacatctttgaactcctgtgattaaataagcagaaacacttgataaaacttctaatgattcttctaaagaaacgaaaaatcttacagttcattgtttgtatctcctttacaagtatatcctttcttgtattatagctatttagatcttaactttcaactcagttataagctcttaatagaaaatacctgcatcactctaagtttacaacagagtcttttgtacgctttgggcttgatagatattaatgaaatggaaaggtaaaggtaaatgtttcacgccctttggaattaatctctattgtacatacataacatgcagatgcactaacagaagatgacaaaaattagcaatcttttgaaaactagtatttactaaatggatgtaatatgtgttgattatcataagttaggattgagtaaacaattaaaatgctctacttggaccaaattgaaagcccatattactggcaatctgatacagaattatagctgtgtttcacttgtgaaatagagataactttttttatttttttgtaacagagtctcgctctgtcacccacgctggagtgcagtggcatgatcttggctcactgcaaactctgcctcctgggttcaagtggattctcctgcctcaacatcccaagtagctgggattacaggcatgcactgccacgcccagctaatttttgtatttttagtagagacagggtttcaccatgttggccaggctggcctcaaactcctgacctcaggtgatctgcccatctcagcctcccaaagtgctaggattacaagcctgactcaccgcgtccagctgataacttttgtctttctccagtgtcattatcctagtttataacatcatcttgcaactcgatttctatagtagacagtattagctacataatttggggacccaatgaaaagtaaaaatccaagcctcccagtttaaaaattattatgaatttcaagatggagttgtcagagcattaatccaagagcaggaccttctgagagggaagctttgtgctatggcacagattgcatacccacaaagccaattctgctaaccacctcataatgatgtctgtaacttcattgcatcacatttcctatatattttcacatagtaacattacgatgtatttgtatattttcaccatttctgtgtaaaaccatttggcagtttccctttgcacatttaataaaatccaaattctttgtcatggtcaacgagcctccacataatgtggccattgtcaacctttctaataccatgtggcgttacttcctctttttttctctaacttgtgccacaaaggccgtccttcaggtttttgcacaccttcacaaatgctactctcaccagtggaacgctgttccctggctcctcatccttcacatatcattccaaatatctctttctcacagaacgcttccctgatacccaaattaaagtagctccacattctctatttttcttctaagcatgccttttcctcctgcaaatgtttagtacacactgtatcttaaaaaaaaaaaactaaaatagtttctgtccatgattagcttgtaatctccaagagaacaaggaccagtctctcttcttcgctacagtatgacaatgtttagcacattgcctacttcacagtaggtgcttaataaacatttgctggatggatgaataaatgaatgaatgaaagcaccattcaaatgttcaagaacatttttctcactattactattattttcacgtaggtaaaatataatttgcttgggcaaccagaactataataagctcacccaggcattttcttgtgggcactgggctctctctgggttctcctctgaagaagccctcttctcagatatactgtatatatgaatatttatttctcttatacaaaagaggacctcagagctaggtacatcactgcatcatctgctttcatgacttctggatggagtgagacatgcttctttctaggtccttctcttttccattttctattttacttaaagagaaggagctgttaacatattgaaactaaccatcctgttcttctttagcttcaaatagaactaaggctgtttataagaaactacacacaaatagaatatattgcatcttcctggaattctagtacattataatgacaaatgtttttcattgcaatattcattgcattatgttcaattgtttttgttgttggtctggaaacaccagaagtgtaattactagctttgataaagtaataaagtcaatggaataaactatgcttggattatggcctcttgttataagataagcaaagctaagtcaatacccaataaaaattaatactgatatcaaatccagctatcttatgttcaaaatgagaaatcattaccttctcgtaacattcttctatgaaatgtgttccttttaaaacattaaaactgtagaaacattaaaatactttacatatatttacatataccttactgtatttgagaacatatatagagattatacagatataatcgtacatatatatgagctcttttgattctttacaacagtgctgtgaagtcaactgggaagactgaattatctccagtctctagatgagaaaatcaagaatcagaaagattatctggggctgggtgcagtggggctgggtgcagtggctcatgcctgtaatcccagcactttgggaggccgaggcaggcagatcacctgaggtcaggagttcgagaccaacctggtcaacatggtgaaatccccgtctctactaaaaatacaaaaattagccaggcatggtggtgggcgcctgtaatcccagctactcggcaggctgaggcaggacaatcgattgaacctgggaggcggaatttgcagtgagccgagattgtgccattgcactccagcctgggctacaagagtgaaagtctgtctcaaaaataaaaaaataaaaaaataaaaaaattaaaaaatgaaagaaaagaagagaaaaagaaagattatctggtactatgcaatcagctattaatacagacagaatccaaatcttcaaatccctgttctttcaattttactgttaatatgttccaaaatgcattttaaattaaaaacatactaatggtcatactctactattccatagaagaatttaaaaatggaaagttattcatggaacagttttgaagtagtatattatctgaatttgtctagtatattttattaagctctcttcagcctgtcctcatcaaaaataagtattacattaacattacagttatttaaaaattaaccttttctaggctggtttaattttatggataatgtattaatcaacatggcttgaagtttcctatcaaaatgcagtcaaggccatttacactactattttcaggaatctccttctgctacctttgtaaagcatttacttcataggaagcatttcaaacactactagtggaaaaatacactaggcaattatagccaaagtttctacggatgtggctaatttatttcctggtttaaaccatatctaaacgagatttaagagttcaagagctgggaatgaatggacaattgggttattttgtattctgtggagtgagatttgcagtcaatgtcagtattaaatctaggtgtaaaatgcaaaggtgcgaagtttgaatgatgcctccactttgttaggtgatggctgaatcacatacacacacacacacacacacacacacacacacttacataaacacattgaatatatacacaaatacatgcagatatagttaatatctataaatatatctattaaattataatattaatgtcacgtaaaaatacacagatacccatatttaataatttttaaaatataccatatatagtacttatatctattgtatataacatatatatgcaaggcacacatgtagatattgctgtatatattctgtagactaatatattgatatatataattatcatatttatacaatattatcatcatcaatgttttcatcaagttgtcactctctcaggtatagcatacctgagaactgaatacttttcaagtttatgtttagatggttttcatggttgcgttttcccactgataaagtagaattttaaatataacttgtcttatttttatctgtcctcaatttgagtgtgtcctagttcattaaatttagaaatcccttctcattgcccctctgccatgtagttaatggtctgtaaaacacttaaaaacactagaggagttcatttttttaaaaggggctctatggagaagccttctaaaatgtaagagtcttttgtaatcacctatttatttacttgtactttaagttctgattttcatctagtagaggcattctttggtcaaggcaaaactgcagtattctctgtagcttaatatgagtatagctgataacatcatacttttttccattactactatactgaaactagtctagaacctaatgagctgaattgctatccaaaggaacaggatttaggttcagatggggaaaaagagaataacagctgcatccacactcccttccacatgatcttgttcatgagcaatatgatgacctggcatgacgtgcaactttaggtctggctctatagccccaggagaacatggcgaggacagtattaaaaacgtgtctatcctattcaacaaatggtgctgggataattggcaagccacatgtagaagaaggaaactggatcttcatctctcaccttacacaaaaatcaactcaagatggatcaaagacttaaatctaagacctgaagccatataagttctagaaggtgacattaaaaaaaaccttctagacattggcttaggcaaagacttcatgaccaagcacccaaaagcaaatgcaacaaaaacaaagataatagatgagacttaattagactaaaaacttcctgtatagcaaaagaaataatcagcagagttaacagacaacccacagaatgggagaaaatcttcatgatctatacatccaacgaaggactaatgtccagaagctacaaagaactgaaacaaatcatcaagaaaaaaataaacaatcccatccaaaagtgggctaaggacatgaaaagacaattctgaaaacaaatggccaacaagcatatggaaaaatgctcagcatcattaattatcagggaaatgcaaatcaaaaccataacacaaaaccacctcactcctgcaagaatggccatgatcaaaaaaaaaaaaaaaagatgttggcgtggatatcgtgatgtgatgaaaagggaacacttttgcactgttggtaggaatgtaaactagtacaacgactatggaaaacagtgtgtagattccttaaagaactaaaagtagatctaccatttgatccagcaatcccactaatgggtatctacccagaagaaaagaagtcatcatacgaaaaagatacttgcacaaccatgtttatagcagcagaatttgcaattgcaaaaatacagagccagcccaaatgcccatcaatcaatgagtggataaagaaaacgtggtaaatatacatcatggaatactactcagccataaaaaggaatgaaataatggcatttgtagcaagccagatggaactgactattattctaagtgaaataattcaggaatggaaaaccaaacatcttatgttctcactgataattgggggctaagctatgatgatgcaaaggaataagaatgatacagtggggccaggcacagtggctcacgactgtaatcccagcactttgggaggttgaggtgggtacattactggaggccagggttgaagaccagcctggtcaacaggcgaaaccattagccatgttattagccaggcatagtagcgcactcctgtagtcccagctactgaggggttgatgttgcagtcagcaaagattgcgccactgccctcctgggcaacaaagtgagactccatctcaaaaaaaaaaaaaaaagattgatataatgtgggcttaggggaaggggtgagaggggggtgagggataaatgactacacgttgggtacacattggtaagtgtacactgcttgggtgatggacacaccaacatctcagaaatcaccactaaagaacttattcttgtaaccaaacaccacctgtcctcccaaaacctattgaaataaaaaataaattaaaaataaaaacaaaaacacgtgtctaggtagcatacatgataggtgtactcaccctaagtaagttaatgtgttttacttgtgtcattgcaaaaatgaagcaaggtagagctataaaggctgtctgaacttttctcaagacccggtggtggggtgaggagtcagttacaactggttatttcctctttgcagggaacgtatatgtggcctgaatagttgagcagacagacttgggcttgctgctattaaatatgtggaatgtgtgttaatattcaggacatattttttctatttgatttcactactatacttcaaatttcatgcctcctaaaatcaaaggcttttcacatttcatatttccaagtgttgtcataagtctgactttggaatcatcatttacactattcatagttcttttcatctatcaaatgttataacctgttgttccctggattctgtatgaaaccagagctcttctgcttttgtgtccaaatattctctctgaattttcactcgagtcattaaaaaagaactattatctgactcttccatgatttgtctctggataggaagccccaaattgcattagttgtttttattatcctaatacactgaaagcctgattttactataatttgttcttcactttcatcccagccctaggtctcctgataatactgctttctaaattgtgtctattaaatgccttatttgatattattatttcacagattcatatcttacatttacccaagtttcatttcatttcttctttcttctttgtaacctctttagattcttttgtgctagttatcttttttctgagaattgaaagtagttcccaaattatagccaactacaaatttccttagtgttcttttgatctcactttccaacggtctcactaaataagacagatgagatgcttcttacattgagattttattttattgtattatctgttctagtacttctcaaacttaaacctacatatcaatcacctggggatctttttaaaatgcagattgtgattccatagctgtggagttgggcctgagattctgcatttttcaacaacctctggtgatgatgctgatgttgctggtttgggtaccatgttgtgagtagcattgatctagataattccagttggtacaaataaataacttgattgatttcaaataatgttttaaataaaatgtttatatttttagtgatggaaaatttttaaatctgtagttatttgaaatgaataaattttttttaccttggattagagaatctcactttaataatacctaagaaggagacaggagcttgattttcccttctttagcctccagggttccattctgatagaaaaatacaaactgcattctttaaagaaactaccatcagagtaaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaagcacatgaaaaaatgctcaccatcactggccatcggagaaatgcaaatcaaaaccacaatgagataccatcccacaccagttagaatggcaatcattaaaaagtcagtaaacaacaggtgctggagaggatgtggacaaataggtacacttttacactgttggtgggactgtaaactagttcaaccactgtggaagtcagtgtggctattcctcagggacctagaactagaaataccatttgacccagccatcccattactgggtatatacccaaaggactataaatcatgctgctataaagacacatgcacacgtatgtttattgtggctctattcacaatagcaaagacttggaaccaacccaaatgtccaacaatgatagactggattaaaaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggaggatagcattaggagatatacctaatgctaaatgacgagttaatgggtgcagcacaccagcatggcacatgtatacatatgtaactaacctgcacattgtgcacatgtaccctaaaacttaaagtataataataataaaataaaattaaaaaaaccccttcttggtaataagttatatcacctagtgtttgcacacactcatacacacatcaccttttctgcccatgcacacagttttagagatcccttttcagtgtattaccatcatcttgcctttttcttattgggaagacttatctacttatgtgggattttattcctcaaataagatgggttttattaccgacccctgaggaacacaaatgcccagttatccctatatggagtttcctattattaagtcagttctctatccaagacaacaaagtccttctcatttccatggtgactgaatggggaagcaatgattataaggcatcagccagaacatatgcgacagaaaaaaggaggcttgaaatttctctagactcaggaaatatgtattccatggcacacaatagagtattgcttctgaaatatttcaatttctgtggaatacaactcttgatggatatattttcaagttgtaccgacattcccatacctgtaatatgtgtataagctctcctttacttttgacacttttattcacccttaatggtacatggagctaaaagtgatatattttccagatgtggcttgatttcaggtgatatatatctgcaactaaagaataagattctttacaatgagcaatgctgaataggtacttctataataatcaggcatcacatatttggacttgactgcttagggtaaccatatatattcttgttgaagtactgggtgcttaaaaatgttttacttcattcctcagttaacaaaaatgaccctgaaaagtacactgatagcaagtagtattgcaccaattatacccttcactgcatttgattgtagggttttctctttattagcttaaaagtgagcagtaccaagtccaattccccagggctttttgtgcttctacaaatcatgtcaagttgctcacaaccagtgaattcattactctgatttagcgatggcagtacacaggatgggaatttaaaaacaacagcaaaaaacatttaagtcttcaaattttactagtttgcaatatgaaaaagttttatatctaggtgaatgctctttctagaaggattcttcatatttttatttatgatagatgatttttgaagatttcaacttctggtaatggcagaatacctcctttgggcttctcctgcagataactcaccagacacacacacacacacacacacacacacacacacacacacacacacacacactctatccaaatgcactgaagaatgtccaaaagagggcagaaactaaaggggaattggcacctggaagaagggaatgacactattctttttgcctgagaacaggctcagggggtggtaccaagcagggaggttaaaattcagagagaaattcgtcttctaactggctgagaaatcagagttggggccatcaaaacatctagaaactggggagatatccaagaaagaaagctacagagagggagcaccagattctgcatatgtattctacccaaatcactggctgacatctgagctatgcatgtgcttggcagatgccaagcagcacagctaagattgaaataactgtacagatatttcagtcagttgctaactgcagaaggggcagagttttggggtttgcattaagataagttaattgtctgctaaagcaaacaaaaatcgggactcttaggtgtggagagtccagagtctctgtataatgtatcatttacacagtccagatacaatataaaattgtcagacataggaaagagcattttgactgctctcaaaatgaagggcaatcaacagggatcagtcctgagatgatccagatattagaattagaggtcaaggattttaagtcagttattataactgtgctcagaatataaagtaaaatactctgataatgaatgatgagataataaatatggcaaagtaataaatgagaaaaatgaagcaaaaagaaattctagatttaaaagatgtgatactaaaataaaaagttcattaggtaggcttaacagcataatggagatggtatgagaggaaagactcagtgaacttgaacatggataaatagaaattgtccaatctgaaaaacagagaaactattaaaaaaattaaaagaacatctgggacttgtggaacaatctttgaagttctaatatatattcatttggagtctcagaaaagaggaagaaagaatgaaacagaaaaactatttagagaaataatgactaaatatttcctaaacttggtaaaaaaataaacccacaaaccatacatttaccagtttaagaaacccacagaagcttaaggtagataaataaaggtttctaacattttaataatatgtaggaagtaagttgcagaaactattcagggggcaattttgagactgaatttgtggtatgtttgtagaaaactgtagctaaggagatatgaaaaaatgggaaaataacaaaaattaattagaaatacattctgttccttttaatcttattattagaatgttaaataggaatattaaaggaataaatttatccattaaataacaaaacagacatatgattattcagttactatgccgctaaataaatcctatgatttcatcttcctcccttatctccctccttccttgtcttcttctctccctccttccctctctcctgtccttcttttcttttatcgtagagaaagatgaaggataaaatctttcttactgatactattatcattaggatacaatcatcattaggaagacatagtgttttactgtttgggtcaagagtcattgtaataaccaatagttttatatttacagtgttatatattcaactaattcaccaacaatttctatatagtgttgtggtgggccttccaagataattttagaacaattcttatttaaaggacatggaattaaagcagaaaattattttataaaaataggtgaaaaagaaaaacaacaacaaagacaacttttctttcttatcctttcagaatatttcagtagaatgggaagctacacttgaaatgcaagatggaatattttcccctaagctctccataatagaatgttggttataccatccttaactaaactaacactgtatcttttctgtagtactgataagaaaattgaaaatgaacaactcgttaatatactacctgaaaaatgtgagattagagagtccagcagaattttgaaggccaagtaagggggtgttcgatgatgagagataagcaactctttgaatagaaggattgtaagagatttaccctctgctattagcccccctctagttcccagggtttaaaatcaattacaatttcattggtacttaaaatttctcttattgtcacatagattgaatttcaaagagaacaggacagccttacacatagaactagtcagtggggagcagaaagtgtacaacctaaattgtttacttcatccacaagagactgtactatgactgggattccataatgtgatatctgaataaaagccttactttacttactgatttatttttcaaagttcagttcttaacaaattttgaaaacagaaattcaggcctggtcactatttattcttgagttaatttttcaagtagtttcaggatagccttagttaacttggcaaaatgccctgaaaagtgaattagcatgtttaaaacttggctaatcactccctcatccccaaccatagcaaagcctgcttaattttgagccggcgttttagcatacagtggtctaactccatcctgcacacatatcttgaattggctgatttggaagcaggcagacttccttctggatctcattcaatttagaaacaacagcagattagcgattaaatcggccaaacaacttctggctcataccaattaatttcttcaaggatttttcccttaaataaagtgtcttacacagttacagggaatgtctcaaacagcctgactatatataccactattgttgaatgttttcatttttaatgttaaaagctctgtcacagaaaacagcctggaaactctgtggggcaatgcaacccatcattctaccatactgatacaagtaaaacaacaatatcaatgttctaatacattaggaccctttataaagagttctcaccgtctaaaagcatcagcaatcataacggagctgtgggtatttctaagccaatcaacaaacagccataaatatacttggaatatacagagacattatcctacttcacttttaattcaacatgaagtcttttttaaatttaatttaattttattattattatactttaagttttagggtacatgtgcacaatgtacaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatggggtgtttggttttttgtccttgcgatagtttactgagaatgatgatttccaatttcatccatgtccctacaaaggacatgaactcaccattttttatggctacatagtattccatggtgtatatgtgccacatttttttaatccagtctatcattgttggacatttgggttggttccaagtctttgctattgtgaatagagccgcaataaacatacgtgtgcatgtgtctttatagcagcatgatttatagtcctttgggtatatacccagtaatgggatggctgggtcaaatggtatttctagttctaggtccctgaggaatcgccacactgacttccacagtggttgaactagtttacagtcccaccaacagtgtaaaagtgttcctatttgtccacatcctctccagcacctgttgtttactgactttttaatgattgccattctaactggtgtgagatggtatctcattgtggttttgatttgcatttctctgatgcattcttatacaccaataacagacaaacagagagccaaatcatgagtgaactcccattcacaattgcttcaaagagaaaaaaatacctaggaatccaacttacaagggacgtgaaggacctcttcaaggagaactacaaaccactgctcaatgaaataaaagaggatacaaagagatggaagaacattccatgctcatgggtaggaagaattagtatcatgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcatgctacctgacttcaaactatagtacaaggctacagtaaccaaaacagcatggtactggtaccaaaacagagatatagatcaatggaacagaacagaaccctcagaaataacgccacatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtaaacaggcgacctacaaaatgggagaaaattttcgcaacctacttatctgacaaagggctaatatccagaatctacaatgaactccaacaaatttacaagaaaaaaacaaacaaccccatcaaaaagtgggtgaaggacatgaacagacacttttcaacatgaagtttaaactatatgtagttgaggtgcttttccaaatggaaagaaaacaatctactacccaaatcaacacatagtttcctgtgaacaatatcagaaactaataggatgatcctctgtcttagtccatttgtgctgctataaaaaatggtacagactgggtaatttctaaacaacagaatgtttttgtctcagttctggaggctgtgaagtccaagatcaaagtgctggcaggtttggtattgggagtttggtttctgctttctagatagcgccttgttgctgcatcctccagagaaatgaatgctctgtcctcactttgtggaagggtcagaagggcaagaaagtgttcccttcaccctcaaaccctttcataagggtgctaatctcattcatgagtttggagccctcatgacttaattaccttccaaagaccacatctcttactactgatgctctggggattaagttttgacatcagttttacaggggatgtggtcattcaaaccacagcaccctcttttagaaacaagattgagagacaactttctggtattcacttatttttggttcatagagttcaatcattaaggaaaaatggcaagttgaaaagttgtgtagtaaaaaataaagaaaacttcaggccaatatccttgatgaacactgatgctaaattcttcaacaaaatactggcaaaccaaattcagaagtgcatcaagaagttaattcaccatgaccaagtaggctttatccctggggtgcaaggttgtttcaacatatgtaaatcaataaatgtgattcatcacataaacagaactaaagataaaaaccacatgattatctcaatagatgcagaaaaggtctttgataaaattctacttccctttatgtttaaaactctcaataaactaggtattgaaggaacacagctcaaaataataagatccatatatgacaaacccacagccaatatcatactgaaagggcaaaagctgacagcattccccttgaaaaccagcacaagtcaaggatgccccctctcaccactcctattcaacatggtactggaatacccggccagagcaattaggcaagagaaagaaatactgggcacccagatgggaagagaggaagtgaaactatcactgtttgcagatgacatgattctatatctagaaaacctcatagtcttgccccaaaagttccttcagctgataaacctcttctgcaaagttttggaatacaaaattaatgcacaaaaatcacaagcattcctacacaccaacaacagccaagccaagagccatatcaggaaggcaatcccattcacaattgtcacaaaaagaataaaatacctaggaatagctaaccatggacgtgaaagatcgctacaatgaggattataaaacactgctcaaataaatcagagatgacacaaacaaacgggaaaacattccatgctcgtggacaggaggaatcaatgttattaaaatgaccaagtgcccaaaacaacgtacagattctttttttttttttgtatttttagtagagatgcggtttcaccatgttagccaggatggtctcgatctgctgacctcgtgatccacctgcctaggcctcccaaagtgctgggattacaggtgtgagccactgcgcccagccacaatgtacagattcaatgctattcctattaaattatcaatgatattcttcacagaactagagaaaactatttcaaagttcatatggaactgaaaaagagcccaattagccaaggcaatcctaagcaaaaagaacaaagctggaagcatcaagttacctgactctaaactatactacaggggctacagtaaccaaaacagcatggtactggtacaaaaacagacacacagaccaataaaatggaatataagcccagaaataaggctgcacacctacaaccaactaatcatcaacaaagctgacaaaaacaagcaatggggaaaagactccctgttcgataaatgatgctgagataaatggctagccatatgcagaagattaaaattggaccccttccttaccatatacaaaaatcaacttaagatggattgaagacttaaatgtaaaactctataaaaacgctggatgacaacctagacaacaccattctagatacaggaatgggcaaagatttcatgacgaagcttccaaaagcaattgcaacaaaagcaagaactgacaaatgggaactaattaaacttaagagcttctgcacagaaaaagagaatgtcaacagagtaaacagaaaacctacagaatgggagaaaatatttgcaaactatgtatcgaacaaagatctaatatcctgaatcaataaggaacttaaacaaattacaagaaagaagtaacaaccccttaataagtgggcaaaatacatgaacaaacacttcacaaaagaagacacacatgtggccaacaagtatatgaaaacaaagctcaatatttctgatcattagataaatgcaaatcaaaaccacattgagaaaccatctcacatcagtcagaatgactactattaaaaagttaaaaaaaaaatagcagacactggccaagttgcagagaaaagagaacacttatacactgttggtgtgagtgtcaattagtttaaccattgtggaaagcaatgtggaaattcttcaaagggcttaaaaaagaactaccattcaacccagcaatcccattactgggtttatacccaaaagaatataaattattctacctaccataaagatacgtgtccacataaggtatgttcattacaacactatttacaatagcaaagtcattaaatcaacctaaatgcccatcaatggcagattagataaagaaaatatggtacatatacaccatggaatactatgtagccataacaaagaatgagatcatgtcctgtgcaggaacatggatggagctggaggccgttatctttagaaaactaaacactgcatgttctcactcataagtgggagctaaagaatgagaacacaggaacacaaagaagggaacagacacactgggacctactgagagtgaggggtgggagaaaacagataatcagaaaaaataactattgggtactaggactagtacctgtgtgacaaaataatctgtaaaaggggcccccatgacatgagtttacctatatgacaaacctgcacatgtactaaaataaaagttttaaaaacattaacatgaaaaaagtaacactgtacagtaaagcttaggtgtcatacaaatgggaaaaattaacttttcttttaagatttccttaagacaactaatggtttatctttaccttcccttcagcccttggcagctgaccgacacagctacctattccttccacacttccccttctcttaattcagaggtataaatgcttttatgtgccagaaattatattttatgttatgagttctccagacataagcaagaattgccaaacttgccagatggccctatacttatatttcaaagtttaaaaaagcagaatttaatgcagatacaggaatattatcaaagtaccatattatttgagcattttggaaaatatttttattttattttcaatagtttgtattaccactaatgttgttaatcacttcagagagtatattaatgctaaattcagaaataggaattttttttatagccaaagtttagatttataaaaaatatgagattctgctttagaagagattcttcatgaatagatttatatttcagttttcctggtgggaaatcttgttctttcaaagcctttcagaagatatcccattaaaagtgtacatttttcaaaagttttagtgtagtttaaaattattttggacataggaagagcacaatatatacttccatggaatagctacctcatattcatatactctctcgattttatttagtgtgctggcattagatttaaaaattaaagcacatatcactccttttcctgaaagttaccacttcttgacactgtacaattcttggacataattactttgagtctctagagtaagatcagtaagcaactaatgaaaaattcctggtagaggcagacagaatgagaaaatgactatataactgagatcaaattatatccacagggagtaggatgctttctatattctacaaaagtctacagcaaaaatgcactaacgtggatgaattgtgtgaagagtcattttgaattggtgaaaagactgaattacagattattgggaaagaaatgcatttttttcaggtacatccaatgggaagaattgctaacaaacattcatttaaaacagcatattcattgttgattttcatgtgagttttgatagcgtacttgaaagctgttaattatcttaagtaggttaaacaatttcttgaaatgtgtttatattaataattcacttagtaaagtagggctttttgtctgatagcataaaggtatattatagcctagaaagagtaaagagcctgcattttaaagtagttatttctaaaattcacaagtttgtagctctttattaccaatcttgggaaaacttctagacctttctttcagaggtcaactactctcatttaatagtcataagtacattatttttaataaaataacatatcctgatggagtaatgttttctagtttggatgacagatttctatagtggatgataaacctaaagtttttattccagtcatatattcacagattctaattataaatctgaggaactctaagaacataaaatctttttttaagcgtgatattctccaaacaagttaagcttttcttagggaaatcagaatattatgaggctttctagctctgtgatccaagtaacaatcttctccacaatgtgtaacaggctatcatactcagctgtcaaatgccttccagaaagcaagatatgccttgctggcagcagctcttcactctattgagggatgtagaatggtttggaatttgggctttcatttcctgttgtctgggttcaaatctcagctgagccacttgttttatcatcagttaaagcacaggtatcaggaagacctacttcacagattgctctgagggttaaatgaggtaactgaagtaaagcccactgcaaggtattaatatttagtaagagttgggtgaaaattgttatccattgcctggaaacatattaaaagaggacagtatgttcatctggtatgagttattctcattgaattttcattctccctatccctattcacatacattgctttagacaaatcttgcttccagaggaacactgctacttttccttatttagatttttttaaccaatgagtttagatatattctagatgaccaaattgaactttaatattcagaaattttcagaattcacattttcaccctttgataaaaatgaatttaacgtgattaggcactacacctgactatgcttgctcatatagagaaggggcttcaattcccacttagtaattttttttttttttttgagacagagtctcactctgtcacccaggctgcagtgcattggcatgatcgcagctcactgcaacctccacctcacaggttcaagcaattctcctgcctcagtctcttgggtagctgggattacaggcacccaccaccatgcccagttaatttttgtatttttttgtagagatggggtttcaccatgctggccaggctagtctcgaactcctgacctcaagtgatccacccacctcagcctctcaaagtgttgggattacaggcatgagccactacacccagcagtgattctgttttgctcaagaagaataatcaaactgatgattcttcttggtgaaatattaatagttctacctactttgtgttacctataaacattttacagttttacatttacttctctatggaatggtctaatcattaccattttcttcagagtgttctaaaaagtcaatatttactgatgatatcagtaatccataatgtattcttttctttccaactccaaatgtttacaaattggcattctctttacattttgtcttagaaggagcatttctttccaaggcgaaatacttgagagaaaatgcccttagtaggaagatgtgcttccagatgcctatgataattgattagatttttttgatatattgggttaatttttattttattttattttattttattttattttatttgttatggagttttgctcttgttgcccagggtggagtgcaatggtgcgatctcagctcactgcaaaaatacttccacactttcctcttttaatagactctactagcaacctgtcacatttaatcactactgaactagccatgttgttttaatctgcattctatacatatttagcataataaatgaaaacttcaaaaatcctccctgttgatgactggtagtgtaactcttgctgtatgcacacttatgctctgccttggattgttgacattctatgctcatgacactggaatcactcagaaacatccttggagctctccatctccacctgcatcccttctactgcctcatctcacttcaccccaaccatggtatttataccttgtgacactcaataaataactaaggaatagataaatatttagatcattatcctgggaattcttctttggtgcaagagtatgaggctaggtatcctctagggaacttccagggagaaatatgcaggcatacatacagaaaatatattagcatcacaaaggcaggggaaataacccacatacagatctagaatactttcagatggccctcataagttttctcttggtcctctgcagaactgcatacattacaatgcttgagtaaggactgtatgaatggaaacttcacctgcagttgtgatgaggacactctaaggtccttggcaggtatatctagggttttccttgctattaagtgtaaatcagtcattgcctggtaccctggacagtaataagaattataagccaattgaaggttgcttaccacaggggaatctgaagcccattcgagtactcagttactgcctagatagctgattttatatgaaattgacacgactgaagagacacagaaggcaatgttcacatcaacagtttgctgggcatgcagccaggcaaccatacacatctacataggcaatgcagctgatgaagggaaggcccaaagctggggagaacaaggcaatttgcagggatctatgcagacctcaggatcaggtttctccccattccctgaaggtcttctcttcttcattattctctggctgtctctatcttaaatactttcttctttccatttcttttttttttttttgagatagagtcccgctctgtcacccaggctggagtgcagtggcgtgatcttggctcactgcaacctccgcctcctgggttcaagctattctcctgcctcagcctcctgagtagctgggattacaggctcaagccaccacacccagttaatttttgtatttttagtagagatggggtttcaccatgttggtcaggctggttcgagctcctgacctcatgatccacaaacctcggcctcccagagtgctgggattacaggcatgagccaccgtgcatggcctatcttaaatactttcaaagacataatcaacagactagaaaaactagtttaattaaggcattggtagggaaaatatatgcatgtaaataaatacatggagtcataacccaagttggatttgttgtagaaaagctaaaagtcaagtaatataacatacatgggcagaatagaaggaggaagagttggacctgtgatctttgccaataaacggaaggtccatggtaaggatcagcccacgatggcaatgtggcttgatgccaatgatgaaaggttgaggaaagaaggtggcatgcctgcaaaagcaataatttatcctaagttcactgaatacaggtgagtaagtattgtattatttctactacaactgactgccacaggtcactgggaaagaggtaaaacgttcaacaatcttgcccacagattagcaaaatcttaatctgctctctgccaactcagaatcaaatcccaagcattaaaaacaatgattctctctggacaggataacaagtagaggtggtagaatgtagtaggcaagtgcggaggttttgtgagcacacagaccaggaccagaatgctgcctctgctctttccagcatgggacctaggacaacttcctaatccctccaagccttccttttctcaacaggatagagaataataattcataccttacataaatcattgtaagattaaagtagataacacaaaaagccctcaaaatgttaaataacaaccattgaaggtttttaatttgtattgtcattatcatgattatcaattctacttttccttgggcaaataaccttgtactcataaactgattctaacagttgtgtctgttttataggatgaacacatacatcattgcatggaaaaagcagaacttagcctggctgtgcatttcatgggtgcagtttataggcatcacctgcaactagaatagcaatattaattgtaatgctaacatatggaaagataaagataaaggtgtaagataaagctcactaaaacaaagggatcttgatgtggaaatgttagtatttagacaaagtataaggacgcaaatgagcaaaaagaatttttgtgtttacgaccatgatacaaacagttaagaaatccaggtgaaagtgggttttccatcccacagaatttgaaccgccctcattgtcacaactgtaggcatcggtgatggtgttatctttcttcgtaggctctctggtctctagccagtggggagaaggagatttcgattttataaactccaggacacatacattaatgagtaaaaaatgcttcataagctgatcaacagtattttttgtcatccttcaagtaataaaatacttaaaactcatattaggttctgacgagcccaaaaatgctaagaggagggaaagacatgatttgatacaaagtatagatctgatttctgtgtatgggaattcatatgaatttgtttttattgcactgattttgataacctgccataaaacttttgttaatgctaagaagaaagacatagctaatgctataaattcacttagatatctctgccttccatattttggtatcaaattaaatttatcacttcattatcccttcctggcagttggaagttgtagactttaatggaaggtgccagggttgctaatagaatcttctcgtcacagatgaaggaaatgtaaaagcgaaactcacaaagatttgataggatttatgctaaatgacaacgacacccaaaagcacaaactaagaatgaagcctgtgccctatcgggagaaggaattaattatccaacagatttgtaactctttctctactataaataaaaatgtagcaattttcacaaatgatcatttagccagagccagccattgcctatagaatggaattaatgaggacatttacataaaccttacagtgttttcatccctcaagactcagttcatctgttgcctcccaactgctcctgatgccctaggttgagatggacacttgtttccttctaattccataactccgatagcataatagcagttatgttgaggagtggtaattgaatggttacgggcacaatgtttgtaataaacagaattgggtttgcgtccggcttccactaataaatatctaaacctctttaacctcagttttcacctttgtaaaatgagtatatatacacatatgtacgtatatatgtacacatgtatacatatatatgtgtatatatgtgtacatatatacacatatacgtacatatatgcgcacacatatatgtacatatatgcacacatatgtacatatatatgcacacatatatgtacacatatgtacatatatatgcacacatatatacacatatatgtgtatatatgcacacatatatgtacatatatacatatatgtgtgtatatacgtacatatatgtgtgtatatacgtacgtacatatatgtgtgtatatacgtacatatatatgtaaaatgagtatatatatacacacataatgtgtatatatatacacgcatatataaaatacacacacaaaaggtatatacaattatgtgaagtatttagagtttattactattttttttttaacaattgatcatcaatgataaagagtttatcttattaatcactcaatctcaattaactactgcagtgcctggcatggaatactcaatatatgttaaatgcatagatgtttatttaaatgattaaaatccaaacactaaagtttctgaggcagggatatgtaaaataaattctaattagtaccaaaaatcaaaatctgtcagaattatgtgagttcagaaaagatgtgcgatacttgtttccagtcacaattttctaggagaggcatcctagataataggaagtacaaaggcagaaatcctgaatgcaaaaatagcagaatgaaagtacagttttgactcttttccaatttgcaatactaatgccctacaaaatgcacaaagtgtacccagagtgaatggaaattcaacctcaagtgttttgttttcagttctataaatgttataattttattatccattaataataatgctattacaagacaaaatgtcaatgcatatattaaaacactagaaatgtatttgatttaaagtttccagacaaatttcccactgggtttgtttgtataagggtaggtaggacgttagggcaaaagagtccagccctgcatgtaatatcctatcggcaatcaatttaaggttctgttctggaagctttggcctcaggcaaggccagcttttgttaacggaggctgcaggcactggctgatcctacaaagcaaagcacatggaaggcctaccaaaagacctaatcaaattttccatctttaagaagcagcttctcctttgagttgtgacaccacatccactacctactccactcctcaaggagcagatgtgccccttctctgtttctaagtcctagccagcctccctgatgtgaaaggccggaagtcttccaactccacacccagctgctggcaagttggcagagtgaaatgcatttgtttatgcccctagccattcattttctttaagctggtttccagccaagatttttatctaggtaccagctattcttttccagtggttaacttcataaggtttttagttcccaaaggctacctgattaaaagtaatttgggcataaaaaatgtctttagtatttcttatatgatatatcttattttgtcatagaaatattaccaaatgcttatcctatagtttctttcagagtgagtttgcatttcttaaaaaaattaacaatgtatttataatatgtaggatttataatatacacacattttaagtatacagttacactttagacaaatatacacattcacaaaactaccaccccagttgagatataggataaaaatattactggagaaaatttctgtcttgatttcaaataatatggatttgttactcccattttaaactccacataaatgaaatcatttggtaactgctcttttgtgtctggtttcttttccttatatgtttgtgagattcaattacctcaaaaccttatggatatgtgctttcatttctcctggaaagatacctagaagtagaattgttgggtcttacaagaaattgctggagagttttccaaagtagttgtaccattttatatactcattagcaatgtatgaattttcaagctgctcaatatctttgccaacatttatgttttcagtattttgaacattagctattctagggggtgtgaagtaatatctcattgtagtgttctactgtactttctaatctcacctaagcatttttctctcttttacctaggttgtcagttcttgttcagtgctttcctttatgtaagagaatactattcccaatcaaaggacagactaccaaaattatggtgatgtgcaaggtcacctgtgtgatgacatataagttgattatgacaacagatgcatctgccaaaacatttccttgatctcctcctgtaagcttcctttgggtttctcaggaggggcagaatgattcactatcaacatagtatcacagatagacttatcagaatcttggtgaattcattcaacagaagtcttctccattttggtgccaaagcgataaaggaagaataagggcaagggagtgggtctagagaatgtctgtttctcaactataccttatttcccttattcaactgccacgttctataagccttagctcctacctaaaccacctaatgcatacctcttagtccaaaaaatcatccttgaagctcattagaatcaagtgcatctcttattaattgattcaaaagtgggaaaaaccatttcatataatttaggctacataaaatttttaaatacagtgcaaatcaattgaactgtcctttcgtgttgcatctttcaacagctgaatattctatatggcatttcacagaaataagatttgatttgagaacatctgcagcagtctggaacacattttcccctgtacttgacttttagctcattatagctctcagatgttctctcggcaatcctgtgacatattggagtgttactgaacaaacatcagtgaagcctatgtcttgagtagtgtcaatctcagttgaaaatgtttcagctttcttagcatcaacactagaagaatttaattaacccactgaaactttcaaagtggtagttaatgcatggaagaaatgagaaatcagaaaagtggggggagagtggataagtgcttaacctcccacaagctgatgcctgccatcatcagcctctgcttaggcaggccatgagaagccttgctgctctgtgtagcctcctgcattctgccatgaaatctctggcttgctctattgcccctatggagatggagaaggtgtggaggtggcaactactgctgtcatgctcccctggtccccacacaaggtcagcttccaggctctaatcagctctcatccagatgctctcatgtttttagtaggtggggctgggagaccaaggtcagaaaagagctgtcgggagtgacacggttttttgcccactgctgctattacattaaggaagcagctggtgagataatgtatgccaaagtgctttctaaattataaagtgcttatataattgtcagggataatcactactgttgttttattctgaggttgcagaaaaagcactgaactgggatgttgggtatcaaagtccaccagaaagctgaatataggaatgtgtagggtccacagggaggtctttggtgagagtacagatttggaagataacaataaagagaggaatattggcttcaggggtcaaatgaccatacaacaatatgagagccagagatggaacaagggaataccagtattcaagggacaaaaaaatgtgtgtgtgtgtgtgtgtgtgtgtgtgtagggggggtgtcctaaaagattaactctaagaagtttctcttcacacacagaaatattgtttatctccaggcctttgccacgctttatgccttatcctagagtatttttcccactcctactagactttgtttcaggttatctaggaaaacattctgaaactcatcccctgttgtctgtgtatatctctataattgcaattatcacactatattattaataactgtttaagcgttctatttccacacagtctgtgatccttttaagggcacaattatattactgttaatgtttgcatctataatgaccagcaaatactaggtacgaacggttgtttccttgaaagaaataatagagaaatatgagaaaaatgtgtttaaaagtcaaagaatacatttcaagtatgaaggagtagtcagttgttgaatgtcacacagattttgcaaaataaagactgggaagtatctactggattgagtgatcagtagtaaataactcaactttagtgagagcatgtttagtgattttggaggttgccagtgggtagaaatctaaccttgagtagctgaagacagaaaagcaagtaagaaacgaagggcagtgagtacggatgacattttctagaacctgaactgtgaagggataaagaaattcagaccattctttctttctttttttttttttttgacattcctataagatatatatatcctaactttttggatcaggaaataggggctaagagaaagtatgtatattgtccaaggcttactgcttacaagacagaaaccatgagtaaggtgcacactcttcttggttccacagttggaggaggccaattgctggatatcctcctaacttatttaaagtcaggctgtcttagtctgttcaggctgctataataaaataccataaacttggtggcttataaacaacatacatttatttctcaccattctggacgctgggaagttcaagattgagacgctgggagatttggtatctgggggcggcctgcttccatacagatggcaacttctcactgtatcttcacatggtggaaggggcaagggatctctctggggtcccttttataaggacgctaattttattgccttccaaaggccccacctcctaatagcatcaccttggcagttaagattttaacatatgaattttgaagggacacaaacattcagaccatagcataggcacaatggggaaataaacatcttagctgtatgttatggaaagaaaggctatgtggtagcctggagcactctgacaggagaggtcagactactagtggagtgatataatgggaaactgcactacagcactagctacttgcagatgggaaggagtgcagaaaaggaagtgaagaacacaaaaaatgagtgtattagtccattctcagactgctataaagacataacagagactgggtaatttacaaaagaggtttagttgactcacaattctgcactgctgaggagggctcaggaaacttacaatcgtggcaaaaggcgagagggaagcaaaggcataccttacatggtggcaggcaagagatgagtgaagagggaagagccccttatgaaactatcagatctcgtgagaactcactcattctcatgaggacagcacagaggaaactgcccccatgatccagtcacctctcaccaggttccacccttgacacatagggattttggggattacaattcaagatgagatttgggtgggggcacaaaatctaaccatataaatgaacttttccatttcataatttttcacagggctaaagagccagctacccctttggaaacagttacaagttatctggaattctatattaatcctcataggctggttgtactgtggtaataatagacccttaaatcttagtggcttaacaaaataaaagttcctttcttactcagaaaaagtctgctgtgtctctagctgtgctaatacgtggtatctgaccatctaggccatccattttatgttgccactatctcagcatgagacttcagtgttcatcgtggcagagaaagggagtagggagaattgagtgctagtgcttaaacgcttccagccaaaagagtcatacaccacactttgctcacatttcattgactaaagtaagtcgctcactcatatggaacatccaaggggcagggaggtttgcctcttataaaaccagaggggacaaagaatagaaaatattagcgagcactagcaatatctaccacaaatgccaaaagcacgcaaagtcagatggcattccagccttactctgtatctcaataaagattatatacagtagcacaggaataattttattttcctaggaggactggattaccacaaatgctatgtgtttgcttttgtttgtttcacttgggacctacattaagtggaaataaagacttggtaacatttagggtttgaaaggtgcccagattgatagcctgatgatgggtgggtgacattcttcagctcagctgggctgggctgagcaaatgaagagactaacagccagcacaggacctagaaaaggctctatagtttgagatgaaatggtataaaattgataagtagggaagacaaacgaaatgctttaaagatgtatggcaacaaatcttcaaaaggcatggtcttgacagtgaaacaatccacagcagactggccagcatggtgtaaggggctgggagtgaaggcttcagggcacttccagtctataaggcacttcataaacagtgcctgaagctgcaaatcaaaggcttctcagtgcagcattagtcacattttctgtgcgcattgtagtcacatcttctcagacacatttcgaggggtcacctgtgactatgaagcacagaactattatagggcatggatttgagctaccaataacattgctttttaagattatacagcataaaatagagtggatatttgataattaggtggttaactagatcaatatgggtaaccaaacagagtaaccaggtttctaagaagaaaaggaaaggagatggatatttcatctgaatgtctaaactgatttggttaagtgtgagactgccaattattcagggcaactgaagatatcctcacctatccttcctaagctcccagggttttggtaacgctgttcaatatccatatcatcttgaagctaaaaataaatttaattatggtttgttttgtttgacttttttttttggtaaattaaatcccccttttattattccaaacagcagacatttcaattttttcccctgaaatcttagatgaggacaaattggcataaagctcaatataattataatttctgttgactctttacattatcaaaatgactcctttgtctcctataattaccagaaaattgtatcttcaaactaatattccctttattcaagtgagcagatgggcttaacgggagatataacaaatacatgtttttctcaggaagagtatcaggggcatagctcaaaattgcagagaggtattttctttactccataaaatgaggattgggaacaaagctaactggtttgctataaatgtccactgattgtgtagagatcatagaaggaaaggtagggcatgaattcaaggctagaatttgaattcaagttttaacttacatggatatagtaatgatttcattttaaatcctcaatctccacccagaacaagaacaatcctcattttttttcatggtttaaaagcaacatcagaattaatctggacaacttgtgttgaatatgaaaagcattattatacaagttttaagtatataattaaataaggtgcattctgattagttatatttgatgaagtatgaggaattatacttaaccactcccatgaatgtgacaaaagaagtaactgcatttgtgtttggcaatttgatgtagtaaggagaaatggggaatcataatctgtataagcacgatggacaagagaaaggaacttatgggagaatgacaacacaatgaaaatgtagtatagtttacattttatttcaggcatgcaatggtggattgtgataaggcagttgtagcagctacagattcaaaaagcacattgctgcccaaattcctagaattggtgacctgttggtactccacactcagacatggaagtggaaatccatgttctgtactatctcatcctatatctcaatgtccatgcaggcactgacaattgatcacacacctctgctgggctaggctttgaatcacgagcttcctctatacagggctcccagcaggtactaccaaatgattagagttgccttgtaaaatgaaccaacttacctctgggatgagagaaaccaagttggggaggcttacaggacttcacaaactactctggttacaagcaatgcaaaactacctcttcccataacttgagggactcttatcagcccctcccctaatggttcacgttaaattcagatgttaacttttggcaacagcagtagacacctcccttctgcctattttaggaagaatgatggactactcatgacaatttactgcccaaacttgaagttaattaatttatctccattttacctggaaagtgaacacttctcaattatttagaagctttttgggataggaggtgcttcaaaagacaaagatgctagcttttgaccagatcaaacaaaactaagctagtaaaatcatggtgtcaataggttaaggtaacttctaaaaacaatttgtaagtaccatctgaaaaatctgcacaaagcagagaaggaatcaactcataaagtattgctcaaatgtttctatctaccccaatattacccatatattttggaaatggatatatcacatattcagtattatcccaaattgcctatctatctatgcctctccatgttacgaatagttataataacaaccaccatgtattgattgcttacaactacatgctatacactttagatagaggatttctcttttttatcacagaagacttctgtgtacatatatgatttctaatctttacaaagtactgcaaaatagctatcatcatctcagtttgcctttacataaatggaggattgtgggatccatgtagctgttccaagctcacccagtagtaaggcatcatgcctggatttaaactcagaccttctgggtttcaagcactctctcttctgtggtaagcttttgactacagcacattgacttatttgtgggatcatcacacactgatgagatgatcagaagctcagaacaagatggggctaacaaattttatccaacattttttgcttctaaggaggaataatcacaatttataaaacaggtgtctgtcttatttttacaggatacttgacactccagcattctacttaagatatcactcaaaccatctgacgatattcagatgtagattaagtcttcataacatttatgcagtacattctgatctgataattttgaacctttgaactttcagggactggtgttttgttttttattttccttcctcatgccctatgaaatgaactaaaacaataaaaaatatttagcctcatgtgatctgactacaatcatagaaagtgacctcaataatatattttatatcaatcattacccaagtgactgatagaaatgcaaatatcatctggaacttttctaacaacataatgtaactgtctggcagtcccagggagaataactgtggggacaaagctgtaatgggagaagataacatggacaagaagtacagggccatacaatgaacttgaagaaaaatggctttcattcccttcccttctcctcttttctgggttagctccaagaatggtcattacagtataaaaaagtcccccaaaaatgttatcatagatggacaggagtaagctgcaagagcctaccagcaggtccttattatagattttccattttaagattctatatactcatcaataaaattaaattttctaattattacagtttacattttgaaaatattatatacatttattctgggcacaagttcttcatgagatacaagtataggaatattttctcccaatctgtgacttgagtttttattttcttaattgtatcttttgatgagtatgttaattgcgatgaagcataattcatctattttttcttgtatggttagtgtttttttggtatcctgtccaagacatttttcctttccccaaggttataaagatatttacttaatgtttgcttttaaaaatgtacagtttgaaggcaaggagtatatgccttctgttcaattttgctgtgaatctaaaactctaaaaagaaagtcttatagtcttaccttactgtttacttttttatatcacatatttaaaattacttttttgtcctgtgtgaggtagacatgaggtttattttttaatataggtatccaataattccagtactatttgttgaaagggctttcttttctccattggattgcttttgcacccctgtcaaaaatcaattgagtgtatatgtgtgggtctatttctggactttctatccattacattgatctatttgtctaccctgacacccaaacacacttgcttgattactgcagatttatagaaaatcttgaaggcagatagtacaaattctcccacttcccactttgttctcctttttcaagattgttttggctattctagtttgtctgaattccagtgtaaattttagcatagcttgccaacttctaaaaaacacatgttgggagtttgattgggattatgatgtatatacagatcaatccagggagaaataacatcttaatatatcttaccattattttaagtcttctttaatttttcttcagcagttcttcttaacttttattttagatgcaagggtacatatgcaggtttgtaataaaggtaaactcgtgtcatgggggttcattatacaggttattttgtcactcaggtattaagcatagtgcccagtagttatttttttcctgatcctctccctccttgcaccttccatcctcaagtaggccccagtgtttgttgttccctattttgtgtccttgtattctcattatttagctcccacttatgagtgacaaaatggagtgtttagttttctgttcctgcattagtttgctaaaaataatggcctccagctccatccatgtttccataaaagacacatctcgttcctttttatggttgcatagtattccatagtgtatatgtaccacattttctttatccaatctgtcactgatggccatttaggttgatttaatgtctttgctattgtgaatagtgctgcaataaacatatgtgttcatgtgtcttcatggtagaatgatttatgttcctttgggtatatatttggcaatgggattgctgggtagaatagcagttcttttttttgctctttgaggaatcaacacactgctttccacaatggttgaactaatttgcacttccattgacagtgtacaagcattctgttttctctgcaacctcaccagcatctattattttttgagtttttattaataaccattctgattggtgagagatggtattttagtgtgcttttatttgcatttctctaatgatcagtgacactgagctttttttcatacgcttgttggctgcatgtatccacgtcgctgtgaaagcaattctttcagtgcagatactacatatattttaatttgttcctaagtattttatagtttttacatgccattgtaaatgacattttaaaattttaatttccagttcattgttccaattgttcatgtagaaacagaactattattgtacattgtttttgtattatgaaactttgttaaattcacttattattttaatagtgtatttataggttctttaggattttctatgcacacaatcttaccatctgcaaataaagacagtgcaagcccatttttttccaatgtaaatatcatttatttatttttatgaccttattgcgctggttaggacttccagtacaatattgaatagaagtagaaagaatggacattcttgcccagctcttgatcttaagagaaaataatttatcctttcaacattaagtatgatactaggtataggatttttgtagacgtttccttctattaatgaattgctgaaggccattattatgattggatgttggattttgtcaaatgcttttgctgatctaaggacttataactagaatgattaagaactccaagaaatcaattaaaaaattaaaaaatggacaaaatatttgaatagacagttcacagagtaagatacatggaaggccaataagaacataaagaagagttaacatcttcttattagggagaagaaaattaaaatcacaatgagatatcaacacatatgtactagaatagctgaaactaaaaagactgagaatatcaaaaggtggctggaacatagaagaaccaaacacccacccacagctggtaggactgtgaaagagtaaagccactttggaactctgtttggaagtttcttgtaaaacttatgcatccaccttatgactgagaaattatacttctatgtactagccaagagaaatgaaaacatgttcacaaaaggagttatgcaagtatgtttatagcaaaaatatttataacaccaaaaaagtgaaaacagcctaaatacaacttagagtaaataaattgtggtattttaataaaatatagtattatttaccaacaaaaatgaactaatacctacaataatatgaaaaaatctctgtaatattatagtgagtgaaagttgcaacacatacaaaaatacatattctgtagaattccatttatgtgaatgctaaaaaacatgaacaaactaatctatggtggcaggtgctagatggtgtttgcttctggtggtggtaaaggaagatgtaatggctggaaaagtgcacaaggcagcttctaaggtgttggcaatgttgcatgctttggcagaggtgaggatttcacggatatatgtgtttgtcacaacttgtcaaatggttcatttaagacctctgtatttttcctccaagtaatttatatttcaataagggaaaataagtggcatagaagatacaaaacttttaaagttgtaaataggaaattatagtatcctcttttgaaactgtcattatgcttttggtaagggtcttgctgttgacatttacacatttctttggacactgctttattctctgtgttgaataactttccagaaaggaaaaaaatagataattagacatctacatataatattaccacaaccaaatagcaatagttttatgaaattgtgttatttcagttttttttattagtataaaattaaggggtacaagtgcagttttgttacatggatatattgcatagtggtgaagtttgagcttttagtgtaaccatcacacgagtaatgtacattgtacccgttaagcaattcctcatcccatatcctgcttctacccaattcctcatcctacaccctgcttctaccctcccaccgttttgagactccaatgactattattccacactctatgtgcatgtgtacacattaattaacttccactcacaagtgggaacatgcagtatttgactttctttttctgagttgtttcacttaaaataatggcctccagagggcacagtggctcatgcttgtaagcccagaactctgggaggctgaggtgggtggatcacttgaggtgaggagttcgagaacagcctggacaacatggaggaacgctgtctctactaaaaatacaaaaattagctgggcgtggtggcagacgcctgtaatcccagctactggggaggctcagccatgagaatcgcttgaatctgagaggcagggttgcagtgagccgagaacgtgccactgcactccagcctgggtgacagagcaagactgtgtctcaaataaataaataaaaataaattaaaaaaataaaaaagaaaatggcttccagatccatcgatgttgctataaaatacatgatttcattctttttttatggctgaatagtattctacattttctttattatctgtcaaagtacatttagctttattccatatctttgctatcgtgaatagtgctgccataaacatatgaatgtatttttttgatgtaatgatgtcttttcctttggatataaacccaatagtaggattgctgaggtgaatggtagttttattttcagttctctgagaaatctctatactcttttccacagggtttgaactatttacattcccaccaaaaatgtataagcattcccttttttttcccacatcctcacctacatctgttattttttgactttttagtaagagccattctgactggtataagataatatctcattgtggttttaatttacatttctctgatgattagtgatgttgaacagttttttatatgcttgatggggtttgtcttcttttgaaaaatgtctgttcacgtcctttgcgtactttttaataggggttacttgtttgttgttgttgttgagttgtttgagttctttgtaaattctgggtgacagtccctgttggatacgtagtttgaatatattttctcctattctgtaggccttctgttatctcgattatttcatttgctgtgcagaagctttttattttaagtcccatttgtctatttttggttttgttgcatttgtttttgaggtctttgtcataattatttttgcctagactcatgtccagaagagttttccttagatttttttctagtacttttatagtttcagatcttacatttaagtctttgatgggttttgaggggatttttaaatatggttagaggtagaagtataattcaatttttatgcatatggcaatccaatcatcccagcactatttattgaaaaaggtgtccttgtcctagtgtatactttttgtcaactttgtcaaaggtcagttgactgtagatatgtggctttctttctgggttctttattctgttccattgatccatgtgtctatttttgtaccagtaccatgctgtttttattaccacagcctaattgtataatttgaggtcaggtaatgtgatgactccagctttgaactttttgtcaaatttgctttggctatttggactcttttttggttgcatatgaattttagaattgttttatcaataactgagaatgatgtatctggtcatatggatacaattttggtttctattatcaaaacaaatccttgttttcagagttgctgtacaaccaccatgacagaatttctgattttatcctaatgagagccttttaatgagcacagattatgttcatttattaatatcaccaatatgtatttcatcatttttgaaacctactgaaagtacagtaatttggcaggtttattgttttcttctaaaatgactgctgctgttcttaaaaggatctagctggaattttaattatacattgactttcttttttcctcctaaataaggacacaacagataattcgtgcaatttaattctataaacatgtagcattgtgctaggtgcttgcaaactccagtatgaataagatattatctttccttcaaaatgcttgtaatgacctgcagcactggacaagaagatatacaattaaagaaaatgcagtacttgcaatactagttgtaggaaccatgggctgtaataaaataaaaaggagtgatttgactttcttggaggccaaggaagagggtcatagacagactcacaaaagaagtgacatttaagatagattctaaaaatatattaatgattgatcagtatgttcaattcagctaccatgccattactcctacatggtagacattgcattaggcactggcacacagtctgtgttctaggccgtcaagaagcttataatctaggcatattttgccaagtcaagaaggcataaaggttgctcacctgtctatctcactccttctattctggctttttccatgttatttttaccaaactcaattcacacataaaaaggaactttaagttcaaaggttatttctttacatattcttttcttttctgatgtaatggaaaaagtaatggcttggtaagtcaagtgattactaattcttaatgttaccaataagcttttttctttcaacattcatttagtcatcagttcacttcttcagtcaacatttattaaggcattaccatgttcagtgcatgtctagagaacttagatacaaagatgggtaagaaaagtgaggttattttctagtaaaggaagcagacttacaaaaatacaactgcgatgtgatactggttacagccaaggttcaaaaaggaaggagacattaattctatagcaaaggtcagggaatagctcaaaaagtgatgcttgagaactggaaggccattccagatgtcgggaacagcatgtggaaatgcatgcagatcccaagtgatcattagtttttggcctctactgtttttctttcatgactggtatttaggagtcctgttctcatcccaagcaccaaaaagtgaagacattttctttcatgcttttccagttgcaaaatttgttgttcaaatatcggactgtccaatttctttcatgtttcttaacgaagaatgtcaacataactcttatttcccataattaaaagtgccaaatagtaatgttttcttttctgaaatcactaaaatatatacattgcctccaactctatagatgaatttctggatgaagttatatttgcaattatattttcattttggtaatcttcacaagcccatagttaaaacctttggagccagatgtatggatttagaaatatcttttggattttagaaatgtaaaatggtacatacacctaattttaataaacactccctctccagccccagcaaggtgtggggtagcaacctggaatcaaacacgttaatctgatgttctctgagaggaataaagattatagcaagtctcacatcagttcaggccaggttttctgctgaatgaattatgtaaaaccatttggtttcagtatgttttggatttcagaattgttaatgagggattatggaactgtattgtaattattttcattgtacagttttataaaaaggtttacagagattaagtaacttgcccaagttgtctagctaacaaggaagcttcacataaatccagcagtcttactatttgctaataactgctgtcctacatgcagtttcttcattgggtatttccaacctctggccatttggaacctaatgtgatgcttctctggcattcctctcctgcctcttttatttcacttctttttcagctcaaaattatttattgtttactttctccatcaagagaagcttgtgttctgctcattgctgacttctcaatctctcactgttctattgctattctcttttttgtcccttttggcaatgcagatttttggatccctccatgagaattatgatgttaaaatgcagattctcaacacacctcttacccactgactcaggatcaatgctagtggggcctgggaacctacatttctcacaagcatgctgcatggtttttaagcaccaagagtttgacatcaacagctctgtgttgtgccaaagctgatgactgttcttctcaggaatttgctcttcttgcaggcacagattttaatggcttgcacagtaagtgtactaacacccaactacctgcccttcaacagccacctgaagaaatgctggttaggcagtttgatcagttaataagtaaggtaagcataaggaaagtatattaatatgctaattacttgaaagataacatgacatacttggccaaatccttgtttccatagcccaagtctcattttctctccattgtcaaacactgcactgtaatgggtttcttctaaatatctattctggtttattctagcctgacctatgagtgaatatcagagtagccattgtactttccaaacaaaattttcctgtgtaaagaagccagatacttctagagtgtctttctacaaagggtctacattttctctcatcttcctatagtatgcggacactgtgaggaccagcatactattctttggctaatgataggacaatgtgagttatatgcaaagacacacacacacatacacacacatacacacgtacatacaaacacacacacacacaaaagcagcagcaacattaagaaagaatgattagtttgctgagaatgatgcacatgtaccctagaacttaaagtataataaaaaatataaacataataaaaagaaaaataaaaaaattataggaccaaaaaaaagaacgattaggaaatcacctgtaccctagatccagagtactttgattcactactggggatataaatctaaagggataatcacctattgttttagtcatgtcagcctgcacaggagaatccagaagcacaaatctattaccagaccatctgcttattcctcaagttagtgttgagaaatgaatcactaatataatcacatagaaaaatcttcctttttttaaacgaatgataatgctgaaaattacacttacgattttgatgaaagctgagcttaacaaaataaagtctgaatcttgattcaaactattaccaaatcagtttccatttatgtcattgacacaagttgtcttcatcattacccatcttttatttgaatatgtaagttttgaaacgagtgtgaaaatcctttaaagacaaaacatgacagtgcaatgcagctacttccatttccgctcacatggcaaccacccaaatttgagacaatgattttatagatggtcataaactatcatgtcagagacaatttccttgagatatttacatcgaatgattgtaaagtcatttgtgaattttttttagttataagcaaccttaggatattgatagtcattgataaaggcaagaacactcactgtctaaatactgcagagtcagtttatgataatatgattagttacactaataatgctgcttaggcattatcttgctaattacaatattataaatattaatgtcacagtctttctgtttgattgccactcatggagtcattcatcatgacattttcctggaacccacattgtaagattttatttctttcctccttttcttttttcattactggacttgcaaccatacacattactcttgaagaagggttttttttggctatctattaggagagggacagtgatattttctactaaaactagccaaatataagtcaattatatgatgtttctcttattctttctgagtccctaacccagtcatccaaggcagagtacccagggcttttgttttccattctttttcatgtgacctgcttcaagttaagattcatttgaattattaaatgcttccttaaagaatctttttatactgcctctcttttttttaaagttaattattgatgtagtgacaagctgaaaagactaagaattataattttttcctcccctcattgagggctcaagaaatgtcttctgacaatggttatctatttagaataatacaaaggaaatacaaaggcaaaatgctgaatgttgttttagcagtgttgctaaaatcactgtattatagaaaacgtaaatgtagtgtatatttcttggaaaatagcagttagtgagaaagctgggaccataaccgtttgagaccgggtttaaccacacagcagaagcagttacaaaagatactgattagattttaattttaaaaacttccttatattattcaagactacagtgatttgattgtcttgaaaatagaaaggtaatgttataatttccagaaagcataaagaaatctccagactcccactgggaagaatgccagtcatcaccacagtaagcaagaatttggaggcactttacactgcaaacatcggtcttttccttttatataatcttgtgttgtattggtttataaaaaggtaactcacagacccatcatatggctgtaatcaagtctccttcagaaagagtccactgaagaaatcacatccaggaggcactgtgtttcctttgttagtgagaatgtgagatggtaaataagatctgaaatagaaaccaaggctgagttctcaagaataacacaggagatttaagcacataccttgtccatgagttcagctatacgtggaactggtttccctttctggtgactcacagtagctggactctgtccatcccagtcttgtagttcttcaatgcttttcagataaagcagggctttgaggccagtgcagtagtcttcgatcacagtgaaatcctgattctgaatggcactgcatacctagaaaagacagagcagtcaaccaagtgtcaaaccaagagataattctccaaacaaattcacttttctttgagtcaacaaatatttattttatgtgccaggcactgtttgaggcatgatggatcagtagccgtctggagatgggggtggtggggaggaatggactgcaaagaacacaaggaaatttccagggacaatgaacatttttcataaacttgcaatggtaatggtgtcacaggtatatacatgttccaaaacttattaagttgtatagtttaaatagctacagtttattatatgtcaggcttaaggagtcgaatttggcacaacataataaaggacatttaaattctcattgtcactctattgggatgtgctgcctgcaggcagttctcacgtctgaaagtggtcaaactgaggttggagtgctgtttattacgttaactcaaccatcacttacccctgcctctgtctccctcctcatctgctattgttctccttgttgtcaactatgatccagttacccaggtctttcctttcttcctcaaaaaaaatgccatagtctttctttgccttaggatcttttcacaagaccttctcactggctagaaggcctttcttttccacacatggctaactaccaaccattcctcaggctcatggtaaatgtcccttcttcaaggaggcttccaggagcccagaataggttatggccttcttttaatcagacatttttaacttctaattattgcattattatttagttgacaactcacttcccaattagaccaaagtttcagaagggaagaactgcatttattttggtcactatattatctgcagtgactaggacactgtttgtctgttagtctgctctccacaaatataagatgaatgaataatgatgatatggtttggctgtgtccccacacaaatctcatcttgaattgtagttcccataatccccacgtgcagtaggagggacctggtgggggtaactgaatcatggggatggttatctccatgctgttctcgtgatgatgagtgagctctcacacaatctgatggttttataaggggcttttccccttttcctttgcacttctccttcctaccaccatgtgatgaaggatatgcctgcttccccttctgccatgattgtaagtttcccgaggcctcccccagaaatgttgaactgtgagtcaatcaaacctctttcctttataaattacccagtctcaggtatatctttttatttatttatttatttatttatttttggagtctcaccctgtcaccaggctggagtgcagcagcgcgatctcggctcactgtgacctccacctcccgggttcaagcaattctcctgcctctgcctctcgagtagctgggactacagggacacaccaccatgtccagctaatttttgtatttttagtaggaacggggtttcaccatgctggctaggatggcctcaatctcttgactttgtgatccacccgcctcagcctcccaaagtgctgggattacaggcgtgacccactgtgcccggcctcaggtatatctttattagcagcatgagaatggactattacaaaagattaaaaagaaaagagaactaaaataaaaaattctggagttaaggaagtttgaatcagagaaattaaagttcttccactaaaaaaaccctggggattctgtgagtgtggctgggatttgagttaaagcttgaagaatgtggatttagatactgcttctaggttgcttatttccaaagatatccctccaattttgatatcacatgtagactccagagagtcatttacaacttcctgtagaacctcttcaccaacatggcccaacattacatcaaattcaaaatttacaacatgaattcaacatacttcccaatttatatttcaacttcaaacaatgaaacaaccattaaaacaaaactgagcaaagaaaaactcatttctatcctgttttcccagatgttgaatacctagtatatcagggtgtctggcaatggcagccaacaaagaaaaatcatgtcatgcatgaatgaaaaagaaaatgaaggaaatgcctgaaaacagaataataagattctatttcaaagactcttaaagccttttgggtctttgattaaatacattttattgtaagcctcgtgcctagcatgctacctgatacctcattgttgctaggttggttgagagaatttattgaaaacatactaggaggttccagaatggggaatgggataaggagagagagagagagagagagagagagagagagagagagacagaactctcatatatatatatatatatatatatatgtgtgtgtgtgtatatatatgtatgtgtatatgtatgtgtatatatatatatatatatatatatatatatatatatatatatatatatatatatgcctaggagttctcagcaagcagtggtagtgattccatgatgtgtacctaaaaaaatgccaggtgtgaaattctgggaatgctagcacttaaaaggaaggctaaggaagatgatcgtgagggacaccgagcagaagagatccaagagagttaagtcaggcgctgcagaaaggtcaggaatatcagagctggaagcgatgactggatgtaacactcggcaatataccggataacatttgcctttataggagagatctgcaatggagtagatgccggtttttttggtaggttgaggaatggatgagggatgatgaactaaagatatgcagccaggtcacatttctaagaagtttggctcctgtaagaggaagaggcgagctggggttataggttatagggttttgcattttgctttttacttttatttttgagacagagtcttgctctgtcacccaggctggagtgcagtggcacaatcatagctcagtgtagcctcaacctcctgagctcaagcaatcctctcacctcagcttcccaagtagctaggactacaggcacacaccaccatgcttgggtaattgtttttggtatttatttatttatttttttatttattcttatagagatgaggttttgccatattgctcaaactcctgagctcaagcaatccgcccacctggcctcccacaaatgctgggattacaggcatggaccaccatgcttggcctgcattttatttttttaaagaatgaaaataattatgttttaaggagatacagttattttacatttcagaataggacagactgatttctgtgtatgagatttctgtcaaaattggctgaatgattatgcgatgagaataaaacaatgcaatatctaacatgatgcgggctcttcttaggggccaggcactttgttagcacttttaaatatattatcttctttagtcctcaagataaccctaaaagataggtttaattttcagccccattttacaggtgaggaaagtgagtcttaggaaagttaaatgacttgctccaggccccatggttagaaagtggtggcaccagaattcctggccatacaatagaatatgacctagatatagacattaacagaggaaaaacttttaatataactacaaatactttcctacaactattgcatggaccaaatgcatacgtttttaaaaatttaatcaagttatcttcaactgaaatatagctctggttttgaaaaaatccacacttttagacaaaaattgtcaatgttttcaatttaccttcttacttgtacagtatgagtaagaatagtaacaagccaaaaccaaaaagcagaaacaaaaaccccttcattttctattctgaagtgctgcatgttagtacaatgtagaaaagagtatagaataactactaaatatgaacaagaacattttctaggaagcccatttacatcagattaaaaaaatctgtttctcaggaggaacaatttgaacattaattaggcctgttataaccttcttagagttggtggtgtttttttctcacaacaattataaggaacatcattatcatttcctccacaggggtattttttttcttttgactataaaagtcaactgatgctttacttaatcctctttgctcactctgagattctatttttttgtagtatatgcttatgggtatactttactatagtcttaaaatagttcaccatgtgaacataagaaatcagattttgaaaatcacataatgtcatgtactttatgggattttcatgattattgtaaaatcctgctgctaaaatgaatctagaaatacactgcaagggatgaacagtaaagtataatctaaatcatccctgatgtttccaggaagaagatacaaaagctatgagttatctcaatcctcaaacatggcacaatttgtatacagtagactcagacaaggagtggagtgatcagaatgtagacttgggatcttttaactgtagaagaacatggtaggtcccaaggctaagaaaacttcctctttcccacccacttctagactctttatcatacagggttggtgtttcacataattgggagctatactgagaatgtgaactgaacacaaaaccttaagaggaaggagagactacaagatacttactgagcaagactgggatagtgtgcaatgctggaagccctggaatccaccatgagacacgagtgctggaggggaccacttcagatatacttaatcatatggcaaatgtcacaccacttacgtacctttacaaaatgagtagtttaatttttacttccaataagattaaacctactaattttcctgatagaatttttgatagtaggaactttgcacattgatattttcttttaaaattttgttgcacatacaaatcaggtggggatctttttaaaatgcagattctggttttgtagctttagagtgggatcctggagtgagatcctgcattggccaaattttcgggggatgctgctgctgctgctggaccacacttagaacagcaaagtcttaagcactggcaggggtgaatctcatctcaactgaaatgctgactgcaaaaaaaaatttcttctaaacaaataggtttcttcttaatttttactattagattatatcaacattttcctagcctttcaaagaatgcactacttataataagaagtcatgtttgaagaaacaagaataatttgctgattaaatactaataagactaaaaataaaacttaggatgcaagtgcaccattgagaacagctttgcccatggatttgatctcaggaaatggaattgcttagaaagatgccttgtccttgcctaacttatatactccattgagggccttatcgctatctcaaaggtaaatcgttcttgttaaaactccaaacatgtagctgctatgcctaaatgggtgcattttatatgacatctcttaattgtttgtttaacagctctgattaggactcttaatagctgttaacatgtttgcttagtataatttgtaagttctttatggtgaaggctggtttatctttcttcacagcagggcatcaggtgccattataaggatcgttgccaccattaattatttctatatgtgtgaatatccctatagtgagctattttaaagagaggcccctagattctcagcaggaccagccctacacaggagcagagtaggtggtggcccccgtgcagcgtgatttgacgtgttccataaagcaccaaatagcctcctccaggggtctgacacagtgccctgaatttttactttaggtgcagacgcatttaatagaggccgacctgtgcagaacaactgtacaaatacctggatggtaacagagggttgtggggagctattcttttctcattatttctcataaaatgagattaactagattatcagtaaattacctatttatggagatttacgtcttcaaaatcttctttacatacattatttctttcagtactcaaagctgacttagtcaggagagggagtaatattcttacttgtaaaatggaaagagcttggacttgaagtcctgtttcttaaagtcaatcttgtggtttctatgccatattaagttaagaggctgagagcatgcacacagaagtcaagcagaatagagttccaattacatcttagctgtgtaatcatgagcatttttttcacttaaaaatggagattaaatacttagcacataggaaactaaaaggcaacatacttaagtgcttaaaatagtagcttatactcagctacattggcaccaaaattaaatttcatactatgaataaatcattagggcatgaattaggcaggatataatttttttaatgtaatacatttttggtcaaatactgcagaggaaaggcatggaccttatttttatttgcattaaataatgatctccaaaaaaaaaaagctttggttttgttgtcagaagactcaggtctgagacccaactcttgtcatctggcagctgtgtaactagggctagtcatttagcttgttgattcccttctccctcctttacatctgaaaaaggaggatgataacatcttattgttgtgaagattaaattataccatgaaggtggaagtactgtggaaattataaagcttagacagaatggtactaaacctcataggtattgtagaatttcacgtaatctagaatttcaagtgcctggcagaggccaaaatgggaagttttgcctattaaaaaaaagctcacttcatctgaaaagtaaaataaatttacaaggaagctatcaaataaaatctaaattagattaaaaatatttatcccaggtaaataatttggcagagaagagttctacaaaagcaggaacaccctgagactggcacatgcttttgtgtaatcaaatagcacatttttcaaatgctattttaaaatataacaaagtttaaaaatagagatcttgatctattaaacacaactcagataaacccatgaccataattatcccttttcatttcttatcatacaggtggataaactacacttcaggacttagaagtatgtgcctccaggttatatgcaagtaaaatatatgcttacaatttaagtctaaagttgtctcaaatttactgtaaattcattagtaaaagttctattggagaattactacatttaagcaaaaacggaaattcttctgcaatggttatcacatcacaaattgcattaataactgagttatgtatctggaagaggttcaagaagcctcccatgaatgtggttcatatatgaaacactgaataagaagggttgttcatccaattcttaaagctttctcaggaaaaagaaggttatattatctcttcttactaacctattttgataagcacatattttgtttaaactatgcaaaacatctgcaatattttatatagcactttatagttttcaaagcatgctgtcaaaaagaaatatctatacaatgatttatagttttcaaagcatggtgacaaacaagattaaagggaatttagactttttttcagaccagcttcctcatttcagagatcaggagtccagactggctaaatgatctgtgcatggtacacagctagttggaggcagtgctggcagacccgcctggtttgaagctctttctgctacaacactgtctgtcaatatcatcgtacagcagttctaagagaaagacagagaaggtgctatgaattgttcagtaagtgaggaaattgaaaccaaacattgaatgcagtgcccaaaatcaagattagtaactgggagggccaacagtaagactcagaatttctgacctctgcagagctttttatcttttctttttattattatttccataaatttcaaagccttaaatgagatgaaagtcttacatatataaacaagcatatatgtataattttcataaaaagaagcgaagtgatttcacatttattagttaattattatgacagaaatccacagatttttaacatttaaggttttaatatttggatgacccacttaaaatttcttactttaactggaaactaaatttctcctgttttcggatgttatgcagtttctaattctatctgtccacacctactgattaaaaaaatcagattttctgaaggcatggaatcaataattactcacggaattgagttctgaccagtactaacaaacagatgtataaaactacattgtactttaaaaatggatgtacaatacatatagataaggtaagaattcagaataacaatatccgcctatgagcttttggtactacataaacatggcattgcttactggaattcatgaataaaacaccaaaattataattttataaaaatataggttaaaagacagcccctggagatacatagtaaatagggaactagatggggatgtatttgtatattcacataaaaccacaaatcttagttgttctatcatattagtttctatctgttggagctgtacaacatcaaagtcatgatgtccctatatattgcatttagcagtaatgtaacggactacgtgaagaaatcaaagtgagagtttctaagtagtttcctggcaattgagacagcaggctctctcatctgctctgtaactgtggcagtgcattgatttaaactccttctgagatctcaaatgcttttatattcttaggtctctcaagcagctttttttttttttttcccaaagtgataaaattccagcattcagcagaataccatcttgtttcccccaaaaggagagggcttatttcagctttgctacgaaactgcacaggatcactaagtaaaatagctgtccaaatgtcattctactaagaaatctggctttgagttcagttgtctatgttctgaccacagcaaataggattgggaaaaaaagaacaacaaacgaatagccccggagatgttgtttttcaaaagttcagttcagaaaaattgccgaaatggataagtagttctgcttattaaatattttcaaagttgtttttaattgccactcattgatcagtccaaatggtataggagtcatttattttgtaaatcatatatttcttctcagtacattacttatcctctgaaacgataaattctctgataaattttaagtataaaaatttcccccttttcctccaattaggaaggaactttatgtagcctgaaagtctatttttcagtgtaactctgtggtcattctttaattaatttcttaacccaagatcagctaaagacagactgaagagaataatatgttttcaaggtatattatactgagatccaaaccacattttgccagccagaatataatcatcaattctccaagtattttctcaaaggcagcatatgatgggccacccactcgactactattcagaagagcatttgtgagactgatcttctctgttgcactttgttgatgacacagtttcactgaagatggcctgcgctgattagtcaaagggctgtgccctgcaggcgagactgccctgcccccttccttgtatctgtcctttacaaagtgagctctaactggactcagatctcaataatgactgcaaccaagaaataataataagaaccatacagagacacagcacctctgtctgccttttatgtgacactagagataaaatgggtgagacaggtacaacatgtagggccaaagaatggtgattactgttctgtctcttcaaagatattgctgttgatggctctgcttcccaacgggcataaatacaagactcaaaagactgaggtaacaactggagtcttctacacaccaggatcctatgcagcccattctttggttaggaactgtggctgcagtttgaggaagcttggccactgctcttcagaggcagtaggatttttctactaacatcgtttctcaccatcaggctttggtgctgcatcagttaccacagcaattttcaattactctgcagtaacacaggtggtggtgtaagggtttgcatgtagcattgtgcatgctcagcacctctcatgataaaagtggggtaagaaaaggaaactaaacatccaaacaatagctgtcagaagactcaaatccttaattttaggcaatctttctttttcaacagagtcaacacagctgggaaaacttgatttatcatatcattcactaaaataccagatagagtttgatcacagaggagaagtcataatgcctagagagaaaaagttcaggaaggggaatatcacactctggggactgttgtggggtggggggaggtgggcgggatagcattgggagatatacctaatgctagatgacgagttagtgggtgcagcgcaccagcatggcacatgtatacatatgtaactaacctgcacaagcacatgtaccctaaaacttaaagtataataaaaaaaataaaaaaaataataaaggatgagttcagaccccccccccccaaaaaaaaaaaaagagaaaaagtctatagggaaaattaacgcatggaatttttttctgaactctgaagatggatgaaagttatgtggtcactcaataactaagcagacattcacattccaaaaaaaaaaaaaaaaaaaaaaaaagaacaactcacctacaatgagaaacatttgttaacatgaaaataacatctcaaatagtcctgactacctctgaaagcattcacaattcagtagttggtgtgatagttaatctataattgataaaaacacaaatttgtgagagagtacaacttggctgttatcagtgagtcaacaattttgactgagttgccaatatattctgggacacaaaagttaaagttcagttgattaagagtgaataaactatgtaagagttaagcgttataggaaaaacaaaacaaccttaccaatgttgaagttaatatatggtaaacacggtgcatatttatgggagggctagagaagcaaagcaataaggtttgcatttgttaaaaggaacttttaaaaatactaaactcatttttaatccctttactgtgtatatggaaaaataaaagctcacaaagtttgtggttttgcagaaagaccaggaaaataaattgtatgctagttttttttggctttttgttttaatgaaggccaagaacctaaaagtaaaatgcctggtcttcagctacaaaagatggatctactggaacatggttacagacaaacaaatgcaatgtccaaagaagtagttttatttatgccttctcactaaaagggcacatattttatgatttgtgactctgacaacctgaagaaagattacaaacaccagtaaaagttctaggctgagggttttaggaggatgcttagagatgaccatataatttaccatccaaactgtgacacttgagagtaaacaggaaactattagtgaaaataccaggaccagcagtataaactgggattgtcctgtaccactaggatctgtgattcccttactcagagggtttttttcattcctgtctttatattggagggagactttcacttgtccctgtggaatgcattccaaaatgctccgtcacttttggtttagtttaacattctggtctttcagatacttatgcaggcctcagagcattaacattggatctaattcaccaggcttttattacttaggtggggatttggaatcctggagacctgacttgatccaataagaggacccgacttgatcctgttattgacccagataatcctagatttaaagggtcccttttggcctccaactttaaaaaaaataattaatagactttgctttttagtacacttttagatttacagaataattgggcagatagtacatagagtttcatacgcccacaccacccccaaactcggcaccttccccattattaatatcttgcattagatggtacatctgttacagttaaagcaccaatattgatatgctattattaaaattcatagtttatattaagattcactctttgcattgtacctttctatggtttttgacaaatgtataatgacatgtattcatcattagagttttatacagaatagcttcactgccctaaaaatctactatgctgtacgtattcatccccctcaccctcacctcccccatcccctggcaaccactgatcttttttactgtctccatagttttgccttttccaatatgtcgtataattgaaatcacatatatgtagctttttcagattgacttatttcacttagcagtatgcatttaaggttgctccaggttgttctgtagcaacagaatccattcacctattgaaaaattatcacagtttttttcaactttagtaagaacttcatatattttaaaatataaaaccatttttctatatagccaaataatattttaacagttaataaaataaataattccttagtgtaatctgatatccatagtacaatttccataatatttttatagctagtttatccaagcctaggttcaatccaggactgcatgttgcatccagttgctctgtccttcaaggttccttttatctggcacagcctctttttcattgcaccagcctgttgtagaaaccctactgctggagtctggctgctttgccacagtgttctttacatttctttcctctaacccttgcatctcctggaaacttgtacttgtcttgaatcttgttgaactctcacacaatgtggttcactagaattgggtcctcacagggcatctccagcgcttaatgggaatggggtggcagggaatgaatggtggacattgcctgtaatcatgggcttgctctgctgtcccactggacttcagtttaacccttttatgataaaagatacaactcagaaacagccaaacagaaaagatgcatagggcaaggtatgagggaggggtacggagcttccatgtcttctccagacactcctccaagggtctttcagcctaaaaaaaaaactcaaaggggacaggggaggcaaggagctactcaaaatccatatcctttaagggtggaaaagtttggtgtattttaacaaacttaatattctgtccttttgtaacttatttctttatgctttacccaaattcccttatgattacagcattttgaaatttacttaggttacttattatgttttaaaccctgttcaaaatatgtctacatgtagcaccacattgaaactcacaatagcaccttgggtaagtattattattttcttcagttagcagatgggtaaatatggggtcagaaattacaggccttgattaagatcacacagctactaaatggcagaacaaagattaaaattctggctcagtttgcccacaggatcctttcttgtaaccacagtgcagtcctgctttctgttctgaccactactacgaaggcaactggctttcatgtgaaaacagggagattttatatatatatatatatatatatatatatatatatatatatatatatataatctatatgcttataatgcatatgtgcgtatacatgtttatatgtttatgttaatgtatgttttatatgtatgtgtgtatatgtttttaggtttatgcatacacatacatatacacacaagcatctatatacacacaatattgtatgtatgatatacaatatatgtacatatatttatacatagacacatatatacacatatatacctatgtatatgtagtatagatttcttgtaagtattatatcaaataaaacatacataattatctacttcagtgcctaaataactgcacaataggtatcatcatttggatctcattcaccagatttcagagacacagcaaaaagggcagagactatatttcttttggttaccattgtacacccagtacttaccacataaagatctttgcctggcatatgacttattcaatggatgaatacatgaagcaaaataaaaatattgtaatagtatcagtcagtgacaaacacaattccctttcattccctgtccagaatacatttttctctccaattatacgaatatatcataattaagaactcacatcaatccacaagagaatacttttctctcaacttttgctgcactctatatcactcattgcatcatttatacattaatatctttgcattattacttaactcttctttggatatgccaatgtatttcaaggatgcagggagtaactctacttcttcagcatttttcttcatattcaaagtactatttgtcacagacaaactggacaaagcctgtgtatagatttttgcatctctggtgttcccagtctggatgcctgagtcttatcagcaattgtcatttgattatgttttctcttatgatagtcccctttaacactaactgaaggaatgtataattaagaaccctataaaagatctcatttaacaatgactgaattcacactatcaaatccaatatatacaatgttctaattttcacacatatatattaaagcaatctggattctaactctaataaaggacagataaaacagagcccagagacgctaaggaaaaggtcttctatcttgttttgtgtctagactctcttatctaatttttttgggtttctgcatcacgcaccaatagaggtcagtccagcattcttgggtcaggactaatgttttcattttaaagaattccctctctatctttaattatttcaagttcataaagttcaacacttcatcaaattactttgaaatagttcaaagtaaatgataaaatgtattattgagcaaatttgtacaaatattattgccattgtaaatgatttgcttcctctaatacaggtcctgcaaaaccactgcacatgcccagtaaaggccttctctctgtttgctgggaatgtagccaggagtgtttaatagattattctgaatttttaccagaagagagcaattgtttttgtttttttcctctctttcttttttcttttcttttctttctttcttttacttttttttcttcctctttcttctttctctttgtttcttttctttctctttcttctttctctttctttctttctttctttttctttcttctttctctctctctttcttttttttttttgacagggtctcactctgttgcctaggctgaatgcagtggcatgatcatagctcactgcagtctcaaactcctgggcacatgcaatcctcctccttcagcctcctgggtagctgggactacaggcgcatgccaccatgcttggctaatttcttaatttttttgtagagacagggtcttgctatgttgcccaggctgatcttgaactcctgggcttaagcgatcctcctgcctcagcctcccaaggattgggactataggtgtgacacactgcacttcgccaagggagctatattcaaactcatcatttcttcaaaaactttctctattactcaaaaactacctactaattaatttattctttcattcagcacatgttaatttatggactaatcttccggtttcttttcacattcaattatcaaacaaaattgttgactgaagcagcctgaggttatgctgtttgttttctgtcagaatgaactttccatgcagagctgttgtgaggaccaaatgagataagaattattaagtactgtttactaggaaggcctcccttgttggtataggtgtgacacaatgcgtttgattcagaggtaagaataattattcaagttctgaattttgtatctgaatgtgcaactggtgtcttctgaggtgtgtgtgtgtgtgttccatattgactaatttctaagatgagttgctccattgagctccaggaccaaaatgatcatatctttgttgtaaacaattaacttaatcacacacagataaacatataagatcgaattttgagacaaggaaatgacctgactttcaattgttatgctttgagagtataaaccagaatcatattaccaccgcctacccataaatcaatatactacaggttttaaatcaattattgaatatgaattaggtcaaagaaaaggtaaataaggtaaataaatacaggtaagttggattttatgtgttttatatttcatttttgtctataaaatgtcacactttaaaccattgcttatattttgaatctgcttataatcaacattacctaattaaataatgctcagacatgcaatagaattggctttttttaaactccctccagattactcacatttattttttgtgttttagagacatcaggccttataaatgtgcaacagtattcttactgtagctgtgtaagaccaggcatgtgtaatgtgtgatgtatttggccatacaaattcaccagtgattaaactgattttttgcttgtgtcattgtttttaggctcaatgatgagtcgtgaaactttcctctcacctcatattcattgctacatctggtgtcatccagagttaatatccacgatgtactgattgatttaggaagatgataatgagattattgcttatgcccttaaagcatgacaactgaaatcccatcattttccacatgaggaaatatgctaaatattataatatctgacaggtctatcactgtgggattaagccagctatctgaaacaaaggtttgatattttgatctttagacatattatcttctttcgtcttacaaacacagaattgttgatttggagataatggcagtttatatttgcatgcctacatctttaattccacaaactgttaaggtcctcctggttcatatctgccaaacgaagctaagagcaaacattgttctttcttctgattatgtggggcatgaccatagaataggggaagagaaatgtttaacttggagcatttatatttcaggccaggagaatctggtttaaaagttttcaaaagactgatgagccacaaaaatattaaatgtgtaggaaatctgaccagttaaacaaaatgaagaaggaatgtttcctgaatattcaaagaaggcaagttatagaattggatgagcatgtgtttaaagctaataaatgtagagcgtttttttccctcccccttggagggaaatgttttatagaccatttacttattttattttaaaatgtacatttgatatgaatttcatttcttttactctttcctcaaagattcataatcttctaaaatttagcttcaggaacatatttctgagaatgacaagagcttactgaaactggcctctgaactattcaaaacacagttgcttattgtccatttttaaacattcattggtcgagacttacagtaaggcattcctctctccccttagcatctgtccacaagcaagtatgcacatatctgctttgtgcctaatattatttcaattactatgaggcattcttaagaagtgaaaatgcacatacatcctagctaggagataagacatacattcatttatctgcattggcttgtacatgcattttcaggcttgagacatgtctagaaagtaggatagaaacaaaaagatactagtgcctatctgacattttcacggaggtgtttcctaggcatcttaactatagccagaataccattcctagtttttccactcactgcagcctactactccaccagtccaaagtctagaaatcatctctgtccctttcttttcatgtccacaaccattcaatctctcagcaaatcttgtagcactacttcaagtatatatcgtgaatctatttgttgccataaccacagcttcttgcaactggaatcaatcatggtctctcacttgcctcactgcaatactttctttattcactcttgaccctcctaaattaattatctacacgacagctaagatgattatttaaaaatattaattagatcataatttgccactgcataagaccaacaatgtcttgcctcactttgcaaaaatgggaacactttctacaaagtactgcatgatctggtcctgcctcgttggccttccttcagtatgtcaagcttatttctgccttaggagctttgctctgtctttctgcaatgcctttctccatactttcccatagctggatgaatcttctcattcagttctcagcttaaacatcactgctctagagacgactccccagccagacaaggtatcctcccagtcactatcacacagtctaatttaaattctaagttaatgtaaagtacttaccactatctgacatttttcttatatatctgtttcttactaatgtgcctggtacccatcagacactcagtaactatttgctgaatgaatagaaattatgaccactacataatacactgtttgataatatgaaccttatgactgagtttctcagcagatattagttattgacagcttcaaagccaatctctccttgatatatttaacttttcttaaataatatacagttttaaaatttaaataacttgcaacattcataaacatttatacaaagtatgattagtgcttatttgtaaggaaatactctaattttaatactttaatacatggaacacacttgagaaatatagaaatgcttcctacccaggatgccttaattaggcagacttatttaaacgtgcttatttttaaatttggcaaggttcacaaacattaattttgttacattgctgatactaataatagtatacatatcttaaataaaggtattatgtcattttcccgtaagactttgaagaaatagaactcctaagcatgagtgaaatcccccttacttgcctacagatttttctccactatgaatcgctcccaattcagatttcaaaattcagtatttaataacttcattacacatattatttaagctatctttaagtatgtgggtttttaaaaacattattatggtataatttacatagcataaaactcgcccactatacgtgtgcaaggcaatgatatttttgtaaatttatagagttgtgcagcatcaccacaacctggttttacgatattccaattacccaaaagttttcttgcatcctttagcagccactgttcaccacctccccaagcttcaagaaactactgattcgttgtcctcataattttgtcacatccaatcatttcataaaaatggaattttataataacaaatattagtattttgtgtctttttatcttcatttagcatgtttttatacatgtcaaaatattctgtgctattatggtgtcagtctattttattgctgaataatatctcattgtatggatgtaccaccacattttgtttaccattcatcaacctgctagggatttagactgtgtccagttttggggtattagaaacaatgctgctatgaccatctgtatgcaagtctttttttctggatatatatatttatttgtctgagatagatgatgtggagtggaatttccggattgtatggtacatttttgtaacattataagaaactgccaaactgttttccaaagcagttgcaccgttttatattccaacaagcaatgtgtgaggattccagtttctccacatcctcaccgtcattaagtattatctgtcttttgatactagccattttagtgggcagaaatgtcaacatagtgtaccggttaaaataacagattctgggccaaattgtgtaaattcatatcacaacttgccatcctgtaacttaacattcctgtctatagaatgaggacagtaataacacctgtcttagcctgtttgaacatgctataacaaaaatgccatagactgggtagcttcaataacaaacattcatttctcacagttttggaggctaggaagaccaagatcaaggtgtctggtgaagacttgcttccaggttaatagatggccatctttttgctgttttcaagtggcagaaagaataggggctctctggagtctcttgaataaaagcaccaatctcatttataagggcaccaccctctgacctatcaaacctttgacttaccaaaggcctatctcttaatactaccagattggggttagtattccaacatatacattttggggggacacaaacattcaatctataacaataactatctcacaggattactggaggtataaataaattattacaacttttagcttacaaaaggtgtgtctcatagtaaatttcacatacaagttaaccatgataatttttttattatcataatttgcaaagtgacaacatacttaacctggctgtggattatagttaggctttgggaagctgtttatgttctcttaatgatcgcttccttacatgatgtcagcttaagatagttaagatggttatcacaatgtccaggcactagaatgctaggtactgtgaaaatcaaatcacagattttaaatgacaattagaatggttaaaacttctaaatggtcagattgacctgccagactacttcagtcaaatacgggactttgaatgaatgattgaaccagtggtttattttactaataaaatgtacctgtccatggggataaaaaaggaaactgctgtaggtaagctgttttcctttacaaaattgtcaattgtttgaccataaggaccttcgtcctctgttttctttatcccatttatttgtttccttgtcttcttcctccttcacttgactacgtgggtgattaatggatcactgctgctttgaccaaggaataaatggagaaacggcaaaaggatgatattccccctctcgagttactaaaatgcccattttagacacttttctagaaaggcacatgtgccgtctgcttgtcaaatccctttctgattaatagctttagaagatgttttgcatgcatgcttgccagtttttaaagcacattactgaaagcatttcagagcacttctcctgggtttccagcaacaagcagggatcacttctccatgcttaggtcactgctgtactaatttctccaggttccagcaagccttgggggtaccaatagaattccctaacagcagccaaattttacttgagaccatccaacttagccttctgtattgcatcctgggagtgacttgatttaggttatgatatggtaaaactattataaaattgcacactattttcactcacctgtgtaccactcatagtcatatgaatataagattcaactatttatggattgtcaaggttttctccatttctgaaagtctctgtttctatgaaaatagcatggatagattctatctagttttaaaaagaagtaggccaatgaataaaagatatatgaaggcacatcctccaaaataaggcagaaattgtgtataactttatgaatattcaaccacgttggataatcacaagtgtagaagagagtaatatagtggattaagtgccatactgggccaaaccacagggtgttgaagaagctttcaccaggtgataaaatccagaaggactgggtagtggactctccagaaggatgaacttcaaccaatgcatgacagaaggcagaagggaatagaagatacatttcctctccattttttcctgtgatggattaccccaaggcattgctttctagctagtctatctggagttgttccacgtggccagttggctgtcttgtctcactgaagcttgtgaagcagtggctaactcagtaatgcattaccttgtattcaagtctcatctttctctgtctcatttccatcttcttttactcttgctaccctagaattttatctcccaacaaaacattaacacttgaccctttccttgggttctgctttctaccaccctgagctaagatacatactagtcaaaagctagaatagagggctgtacattttattttaaaatttggcataaatgcataaaactactagcagactggatgatgatgatggctgatgatgataattaatagcttgcatctgtggtacacatactttgcttcagatactgtatgaggtgctttgcatatggttgtgaatcctcacaaccatactacgaggtaggtagtattattatctccactttacagataacaaaattgaagtataaaatgttcacacgtctagtaagcccaaggtcatatagctaatgagcaacagagctgggatttcaacccaaacaatttgatgcattttcatttgggttgaagcattcatgaataaggtggagttctcagtgacttcctgttcttatttggtgattctgagactgatatcactacctgtccagtagcttctggaaaaggtcatctgagtccttgccatattatttatgattacaatagcgtctctagagagccgaagtccactttctttcaagaatgtatggttgttgaggcatctgattctctacctcccaggctattcaaattgtatgttcaaaaggaggcaatgaaaaacacacacttagttcaactaaaatctctcatacctttccttgtagtagaggtttatgaaaggtctacgttattttatatttaactgagggcacttgtagtttcatccttgaatcatttttacccaccatcacatagtgcataccacattcctcctgcgcacaaacaggcacgcccatgcttaggcccatgacactccatcacgtgactggcgctaaaatataaacgttcccattttgtgtggtataagatacttgtgactgaaagtgacctaagcattctttttgcctttctgttgctctatttaaaataatgactacagactctctttcaacaaagggtcatttgtgtcaatggacagaagagaggatcagatcacctgcggtaattgcaaattaatgttctcctggtaatgcactaactacacactattgatctacaattgaatactagaggctactgataagtgatttttactttcctgcttttttgtgtgtgcttttattgctttttccataatgcatttttctttcaactggaattttctctaattgtctccatttttaatttcccacagtgagatgacttctaacttgtaattagaatctgtaaaaattcatgtctctgtctcaaaagccttttagaaatctactgaactgtaactttgatgccataaaccacatatatgatgcacagatacatagtttgagagagccaagctttcgaattttttttttattaatactcagataaaacagaaatccatttggccctctatccaaaatagcaatttgttgagtagtctgcagtaaaacattcaaaagtttcccctaaaagcattttacttggagaacattgatgacgtgtttttctttccaagagcaaacttttaaaatatgagtaaacggtttattacaagataatttttatttttaagtgtgtgagagaagcggggcacagtggctcacacctgtaatcccagtactttgggaggccgaggcaggcaaatcacttgaggtcaggagttcgagaccagcctggccaacatggtgaaacccgtatctactaaaaatacaaaaattatagccagatgtggtggcgggcacctgtagtcccacctactcagaagactgaggcaggagaattgtttgaacctgggaggcagaggttgcagtgacttgagatcacgccactgcaccccagcctgggtgacagagcgacactcgtctcaaacaacaacaacaaaaaagtgtttgagaagaggatgcagatttccaattgagtaaatatttatacacatcttcacagcatacttttgacaatgttaaattttctcatgtttgtgtcaaaaccttaattgaggatctggcaccgtggctcatgcctgtaatcccagcactttgggaggccgaggtgagtggatcacctgaggtcaggagttcgagaccagcctgaccaagatggtgaaactccgtctctactaaaaacacaaaaattagctggacatggtggtgggtgcctgtaatcccaagtacttgggaggctgaggcaggagaatcgcttgaacacgggaggcggaggttgcagtgagccgagatcatgccactgcactccagcctcggcgacagagcaagactctgtctcaaaaaacaaacaaacaaaaacaaaaaacacgttaattgataataattattctatctggtggaaattaacacacgtttgtatttcagtgttgtacttgatcatgctccctgtttagacagaggtcattcatcctaaatctggtttctgaactgtggtctagaaatcacctgaaatggagagatagtctgacagtaatttccttcactactatttgtaaactttaagcttatcattgattttctgtatttctaaataagagacatagttgtgatttctaagtgttttcaggcctgtaagaactttgatattttactgtaatttcttttacaatcattatttgcagctagtcacaattaaataccatcaaaataaatgtgtgcccaaattgtttgcttattttttattcctaagtcatgattatctgtaccaaaaaaaaaaaaaagtaataactgtcaaccgcatggctagaattatataagtctggtactctttcttttatcagtttataactagagacagatacaattacagttgatattcattttacaagcagtcttagggctggaccagagtgctgatggctccctgatgtgccaatcattgttggataatgaaaagcggggcaacaccagggtggctggagcaggagggagatactcggaggactgagactctgaattgtgatactcgctttatcatattaaatatcatttctgtcttattacaatccaatgagataggtactataacttccattttatagataaataaaccaaggtttatagaggttaaataattagcccaaatttatccagctagtaaatgttgagcaaagtattataaaacttcaaagctccttctcttaactaccatagtatacatgacaacagaaccacatctgtatacataatgatagcacacaaatactgtaaagaatcttcaagcttaggatgaactgagatttttgaaaaatgttaaaactaacaacagggttacattacaatatacattaaaagtccagagttcactatgaatccatgtaacaaaactgcacttgtaatccttaaatttacacaaagaaaaaaatgaatgcattaagaatgaggaaactgaatgtactgatttatgaagaaaaaacaaaaaatgaccaaaaacatacttggtattaggtatatacaggtataaggtagagcaattcagctttaatttcatctcactaataagagctacccatccgcctttatacagaggttctcagagcttggttatatttttggtctagagctggagtcattcccgtctagctactgtctaacattgtcttcctcccttttcctcttttctgttctgcctcagcctttagacatcctagatcaaacccaaaaagtcaataaataaatcctcaaattttctaatcttggacgatggttaggaatgggaccttttcaaatctactccataagcaataaactcagaagaaatcagaagtacatcaacacaaggaaaaaaggaaaacaagaataaaataatgatatgccaaatcaaaagtgatgagtgggctttctgagaagaagataacatcagagggtctagtttgttgtgaacacattgaaaatatggtgaccaaacatgagactaattgtaaataggcctatataaacatgagtgtaggtgttaggaggataagagattttaaagtttggtttgttagtactgcaaagagaaattgccttttgaaaaggcaaaggtgcctaaaaaattaaaggtaccagtctgaaaaaagcccagaaaaatctaaatttgttttgaaccctttagaagaaagatagtaatcatcaggtagagagagaagtcctttaaaaaggagagtggccataacccatgagtttcattttataataagcttataattcagtgttatttagaaaatgtaatgaagaaaagttataaagaattgggacagtacacacaaagcaaaacagtggggtacaaaactgaatgtcatgaatggaaactcttagagaggtagatgcttttgagggaccaactgtgaaatgtatttttgtggtctgtattttcattttttgttgcaagataaatagagtggcaaaatctattctcatctgaacccttgggaaaatttttaaatatattaagcacatgatagaactgaatgattctggaaagagatgtgtgttagtctgatttttgcattaatatttaataatgttttcccttgtatagaaagttaatgatgatgtcctaccattaacagaacatgtgctttggagacacgtttcctctagaagtgatgaatttgagttgataaaggcacatttttggggcctgtcacccttgagagtagtaaaaattatttataagcagctaaccaagggtgaaggaggcaaaaagtagccctagaagagaggagaattaaaattatgaaggataaaaaccattatttaaaaatgaacaagatgccatggaagtacaaagtagaaaaggcctactgagcattcactccaggatctgaggaaagcgacagctggtgtggtgttggcctgtgaaaatgtaaagaccttgccactctttggagacacttcactcctcaagtgcagaataacatctaaaatcgttatcatgacctgaagtactccacaagattcatctctgcctatgtctttctcttcatttcctatcattctcacctctgttcagtatgtcttgccatgcctgaaataggccatatttgctcacttgtataactacgccttgatatttatactgttgctctttctctggccaggaggacactcttctctcggggtctctgaatggctcaattattttatcattgctatggtttgaatgtcccctccaaaactcatgttgaaactcaatctccaatgtggcagtattgagaggtggggtctgtaagaggtgattggatcatgacagctctgcccttatgaatggattattccattcacagattaatgcactatcatgggagtgggattcatggctttatacgaagagaaagaaagacctgaactagcgcattagcaagcacaggcccctcatcatgtgatgtcctgccccacctcaggactctccagagagtctctgccagcaagaaaactcacaccagatgcagcccctcaaccttggacctctcagcatccataactgtaagaaatacattccctttctttaaaaattgcccagctttgagtattctaagtaacagaaaatggactaagacatcactcttgtgagggagcttctagcatgcaagcttcctgagggcaggtctcaggtgtctgagaatatccttgtatccttgatgcttgagctctgcctgggatatagtggggctcattcagtgataaagatgccattttatgatagttcattgaggacattattttcattttcctagataccacatttcaaatgtaactaagataaactttttaaaagaagctatactgtttatcttactgtcaattatatccctctatggtttttccacaaaatcttctctttgccatggttgtctccacttcagatgtatacttaagtttttgtacccaagaatagaaccttacttttgtcactaattaactgtgtcttctcatattagatcaatcacacatgcatcttctgatttttctgagtctactttgtgatttactctttaccccaagtttactccaaatttcatgttatccaaaaatgtgatcaaatggatttctgtgcttcccccaagtagagcccaggagccccagagtagccagtcttctagaaatctcaaagttttctttactcagcacgtggaaagaatgttcagaattcaaaataattttggaaactgaagaagtcagggataaattacttaataaagacaaaaacaaatatctcacttataaaattatatgattgggtataaacaaactactcacagatagagctcaagaactaagaagaatcagcaattaataagtgaaagagcaagctttcacacgtttattattttgaattcctctttcattttgctagcacatttcttgagtacagtaacagggagggtgggggatgcagagacaaattatagaatagaaatcaggtaacatggttcctagtcctactggaaagtcaactgataaaatgaacccaaggaaattacaaactgtgaatatgcaaatctataaatggggttaaaaatgcttattgatatacccacagcttcataagaattatataaattaacatatggaaaaggctttttgaaaaaatagaagataatattcaatagatcattaatactctttataatatattttgctatggtctaagagctctctaaattcccagtacagtccaggttttctagatctctaacttagtaccaaagtctataaaacattgaaaaaattttaaaacaaatatcaaagtgtatacatcaaaatgaagtggtcttttcaaaataatcacctgggaagatgttcgcactactcagaacaattttggaacatttctctgtaaactggtaattaaaatcaatttatgaactaacagaaaaaagactcatgactttggatacctaattcactcaacaaccaactttgttcattcatcttggctctctttagctttttaaaatgggaatgaaatccattcccaatatataaagagtagttactacattacctccccaaataactatttctaatagtcatttggatgaacaagacacagttattaaaaaatcagttacccatccaatcacaactcatttcaagtgacactgataaaccagaaatagaggaaaggaacaaagatatacaatgtttagaaagtaatatgtgaaataagaatatctaaacaactgagattttctttcaaaatgaagaataaaaatagtagtttaagactttggtcaagcatatgaagactctttgaaaaagaagtcagaccgttaattagtcacatctctgcatacaattcaaataggaacggacagtagaaaggatttgtcagggacaagaaaaaatttaggcaaggacatttatataaggtgaggaattttctgtagctatacgcctgcaaacatcttagctaactcatgattattctctaacttgaaatagtcattgtgcaatgctattatttttttctatagtaaaactgtctttcaaaaatattagcttgagtttcaattaatttctcttgaatctagatgttaatctttctatcaagtggagaatgtgtagtcactcaaagacgtaataagtttccatttaatttattctctttgcttataaacaacatttgttgcactagaatcaagatgctttttaaatatgaaaacctcttgaaaataacctttcattaaagtaatttaaaataatgtgataactgacacagcaattagaacatcattgaatggataaactaaaagcatttttttcttatatattattgtgagaatattgagtttccatttttaaaaatatctacttacatattattcttaaagttgtaagtgaaacattcattaaagccaggacacaagaaattgcataatggaaagaaaaaatatttctcttttaaccagttatgtgaaatagttctgattccatttaaaataattttgaatgctgtcaagtatttttactacatttgttaccctctggcctgaaactgaatgatgatgaaataaaaaattagaagttattgaataaatattttccacctacccaatgaaaatttgtaatatagggtgcaaaatttttatcacctaaagacacccgtcagtaaagttgaagcaatgaagcctctgtgtatattatgaccaagagataatatgggtaatgcatccatctgcactcaagtggaaacagtgtcatcgtgctgcttcaattacttctttttctctaattttaataaaataatacatttcctgatcacattaaaaaattccatttagcttgaactagctccatcagagcagctttgattattgttaaaaattgatttggttatctgagttcagcgagtggccgtcatgtgaccatgactttccacagcaaatgcccactatgcttcatctttccgttatatttcaggattttctattaactttagtgacaaacccacgcagaaaagatagaattaaacacacacacacacacacacacacacacacaaacacacacacatccatacaatctcaatgaaggcacaggtcataattgtttgtgaattaactgataagttttgactttctgaatcaaagtccttaaggtaatgaattgtaatggcagtatcattaaattaaattaaattatagaaacctacagtcattcagtgaaaaaagtcatatagtatgtatattttttatctatagaggaaggtgaacattttataatgaaacctatcactgaaagcaactgactcagtctgagctttggttgtaatacaaatccctaaatagtttttcaacagaaattatagtctagtacttgaatactagaaagaagatacaggactcattgggaagataagatctgggactaacagtgaaatcaaaacttaaaaaagccaatgttaatttattaaagttctcccttcaaactgttttgaaggtgaattactagttatttatttatttttctcttcatgaagaaataattggcagtcagaagcaaacttctttttttcagagtagccctcaaaaagatttcaagacctcaagagtttatgaataatttgagaatataatttaacaggaaggtttttataaatatcagtacctgaaatttactgataattttcatctgtccttttcatatttctaatttgcatattctaactaatgaaatcctgtcaaataagattaaaaaatcagggatttcaaagacactgaagttcacttaaataaattagaagtcagttgggttgactgaagaacttataagagcatttacccaggaaggcaagcctgtaatcggttttgaatcttatttctaggccacggtgttacatctggttctgttgtaatagtcattttcactccaaagttgtactaggaaaatgatctggagtacccagattactctctagctaattccttagtttttatattcaggattcattgaagcattttatccattttaaaattatacagatttaagtgtactgcatgatgttttgttatacatatacacactcaaatgatcactacagtcaagccaattaacacatctctcattttacacagcaacattttttttctggtggtaagagtgtctaaaatctactctcttagcaaatatctagtataaaatacaatattattaactagattacttgtgctgtgctttagatctccagacttactcatctgacatgactgcaattttgtatccttgaactgcatctctttgtaaccttcctacttcatgcacccacatatgataactacagttctactctctaagtagtcaactttttttttttttagattccacatataagagagatcatacaacattttcctttctgtgtttggcttatttcatttggcatagtattctctaggttcatttattttgacacaaatggcaggatcttttttacagctgaacaaaactccattgcgtatatatgctgcaatttcttcatcattcatctattgatagacacttaaggttgcttccatatcttggctattgtgaataatactgcacagaatatgggagtacagatctatctaactatctgtctgtctgtctatctatctatctatctatctatctatctatctatctatctatctatctatctgtctatcatctatctatatgtagtgctgatttcatttcctttggggatttacccagaagaaggatcgctaggtcacatcgtagttctgtttttaattttttgaggaacctccatattgttttccataatggctgcaccaatttacattttccccaacaatgaacaaaagttgccctttctttacaccctcatcaacatttgctatttttatcttgtttgataatagttattctaacaggtgtaagataatatctcattgtagttttgatttgcattttcctgaagatcagtgatgttaagcatctattcaaatatctgtgccatttatgtctcctttggtccattatttactcaggttctttactcaaagatatttactcgggttctttattcaaagaatattaacgtctacactcaagacacataactctcattcatttttctatgatttcacattttttttcttcaaagatcctgagtaaaaaattttgaaatcaggttgttttttttttttttttgcttttgaattgtgagagctccttatatattttaaatattaaccccttaaaagacatatggtttgaaaatatttttccaaatccataggaagtcttttcatcttgttgattgcttccttttttgtatagaagttttcagtttgatgtagtcctacttgtttatttttcttttgttgcatgtcctttgatgtcctattcaaacaatcatagccaaggccaatgtctaggagcttttcccctgtgttttcttccaggagttttatgatttcaggtcttatgtttaagtctttaattcattttgagtttgagtttcagctgagcccagtattacgctgaagccaaacccagaaaagggtactataggaaaaaaagtataggccgtatctctgataaacatggttgcaaaaatcttcaccaaagtaataacaaactgaattcaacagcacattaaaagaatcattcaccatgatcaaatagcagtcatcttagagatgtgagaatgattaaacctatgcaaaccaataaatataacaacacattaagagaatgaatcacaaaaaccatacgataatcttaatagatgcagaaaaatcatccgacaaaattgaacatctttcttaataaaaactctcaaaaaattagatatacagggaatgtacttcagtacagtaaaggccatatatcacaagcatgcagctaacatcacagtcaatagtgaaaagttgaaagcttttcttctaatattaagaacaagacaaggatgcccactctcctcatttttactccacatagtactggaagccctagccagattaattaggaagaaaaagaaataaaagcacccaaatcagaaagaaaaagttaaatagactctgtagataccatattatatgtaggaaactcggaagcctccaccaaaaaacagaacagttagaataaatgtattcaataaagctgcaggatacaaaattcacatgcaaaaattagtgatgtttctataaattaacaaaaaattatccaaaaaagaaatcaaagagttaatctcacttacagtagcataaaaataaacacttagcgataaatttaaccaaggaggtgaaagacctgtatactgaaaattataaaacatgaattaaagaaattgaagaaagcacaagtaagtgataagataccctatgttcaaggactggaagaatcaatagtgttaaaatatccatactatccaaagcaatctaaatattcaatagaatccctacaaacattccactggcatttttcataaaaaaaatcactgaagagttttttaaggtaagatgattggatgatttaccattgaaatgttgacatcttgtcaaagcatgttacagaataagatcatagaaataaacagtgccacggagaaatgatacattccaagaaaattcgctcaaaaattttgaagcaaattttgctatgaaaagcaataattgggctgggcatggtggctcactcctttaatcccagtcttttgggaggctgagtgggtggatcacaaggtcagaagatcgagaccatcctggccaacatgttgaaaccccgtctttacaaaaaatacaaaaattagctggatgtggtggcacgcacttgtaatcccagctctactcgggaggctgaggcaggaaaatggcttgaatctgggaggtggagattgcagtgagccgagatcgtgccacggccactgcgctccagcctggcaacagagtgagactctatctcaaaaaaaaaaaaaaaaaaaaaaaaaagaaagaaagaaaaaagaaagaaagaaaagcaataattgcccaataaaatgtaatctgaaaccctaagagacatttcagtttatcaactgtgaggtggaccctatttagctgatgtgattactatgcattgcatgcttatattaaaatagctcacataacctataaatatgtacacctactatgtacccacaaaaattttaagaagtttaaaaaaagtatatgccctttactgatcaattacattatactaaaatatattataaaataattagagataaatgcaatttggttttctcagcactgcttaaactagtagtgaagaagaacccatataatggattttataaataaatttcagtgcatttataatatgggataatatgtgaccactgaaggtagcactatataccgaagtatgttgagatgcaaaatgtattttggtatatcaagtgataataaggttcagtttgattatacatatgaaaataaataaataaaaataaactgtgaggtgatatacaatattttgtgaacttacatttaattcctcaattagcaaaaatttaagcaaatgatgctgtaacctaggttttttcttcaataaaaattttctaggatttacaaccatcattttttaataaaaatattatctttacaatgaagtctgtttttttcccacagcacttatcttatgttaaatataatacacttacatttaacatttattgtatatttttctgtctctgctcacaagaatgtaagcccaataaggtaacagactttagttgtttttttttttaattcacagaaatactctaaatttctacaacaatgctaagaatatatagtagggtctcaatacatatttattaaaaaatgaatgaatgaattattctctgtgatgcatataaagcaataaagaaggtatgcgctatcacacttatgcaacttatgaaaaaaattagctttccattcttgaaatgtcattactcttcttaatgtcagtcatatggcttaatttacaaacatagattcatttggaacagattttgaaattactaatttgagtgtaaatctttattttagcagtgaactcacttaattacataagattttgaaattactaatttgagtgtaaatcttaattttagtagggcactcacttatctacatagtctatacacatgatgaatagtgtatgagaaaaatcagaatcaaaatatttatttatattactatttctacacccattacaggacttctatttctatactctagtgtatcagcaccataacctagatatttaaatcaatttcatttgtctggttatacctgctataaagaattcattttgttggtacacatttcacttgtgaatagaaatcattagaaaggtggatttaataaatattgtaaaaccagagaacagaattcggttgggcaatgagaggcaatgaaaggatgatatgagagaaatgggaggatgatgatcaagaggctaagggctttgagctgtatgaaaaagattcgaactaactgcaagaaagaatttgaggctgggtgcggtggctcatgcctgtctgtaatcccagcactttgggaggccgaggtgggcggatcacgaggtcaggagattgagaccatcctggctaacatagtgaaaccctgtctctactaaaaatacacacacaaaaaaattagccgggcatggtggcgggcacctgtggtcccagctacttgggaggctgaggcaggagaatggtgtgaacccgggaggcggagcttgctgtgagctgagattgcgtcactgcactccagcctgggcaacagtgcgagactccttctcaaaaaaaaaaaaaaaagaaaaaaaaaaaagaatttgatgggaagtaaaaaaaaaaaaagacgaataaaaagaaatactgactagtacccaagccccagcagacattaaacactatgtatttggagtaagcccaattgcagagttacattaatttctctaataatattcaacagcttaaaactatactgaacgaaaggttaggttaacccaagattagggagtggaatgaagtgaaattcagttagaatggaagaaagatggaaatatatattctctaccctccactgaactaccaaactaaaattataaattcaaatatttcccaccttatgaccatcctaagtatatatatatatatatatatatatatatatatatatatatatactgattttaattcatactttagctaatattggttaaaaaaacatgttctggctgagttaaaaatctgactcaagctaatggcagagctgaaaaataatctttaaatttctacagattagattgccagctctctgggcaataaattctcctaggtattttttagctgaaattgtcttgatttcctcttcatttctgaagtaaaaacctatgtgtgaaactttacatttttaacaaaatcatttgggaaccaatattttaatagccagaaagtctctgggctattcccagctagagctaaagagataatgatttcttttataccatgtgaatccttgtatcccctcttcacaattctggtaaaaacaaaacaaaacaaaaaacccataaccaagcacattcatttaacaaactcattcaaccaaaatttactatatttctgttacacaccaagcagtcaatacatggggtaaccaatagcttatgatggggcctggcataaaaagataaatttaggcaaacagatttcctctcttagcagtctgagctgtacacaaaggaatataaatcatcccattataaagacacatgcatatgtatgttcactgcagcactattcacaatagcaaagacatggaatcaacctaaattcccatcaatgatagactggataaagaaaatgtggtacatgtacaccatggaatactattcagccataaaaaggaatgagatcatgtcatttgcagggacctggagggagctggaggccattatccttagcaaggtaatacaggaacggacaaccaaatactgcatgttctcacttagaagtggaaactaaattatgagaacacatgaacacatagaggggaatgacacacactggggcctatgagagggtgaaggatgggaggagggagaggatcaagaaaaataatgagtactaggcttaatacttgggtgataaaataatctctataacaaaccacatgaaaaaagtttacctatgtagcaaacctgcacacgtaccctgaacttaaaataaaagtttaaaaaaagaaatccaagccaatagacagtaagctattgggacatttcatggagaaatgagagctaaaaggctgcaatgtggcgtgggtctaagggtcatgacagccatgtgatagaagttcagaggaggcaagagtaagccatggagagaacaagagtggacagaaatttagtttcttctgaagaagaaatcacatggctcacaaaagagagatggcaaaggtcttgccccaggactgtcccactggttcttgcagttccagttccagggtcctttcatgtccagaatacaataggcttcatgtgcatagtcagtgagtttctgattttccatctaagaggagcctaagtagaaactgacatttgaataattatttcaccattcatttctatgaggacacatagtactctatgtatatttacatactaggatctgcaccctgagcacacatctacacccaggacacataactctcgtttagttttctatgatttcacttttcttctcttcatagaaacttgactctaagaggtaagctatagcctgaacatgtaagctttgagtgggcatggaagacttgcgtattactaatattcccgtcttacaggtcctgtgatggaagacaggcaatatgcccagttggaagagtatttgctttgtggctgtgaaactctagatgggaattctggctccattgctagtcatgtgactgctattaaagacacacctaagactgggtaatttataaaggaaagaggtctaattgactcacagttccacatggctggggaagcctcacaatcatgtggaaggcaaatggtgagcaaagtctcgtcttacatggcggcaggcaagagagcatgtgcaggggaactcccctttataaaaccaccagatctagtgagacttactcactgtcaggaaagcacaggaaagacctgcccccatgatttaactacctcccaccaggtccctcccacaacatatggggattattacaattcaaggtgagatttgaattgtaatctcacacagagccaagccatatcaatcacttttatcctccaagccttagttgatgtcaataaaaaaaaatatttaaaaatttcactctcaagtaggttgtggaaatactatatgtagcagcaattactaccagcacatggtagacagtcaataatctttacttccatgtgtgacttgcccatggtcacatctgacaatgagcaagagtctcttctgaaacccactcataactccattgtatccttcagctcaggtatttctacatgtggatgaaaataaattcaggtgatactcaagcctggatactgttatcttccagattctttttgaagacactgctccatattcttcctttcttcttgatatcctaaggtgccttcttttatcattttctttcttctgaaaaagctttctttagccattcttttggttaaggattcctggcaatacattctcttagtttttcttcagccgagaatgtcttgatttctggctcatttctgaaggatacaggattttgagctgacagttcttgttttagcatttgaaaaatgtcccactttcttccagactccatggcttgtgatgagaaatcccctgttattagaattgtttgtccccaataagtaaggtgtcatcttcctcttgctgttatcgaggttttatctttttcttcagttttcagaaatttgaatatgatggattttggtatggatttctttgaagctgccctctttggaagtctaccttgacctcttgaatctacaggtttatgtcttttgcaaaaattggaatatttttagccattattttttttccattcctgcctttttcacctctcctctgggactctgaggacattagtgttacatcttttgttatagtcccacagttccctgagggctgttttcattcttttcttcagtctttttttctctctgtttttcatattggccaatttctattgccaatttctattgctctatcttctagttcactgattttttcttctgttctcttattttactattgagcacatcagctgagttttatatttaagtgattgcatttttaagtccaaaattttcatctttatatcttctatttctttgatgagactttctgttgtttcatttgtttcaatcatacttgtagttgcttgttaatgcaattttataatggaggcttaaaatatctgacagataattatagtatctctgtcatgttaatgtgggcatctatcaattcttttttatgatccagcctgaggttttcctgggtcttggtatcatgagtaatttttaattgaaatcttgacaattttggtataatattaagagactcttgattttatttaaactttgtttctgctagctttccttggtgtcagtctggcaggggaagtggagaatgccacctccttaatgccagatagaagcccaggtatcttacttggctttcttggacacccgaggggcatggctcctggttactgctgggaggaggtgagaattctggctctccagtaagcctgcactgacacatccctggctaagagatgcaggcacgccttgttgctgctccctacttggccttcactgacaccataagaaggaggaaaggagagtggccttattaccacacggtgatgatgaaggtcctgactctgcactagacctcctctactactactgcagaaggggggaggacggacacctcattactctcaggtgagggtagaagtccaggcttctgatatgggatgggggtgagggctcatttttgcccagtggggatgtgagactgcttggtgagggtggacgtctaagatccctacttgtcctttgcttgcatggatgggtgtagggatggaatatttatccgtggtgttgggtggagcagggaagttatgtctaaaagttctctctcttgctagactgcccctttcctggttctttggctagagagagcaggcttttcatctgtgcctattgttgtttctgggctgttgagcttctttggctccaagtgtgagatgagatatgtgaggaaaaaaatcgcaggaaactcaccactgtgttgtttctcgggtcttgagatccctagccaatctgccttctcttcacctttcagtcttcttatatcatcagttttacatataagggtttttagctgtatacagtgggaggcacagagaaaagtaaatctattccatcttcttggaagcagaagtctgcctccattagctttctaatacatattatttccaccatagattgtaggtatttcatagaacaatgttaattctgattgtcaagttagcaacatgaactatttacactctacccttttgccagagaatatgtgatgccaaactttctgctttccaattaccatcaatgctaagtagtgagaagtcattattaatggagtattaccagagagttcacagttcacagtctagtcatataaaaagcttggtccctaggtcaattcagactacaaaacctgaatgagaaattcttatgctaaaatgtgctgacagtactaagcccatgttgagcaacattatttttaaaaagtatatgaatactttttaatgttctaatttttattattttaggggtattattaagagtacaattcactacatctcacagcatccctttaagaggacaagggaagaaagaagttccctcagctttgtaccacaagaagctgaacaatcaatttattttaatattttaaaagttataaagctaataatttatttctttggctgccaggaatctcaggatcaaatttggtaatgacatagattttcatacccttgatttcattttgtttttcaattgagattttacttttactcagatttcctcatgtattgtttttccaggaggacagtactcattttggtacctgatcttatttatttcaggatcacatgggtgaataaatgtattaagaaaagacagtgggttcgtaagccctcaacaggacaggaaataaacctcaggtctcttcataacttgtcagaggaacttaatacatgctgccattttgatcccaaatggcctccttttcaagaggcccaaaaacgaatctattttttttttgtcacataacttacattgcatttgtgagatggagatttttaaaagggacagacaaacacaatgactacctggaggacggaagcaccactatggagaaactgaagaccactttcagcagagtcaattccaccagtagccaaaatgggaaatccaggcagagcacgagcaatggaggtcacagctctcaaagcaataggtctgattgctgtccctacacaaaatcagaataatcaatggttagcacactgaccacttgagtatactgtcttatattacttctattactatgatgtgatgacagcgtcactggacaaatttcaaattactttatctctgtttaagatgtatatacatatgtagtgtataaatgttatgttttaaagcatgttaatttgttaatggatgtttatttattttaaggactttgataccaatattgaatttagacatgttatacaagtaggtatagcaaacacagaattctctgtgcacacatattacatgcatattacaattggatatacagtaatgtgtaaaagattgcatagaatatttgagcatcagtggctcacgcctgtaatcctagcactttgggaggccgaggtgggtggatcacctgaggtcaggagtttgagactagcctggccaacatggtgaaatcccatggctactaaaaatacaaaaataaacattaaccaggcgtggtggcaggctcctgtaatcccagctacttgggaggctgaggcaggaaaactgcttgaatccacgaggcggaggttgcagtgagccgagatcacaccattgcactccagcctgggtgacagagtgagactctgtctcaaaaacaaacaaacaaacaaaaaacaaggaacagcagattttgaaaagaaaaacaatcccatatagtacatcagtagacatacagctatgttatgtttctttagagtacaaagcagatgttgcgaacatagactctgtaaaaaaaggcaaggtgctgatgaacttacagattccatgttgctttttatatgtacttcccacaatttgaaaaaaaatagggagtctaatccaatttttcacatattagaaagttttaatcaagttaaagagaatttactagaatccagtaattagagtgtatgaatttaattttttaatatttaattagccagacattaccagtatattattccctaatagtaataaaaattgtatggatagaaagaatactttggggctattttaaaaatgagtatattgtactaaagctactttgaattctcaaatgttaaacatcccagagtacattaatgctttcataataaaggaatataatttgatattcctggtgttcccttataagtcaggggtcctttaagcattttctgaactaaaggcagttcaacttatgcaagaatttgacactgccttaaaccagggcttcacaaacaacataaacaaataactggttcagcctcacgtggtgagttctttgtcatcacctccaccaccactagtcaccagcaatatcaatatgtatttactggagtgcttactctgaggtagcacacacagccttcctttaaaaaatggccagaacttaaaattaaattaaattaaaaaataaaataaaataattaaataagaaaagaaacaaaaagttaaagggctttcaatttgaaaaggctagatagcatatgattccaactatatgacattctggaaaaggaaaaactgtggagacagtgaaaatatcagtggtagtaaggagcgaacgggagggataaataggcagagcaaagaggatttttaggacagtgaaaatactatatatactataatggtggatgcatgttgttatacatttacacacacacacacaaaacacacttagagaatgtatctgttacactcatagaatgcccaacaccaagtgtgaaacctattgtaaagttcggactttgggtggttaggctataggtgtcaatgcacgttcatggattacaacaaatgtatcactctagtggggaatgttgataatgagggaggtcatgcatgtgttggagcagtggatatattgagtatctctgtatcttcctctcaattttgctgtgaatctaaactgctctaaaaaataaagtctaaaacagaggctgggagtggtggctcacgcctataatcctagcactttgggaggccgaggcagagggatcacctgaggtcagaagtttgagaccagcctggccaacagtttgagaccagcctggccaacatggtaaaaccccgtgtctacaaacaaatacaaaaattatctggacttggtggcgggcgcctgtaatcccagctacccaggaggctgaggcaggagaattgctggaacccaggaggtggaggctgcagtgagccgagattgcgccattgccctccagcctgggcaacaagagcaagattctgtctcaaaaaaaaaaaaaaaaaaaaaaaaaaaaaaatcggtggctttctttttatcctgttcatatctgtttcagataaaattgaacgtttgcatgactactgcttttgtactcaacacaaaaatgtttgtggaaatgtctacttgtggctcccacacctcaaacatcttcctctacatattactatagcattccttagttaggaatattcaatgctgacacttcaaaattcataatagacattttggatacaaagtattaagttgggcaaattagaaaccggacattaagattctacttctatattatttatcagtgattcctcacagtttttatgttttaaccataaaaaggctaatagtggacagaatttatagtgagaatacaaaaacacacatatatatacacatatcttcagttatactaaaagaaatctacataacaaaagttaaaggaaagcattttttaaggaaagctgtaacaaactttttgatagacacacagctatctctgcataatataactggcatagccaatacataccaacccaatggcttctttacatacacactactttgaagtaataaagaaatattggtttttttcctcccttatttagttgacccaagagagtaaatttgagctaagtagataaataatttatttctacctccactgttagaagactatcattaacagtaaggggtaaaatttcaaagtggtatacagggatttggccacatattctattgatattaatggacataaaaaggcaacacagctttgaaaaattaaccagtgacacttaaagggcaacattattacacaggtgttaaaaaaatcagcaaattcttattggcatttgaagatgttcaattaggtcaataagacattttccaatttatgcttttcttcctttctaacgcttttataatgtacctaatgaacagaaaatcttttcaaaaaataagagtattttttcaagttaagagtaactatgttctctgaggaaatgagatccaaaaaatgaagaaatgatctctctgttgctggactacagtaaattcagtttttatttccattataaacccagtttgattttttataactcaactgatttaatacaaaatataatctacctgttctcagcatttttatggggaatagttcttaagaatgacttcatccactaagaacggtttctagaaggaaaatgaaggtatataaaaagatctttctaaattgctatgtagaatttatttttagttttaaaatgacagaaatgaagtaataataggttcaagataaaaataaaactgttggtttaaagaaaatacatatatcaatgccatacaaaattgtacatatgccaattaaaatcataaagacttcctgaattacaattatcgagataaaggtcttttaaaattttgtcactgctacagtgattaatgattttagaccaaagactagggaggaagaagccagtgtgagaagttcaaagaatgtgtatgcgggctctatctttaaggaaacaacaaggtttaaatcaagaaattgaaatcctatacacttaattgaactaacaggtaacatgcaatttaaattaagccctcatctacatggggtggccagatgaacctaatggggaattcagttacatcaagccattctgcttcaactgtgtggaatcctccaataaaaatcaagccattctgagttcccacgttttgaaacaagctgcaggttcgaacaaacaaacgaaaaatgaactggacttatgagttgcaacattgctaccaagaactttgctttgcattatgtggctcttgtggtggactagactgaactgtaacttttggtcaataatcattctaggccctccatgtagtcataatttaaaatacaaatcagtgtgttgaattcatagattgtcttagataaactacacagaacattcttgaattgattcatgtttcagaaaaacattttagtaagccagagattttgaattaagttaatcaatctgattttgatgaaaagtatttttcttaagaaaatgaactctcatttgtcagatatcattttaaatacaatttcagaaatgctatcattggctataatattatatattgatatatgtgtattaatgtattatgacaatcaggttccttactcagtcttcatttatccattcatctgtctatccacaaaatattttttaagcacctatggctttttttttcctggttcatcagtttgtgtcctaactatatatctacgcttgactcacaaaacaccaggtcttatcattgtagtaggttatttcaagttaataatttgaatccagttattcattctctaccagtattccattagaaacaattcacatttgttagaacattatacattttataaatactattaatatgaattctatcaagaaggcaatttgaggatgaactagttaccaacatcagagagacaactgggccaactgttgaggttcaaatcttagttccatttataagctgtgtgactttgtgaaaatttttaaatcccaccgaatctcaattttgtcatctataaaataataaaaattgtaataacgtcttcatagagctgttttgaagaataaattacataatatatataaaaggcgaggacataataaaaattgtagaagtgtttgctgttataatttgtactgccctcaaggacaattgatttcagagtgagcatttatgtagtttactttgacattgccttctatgttcttgtgtgtttagtgatgcaattaaaaccaatttttaaattggagacaaaagcatgatgcctatgatgacagaactttatcctctgaaaccttaagaggaccatacatgtcccctcctttttctcttttcctaacagctgtcatttagcagtgtcataatgttgatgaagattactttgaccccaaaggaaaaaaagcctcaaaaggctgacatcaatatatttaagattttttttttttgagaagcaaaatgtccatggattttaattacaatatctgaactcaagtttattggtgaaaaggaggcagagatgtacttcgcatgactaaatccttgaagaaaaaaggaatttttaatgagcaagagagtgtggaacatatgctaaataactggaattttgaataattgagtttaattctgtttgtctttctccccctaatcatttgactcctctaggacagcgactgttacacaattaattgttagaactaagtccacaataaactccctgataatagctctagctggcaataaaacagaaattgggttataatactcattcgtgctcactgtgtatgcaaaaagaaaatgtagttttaatttgcttacattaattaaaatataatgaattaagtggataacaaattcattagaaattgaaccttgactgtctaattgttaacagttttaacaccatccagaagaaaaaaaattagtaaatcaagaatttcaaggatttaggaggtgagagattgatttttataacctacatataaatgaaccaccaacaaatttatgctttactaaaattaagtgtacaatgttaatgaagttaatatactaataaatacatgggacacacctatttaaaaataacatctttacacatggattagggtcctctgagaatatttgcataattcaatcagaaactgaagtactaaaaggatctagggttatatgtagagatgtgtaatttaaagagaagaaatggaaaaaataaagttgattatttgatgttattttagttttttcagaaaagctaaaaatttcttctgaaaatgttttaattttagttgaattttttatgttttctccaagtcttcctatcttcatagctatgtttttctgcttcataatgcattcaatatgttcctagtggattcatattaaataactcagtacctagcatgtgtcaggcatttatttttaccaagagaattaataacattcaccaaagagggccattctcctttctgaaagtgtcagctactgttactggaatgagtaggatcactcattcatagagtgatttccacgtgcagacactgaggcaggggcttcatgtacactgtgtactttaacccttgtaactctgaagctaggtgctgtcctctctattttgtacataaaggaagagaagctcaagctgaataaataacttatccagtgtcacgtagtttaaaaaggatgtaatacattaaaaataaagtctctgcgacatgaaagttcccattttcagttattattgagaagtgacaatgcagcaattaccaaaagaaccatctctggattatttttgcctaagaaaactagtatcagtacagactgatgctatgagaacacagaggaagtccaaccaattaggtgtaagtctcaaaccatttgctttatacaattgtagctttgagcaagctcctcaacttcctaaaacattggttttccctaattaaaaaacaaggacattaatactaataatattccagggagtttggatgtattagatgatacaactcatgggaaagacttggcacagtgcctagcttataatgtgtataagctaatattagtgtcaaagccagagaaaattgatcagaaaaataaacattcagctataacacatataaggataaacacttaatttttaagggttgttaatattcattcctagatataacatttggggttccttttgtaacccatatattatttcattggcttcaaaattatgaatattcatagcttgagtctatggtagtaaatgtgtgtatctgtgtgaataaatctttattagatttttaagtgtaatttgcaacgtgtgtgtgcgtgtgtatatatatatatatatatatatatatatatatatatatatatatatcttctaagtcttttttgaagaatctgttccattagtgcttagacacaaagttacatatacaacaatgttcctggaagtattactttctatagaaaaaccgtagaaaacaatctaaaggatcatgagtagttactctattaaataaattatagttcaccaagatatgatattccagaaaacctttaaaattgacacgcaaatagctctaatttataatgttaagagttaatcacaagtagcagagcaatatatatggtatgctcccattgttggcaaaaaagtatgtgattacatttagtatgtgtgcatgtaaatgcatataatgttgaatttcatactgttcacaggtatcatctctgggaaagggggtgagtcctgcagtaaagggattgaagacctttcaagtttatatatatatactttttattgttggattctttttgataaaatggtgttataatttacttctgtagtaaaaatatctatttttataatgttcctaaaattcaccttacgagaataagcatcatcagtatatatgatgtgacatttttatatatgagtgatacatacagtgattctatcctctgtacattacaaagaacatgtttggttctgtgtccaatattttagataaaagatctacaaacacaacagagtgaataggatgatctctcttgatctgtctttctcacacacatatcatatatatctatatagtgattaaaagaaatcctataaatggtcatcaaatatttgaaggataatcatgaaaaaaagggcttatcctatgtagcaaattggaacgaacaattcagcatacacgattggttttattattcttatttttataattaatttattgtaaattcagcaatgaaagcagctacaatggaacttccctattccttgaatcttgatggctacttgacagcaagatgcaacagaaagacttctctgtactacaggaaatattggattagtttttctcttccaattcaaaatctggggatactataacttattcttggtagtttaagagcaattttatatgctctatagttttccaacagataccagtgattaacttagaaaagaagcaagtatgagttaacttttaagattaaatatgttaaatataaatgctcctcttttgagtgctttctaattgacagatagtttcctatttatttttgcatacattgtgctggtcacattactatgaaatagatatttctgtctctatttttatagatgtgtaaactgagattcagcagggataaatgccacatcctcaagatcactctgttagaaagtatgggtccagtatttgaatccaggcctacctgactcccaacaccatgctcttaaccacaatgctatgctgcttcctgattttaagtgtctggatataaattaagctttagaaagaagagttaataataataattgttataattaataaagatatattatccaggtatgataaaaccataaaaatcaacattatagaaaaatagacattatattaattgttggataaaaattaaattagaagtagaatagctagtaattgtataactagagtaaccatatagcccagtttgcccaagagagtcccagtttattatacctgtatttatttgtaattacataatgtaacaatagctatcttcctttggtctaaaagtatcccagttcagatgataaattataaaatcatactagctataactaaagataattatgtccaagaataataggacaaagacaattacagaagcaaagtgaaatttgttttagaaccaaaaccaaatttatgaggagcttagaaactcactatactgtccaagactcaaaagatggcatgaagagctaaatgtctttaaatttgtcactagagagaaaaatatatggcatttactaggcataattagtctatatgtatgttctttctattttcaacctgtaggtggccaccacaagctacacttattaaacaactcattagtagcattttcaatactgtcatcttcagataattagcaatttatttaaataaccaatttctgtagaaataattgccatgaaatgccctgaacctactttttataaactataataaaagtgttaagataatccctgacatttgcaaatgccattagttcacctttccttttgatagtgctatggcattatgtttaaacaattacccgacaacacagcagtttaatgaaacagtacagtgagcacattcttcaatatggccagagaggacattcagatttagaaagaaatccagtgcgcagagaggtttacccagaggaaaaacacagctaaaagaaaaagaattactgaattaaggacattattgctatttccaagttggtttagtttccatggtagatgccgtatcatatgtactctctttggaaacaagaaaggagagttttacaagttgatttatgtgataggctggtgtgaactataatcatatatatctacgaatatgtataataccttcattgtattatttgctctaaaaccttgatgcaggaacaagtagtaaatttttcttactatcaaccttaaatgtacttttactttaaaaatggtgtgcactttcaaagtagagttattgaggaaacgcacaaatggttttacatcgcagctagtatttatcatttaaaatagaccagagttctaactcagtttcttccttgctattcagttccttatactactaagatccattgatgtgggattatacagtgtgtcttggttgcgagtggtaaaactatttgaagcctttataatttttaagctggtgtccacttcatatgaaaaaataaaattagaattcaaagccagtggcaatattatttttatggttagactgaaataacttgagaacctattaagtaccagttgctctgctaaattattcactcgttatttatatcctcacgacatcattacaagtcacatatacattatctccattttacagacatggaaattcaggctcaaggaattaaatagtatgtgcatgtaagaaaggcagggccgtgtggttagataatgcattacaacaataagacaattagtctgcaatatcaccataaaattcactgccgggtttgaatgtgaggacttttctttatttccagattaacacatgcctcaatctctccaaataagagcttctggcaatgctttttgcctacaattttaaaggtttacctataagtataaatagaagaactatttaaaaaagacatatttccccagccaagaaattattctcacctatgacagacttagtggacttgaagtaatatttctcatgtgattttgcttaaggatgtccagagcaaatgttacacagcataaaaatctcaccattctatgtgttttcaaaaatgattatttgagtaggagaaggaggaagattataatgacaatgataatgccgatgaccggagtttcattttactcttgggagaatccaggataacaagtgggcattattctgagaacatacagaaaaataaaaaagaggttccacatccattaggatcctattacttcttcctttggaaaatcacaatttcttttctctctgaaatcctgtgctctgtttactctgtgggtggttctatggccagggtgtccatggcagcacttgctgtactgtaaaaccattcctttcactctcagcaacacattctctttcactttacaaagaattacatgtgttaatctctatgctctgtgataaggctgtgtccctcagagtctactgaaacacaggctgtacagcagttgatggcgttttgttctcttctttggcctgtacaactctcaaagatgtggtgtggacaaggacatctctacctgggcccttatctgaaccctctgaatcaatgctcactctaaaactgaccaggcactttgaaaaagagagatcctactgtttagttgctctatcaattagttgacaataacatttcttcctaaatttcaatagggtaaaaaatgaaaaatcattttcagtcaaaattatttcttgtacccagcaccatggctgttgctcaaaggcagcagaagagatgtctcttctcagcaagcttataaggctgggtcaatgagataaaaaacatggacaacccatgttcacatgcccaattttgtgggtcagacaacagacactgctgaaacttagaagacaaggagagccaggaaatctgaggtggtctaggaaggctttgaggaagatgcaggacttacttcagttgggctcttgaaagataagtgggtaggtctggggctaaaaattaggatatttcaaactgtggcagagtttgggaacaaggtgagaaaaatttcagatatagtaatgaacaaatcatatttataaaacacgttaacagcaaaactaaagtagcctctcaggttgggaaatggtatacagtgcattacatagtgtagggatgttgcctcgtaggcaggaaaacagcctacccccagctctcgcagctaccaatatcaatttctatatggcattttactttttaaaatgcattaaaaaatattgacctagtataagaataaacaggtttaaatttaaacaaaatatcaagtaagggaagttcaaagctatttattgttaataaaaataatattcctattttaatagcaattgttaattattaataaattaataaatattgctatttactgccaataaaaatatttctcaggggacactaaagagaatctgtactctttatacatgtccctgtctgcagcctttctagagatcataaagttctttctagtctgatgaaaagtaatattaggatttttatcaaacagaagggataagaactacaactagaataatatgatccactttttcataatatagagagcttatataatggaagagaacaagtgttccactccattcaaccattcagtaactattgccagtaatgtgaattatcattttcacagatgcatctatacttttaacaaacatcataaatagtgcaggaatctgtagcatgtattaaaaagagcatatgatcaaaaaactaggaaaggaaaaagaacttaagactacattatttcagacaagatctcctaaagtattacctaaaggaactgtaatactaccctagagcatgaggatatggagcaatctggcaacctctcttaacataccacaagtcagctacttgccaaaaatgggaagctagtttcaagctgtgcatatctgtgtggcccctgagacccctgatgtttcagggctttggactacaagctgaggatgtgcctcaaccaaatggatgataaaaactagtagtgatttgtatagccactgagtaggcatgaatttctaatgtatctaatacagaaccaaatagaataaaatagaataatctatgtaaagcaggcagcacagtgacaagcacatagtaaatgctttaaaaatgccatcactacagtttctaaaaatataaaaggataataatagaacaatatgagcaatgtcatacaataaactcaacagttgaagtgaaatgcacaaattccatgcaaaacacaactaaccaaaattgagacaacaaaaaacagaaagtcaaaattaaaaatagatccataactattgcacaagttgaattcataataaaaaacattttcacaaagcaaactgcaagcccagatggcttcgctggtaaattctattaaactaaaggaaggaataataccgatcttacacaaactcttgtagaagatagaggaagaatgagccaatctcaactcattttataaagccagtataatcttgatattgaaacctgacaaataaactaaaggaaaataaaattatagaccaatatccatagactcaaatatctgtattaaataaattcagcaatatataaaaggtgtaaagcatcatgatcaaatacagtttatcccaggaatatgaaggtaatttgatatggtttggctgtgtccccacccaaatctcatcttgaattgttaactcccacacttcccacgtgttgtgggaggaacccagtgggaggtgattggattatgggggcgggtctttcctgcgctgttcttgtgatagtgaatgagatctgatggttttaaaaacaggagttgccttgcacaagctctctttttgcctgctgccatccatgtaagatgtgattgctcctccttgccttccaccatgattgcaaggcctccccagccacatggaactgtgagtccaattaaacctctttctttggaaattgcccagtctgatgtatgtctttattagcagtgtgaaaatggactaatacatggtttaacatttgaaaatcaattaatgtaattcaccaatcaactgaataaaagagaaaagacatatgagtatctcaaaagggtacagaaagtgtacacaggaaaatctgaaatccatccgtgatgagaactgtaagcaaaacaagggtgagactatcctcaatctgacaaagaacatctataaaaaaacctatagctaaaatcagactttatgttaaaaaattctttctctatatactcttcatactttctatatactctattccatatactcacaagaagcaattagaaagttaaaaaatagtattcacaatagcaccaaaaagcaacaataggagtacatttagaaaagatatgtaagatctgtacactaaaaatattttgtaaaatatttctgagaaaaattcatgatacttcagaaaataaagagacatactaatcatagacttgttgactcaatactgttaagatgttaaacttcaccaaattgatctgtagattcaacacaactcaaaacaaaaatccaaaaaggtttctttgaagaaactgataagctgattcttaacattatttaaaaatacaaaggatgtagattagcaaaaacaatcaggaaagaaaataactcaaggacacgatttcattttaggacttgctttaaatttatagtaataaagacaatggcattagaatatacgacaaataagtgaaagagaacggagtcctgatatagtcccacaggtaaggccaattaatttttgaccaaggcaggaagtcagttcaatgaggggaaaaaagccattctaacaaatggtgtgagaaaagcaggatatttttaagaggaaggggggagaaaagaaaagaaaagaaaggaaaaaaatgaaaccatggcctctacctcacttcatatacagtttttttaaagattcaagatgaattgtaaatctaaatgtaaaacttgaaaccataaagttcctagggagaagaaaaggagaatatttctgtaaccctgaattaggcaaaaatttcatggaaaggatgttaaaagcaacgactaatttaaaaaaaaaattgataaactggacacttgaacaaaatacatcattaagaaaataaagaagccaaagtctagaaaaaaatatattcacacacatatattttaaaacgaactcatatgtaaaatacatgaagaactagaaaccaacagttaaaagattacaatagacaaaatacttgaacaatactttttaaaaagacatacaaatgatcaataaatacataaaaaagtgttccacatcagggaactcgaaattaaaatcaccatgagacaccattttaggcccacaggaatggctaaaaatccaaaagactgataacaccaaatgttgataacaatgtggaacaaaacgaactctcacatgctgctggaaggagtataaaatgataaatcacggccaggcatggtggctcacgcctgtaatcccagcactttgggaggccaaggcgggcggatcacgaggtcaggagttggagaacagtctggccaacatagtgaaaccctgtctctataaaaacacaaaaaataagccgggtgtggtggtgtgtgcctgtaatcccagctactcaggaagctgaggcaggagaatcgcgtgaacatgggagacggaggttgcagtgagccgagatcacgccattgcaccccagcccaggcaacaatgcaagactccatctcaaaaaaataaaaaataaaaataaataaataaataaagataaatcactttggataattgtttgacagtttctttaaaaaatgacatacatctatcctatcacccagcaatttctttcctagatattcactcaacagtgaaaacagaactaaaaaagtatatgtacaaaaatgttcatgacagccttacccataacagctcaaaactggaaacaactgaaatatccatcaattggagaatgaataaacacattttggtcaatcagtagaatgtaaactactagcaataaaaatgaaatttctactgatgtatgtgacaatattattttaaaaattatattgaacgtaaatgaggccagacatgtcccctactcacacacacatggaagtagcagggaagaaaggtaagaaagagaaagagagaatagaatgaatattatttagtttatatgaagttttagtacagataaaaagagtctatggtggtataagtctcagctggagatggagaaattgactagcaagcaacccaagagaactttctggtgtgaaggaaatatcctctgtcttgtttcagattgtgttactacagatgtgcatcattttgaaagctaacttatctgaacatatatcatatctgtgtattatattgtatttaactatactccattaaaaataaaaatatatgaatacataaataagaagtagcaaaatgtccatctcaaaagtgagcatctcctatatgaatccacttctaaaaaattcttttgatggtcagaatctttcaaatacttaattttatgaaatatgaggacatcttcccatttgcaaatagaaaatgaatctgtggcagggcacggtggctcatgtctgtaattccagcacttggggaggccaaggcaggtggatgacctgaggtcaggagttcgagaccagcctggccgacatggtgaaaacccatctccagtaaaaatacaaaatcagttggtcatggtggcaggcgcctctccagcaacttggaaggctgaggcaggagaatcgcttgaatctgggaggcggaggttgcagtgagccgagattgcgccattgcactccagcctggccaacaagagtgaaactctgtctaaaaaaaaaaaaaaaaaaaaaagaaagaaaaaaagaaaaaaaatgaatctgtgagcttatattttaaaggtgaatgggactgaagatcatcatctacagtacatcatgtaaggtaaatcaatgtcaacttagatgacccagtgagagcaatttttatggtggtgttgctcttgttaatgttcgtaatctccatgaaattttcttgagagcaatgcttttaaagaagccacatatatcacatataagcacgtacacacaaacatacacatacacacacacacattgtcagtgataaatcactagttactaagaataaggacacatggagtacaaaatgatgagcatataaagacaggtattacggctagactatacctctaaatcgtaactcttgaattagccaggcatgctaaaaatcactctatttagaaaggcacagcttcaatgaaccaaagaagcagtttggccctttgctgactgtagtgctaagtgagaccccagagccaaatttcaaaaaatgccatcaactgatcacaagtattgttaacatataatgagaatgtctgtttctgcactttatgcccaaattggtatttgagtatatctttacctctccaaaacgagagaggagtcactcaagggtgttattcctattaaaaccttgtagtcataaacttaacttcccagacaaatctttaaggaatatttggctcatagttatgtcaagtctatggtggatttgtaatgaagtatcctttctctatttgctattttttcaatctttaatgttttctgatgaaatttcaggctcttgtcaaattgaggtcattactttgtctactggcatggatatgcaggcaaattggccagtgtgcaaccctggatgactcaacttattgccaaatggcagttagctaacttccatttgcaagaagaggagacagcctattgtcaggaccaacttggtggggaaaggatatatagtctgtgtctaatgcacatatctaagcaaaatgtgatgcatatatttttccacattcgtagatgctctttcttgtttttttccaatttatattgttgacataagtgtctcatcgtccaaatgcttaaattgtgtataataattccaaacagcattcgaccattcagatttgggcattgggcatcacagatatgttaaatctagttacagaggcagagctagagcatggtttccatgccttgaggggagagacatttttcagtaacctttgccaaaaccgctatatactgtttttctcaacagagctcagagactcattgtaattgtgtagaagtcaacagaaatcatattaaactataacactttcaaattttttcaagtatatttgcaatccagtgtaaatagggccaatggtcacaatgtatatatttttggaacactaatatttgttttactctaggcaagtgttttcacaggtagtaactggtatgaaaaagatctgctttcactctagaagattatttattcataaacttcgaaatacaaatcataagactcccagaattctaatttactaaatgctgaatatattatgaagcagttcttaaaatttaaaatttgaaaatggaaatgtattgaaaaagtttcagaaaaaaatgatgtatttcccatatccagcacaaactgaactagagaaacatattatgattgccaaaaaacgggctatcactctaaaggctgtaggcaaacaaaatactaacaagtttaattattcacaatggcacatttatggagagtataatgtcacaatcaatgattacaagcccacacaaatagcactgtaataatcctacaaggcgtgttcagaagtgaaataatttagaatttgaaatcaatagcatttatagacattggaaaatgtcaaatggaaaacgaatgccagtatttgtattctttctggagcatttttacttctcagcttttaattattctttaaaagattttttagtatctgaaagcaaaagcaaacatttccctttcatgtctcaactaactctttcaataaacttagatatgtgagggtattgttttatgtatggaaaaatgagaagtctttgtgagagctaaggttttgctaagtgtttccctttaatttcccttctcgtggcatcgttcccttgtgccattctcatcctccatctcacaatgtttttgttccattcatttcccatcactattagcatttaaattccggttttggcacaaaaactttccaacacaaggtattactttgacaaattcttaaaatactccttgtaattagagacagggtaaattggatgagaagtatatagggattctctccactatcttttcaacttttctgtaagtctaaaatcattaaaaaataaacctttatttttaaaagtttcccctatataacacttggattcttcttgctcttataaaaatatcagtttacctatattatttgggaaaaacaaggacacaaacttgtgaatattgaaaataattcttaaaaatataacattcatagctattttaattaattgccatttcctagcaaggaataatagcaataacaataactatcctttgttgaatgaactaaatatgcacacagaactctattaaggcttttattaatattacttaagttactttatctaaatctcacagaatctccaggagctatcactttttatgctaaaaattgttaaatatcttgtctttataagagtaactggaaggtctcagattctacccaaatatgttgactcccaaactagggccgtttttcacaaacattttgccttccttcaataagttgatatttgtatgtacctattggctctaggcattgcactgtacatatactttttatatatatacttatttgtatgaatgctcaaaaataaccctgcaacaagttgctattaattctaaaaacgaaaggaaaaatcctgacattttctagtaaaagctgttctagttacgaaagcatttaactgtcaactctggtctttgctgacacttttttagatttctgaaaaaaaaactgtatttaaccatttgtccattaatggagtgatgtccaatcaccttatgtaccatcaaattacctatcaacagaaagagaaagagaagaaaatttaatttcaggttactccagaaactatggcaaccaggctgtttggcagccaaagggtgtaaaatccagattagatagatggatgtatttacatattcacttttacattaaacagagtggatgacacatccctgtataaaacctattatttaaaaacttcaagtgaaaactgttaaaataaatggctcatgacttatgaagtgttaaaataaacgtttatttcaacactatacatgtcataagccatttatttcaacactccctacttcagaagacttacccaaaacaagaagaaaagatctcacttgctaagtgtatgtcaagaggccaagacgcagaagataaaaccgaagttttgatgctagagctttggtatgtggaagttcagatcagaaggtggaagaggaggtttgatgcttaacacctggtaaaagctctgtggttgtggtaaactgttcatcatcaccacctacattggcttcatttagacatcacgtttatcttaagtcattctgagagtttagggcatgcctgagtatcaaattatgaatgaaatgcactgtttgaggtgtttctgcaaagataatatatgttttattttatgtccccacttattagagaaggctcatgtaatcaaagtcttcagggagcaaagcttcagggacaaaggcccagtttcataagcataagtgcatacacttatacagcacttcctatatgacaagctctagtgtaagtgttatacaaatattaagtaatttaatcttcacagtgtttaggagggtgatatggtttagctgtgttcccacccaaatttcatcttgtattcccacatgttgtgggagggacccagtgggaggtaattaaatcatgtgggcaggtctttccctgctattctcatgatagtaagtctcatgagatctgatggttttataaagaggagttcccctgcacaagttctctctctttgcctgctgccattcatgtaagttgtgacttgctcctctttgccttctgtcatgattgtgaggcttccccagccatgtggaactgtaagtccattaaacctccttcttttgtaaattgtccaatcttgggtatgtctttatcagcaatatgaaaacagactaatacagaggggtaggtatttttatttttgccgtttttttttttcagatgggaaaacaaatctagagtggctgagtaatctaaccaggggaaactggtaagtggtggcaccaggattttaccccaagcagttagcgccagagtccacgttccttatccctatgctaggttgctgactttcagcagcagaacagcagactatctcatgctctagaagtcatgtgggcttgagaagtcaagttcatcatttcattttcgggcagggctagcccaaatgggtgacaatttctctcctttataaacaagatctcctagatgaaaagaattaatgctatttctataagaaattagtattgactgatgactgatgatagttgattatgacagctttcagttttgcctattttaagactttatgttcctaccaaaagttgaaggcctatggttgaagtgggaacgtctgacagtgactgaattatttccctccaggatgtcttttattgcccgctaataaaagcgctagtaaaacatttccattgttaagcatacccaataatagcagtctttatattctgaaacaatgctgtatagctcccaagcttctctctccctcccttcctcatccttccttctctctttcttttatatttccctcttgatatggtttggctgtgtcccccctcaaatttcatcttgaattgtagcttccacaattcccatgtgttgtgggagggacccggtgggaggtaactgaatcatgggggtgtgtctttctcatgctcttctcatgataatgaataagtctcatgagatctgatggtttcataaggaggagtttccctgcataagctctctctttgcctgctgttatccacgttaagatgtgacttgctcctccttgccttccaccatgattgtgaggcctccccagccatgtggaactgtgagtccattaaacctctttcctgtataaattatccagtctcaggtatatctttattagcagtgtgagaacagactaatacacttcctcttatttctctaacatctcttctttcctttatctcccatctttaccttacctctcccctctcctcagacaccttagcactaagaacaaaattaagtgtggattgcttaaagtccctcagtctttataattttataaatctgtcaatagttggaacatatgatgtaaaatcatgtagtctatctgtaatacatatccttgtccacaaaccagactttaaaatatctacacccttcctctgcccacccaccttcccacttcacactacgcaatgattaccaacaagttcctttggaaatcacaaagccaaaaattggtaaaaagaaatcagaagactcagtgcactgtgacatacaaaaaacaatgtgcttttaacataccacaatggaaagaaaaattctgagtttttttgattagaacatttggcatttgaaagaagaaaactaaattattataaaattatggaatgtactcaacaaaaaagtgacataattaaaaaaataataggttggataatatgaaaatatactatatactcacctatttataaaatctctatatttgatatcttgttattagaatccaaactactccaactagtaaaacattcagatgtatttatactacataaatgagacctatatttttataagtgacacctgaaatgtattttctgagagcatattttgatatttactactggtactaaagtaaaagtacatatacatacgtatatatatatatatatagagagagagaaagagagagagagcacgtgagttatgtaaatatacatataccatatctctatatagtgtgcatatgtatatgtgtgtgtatatatgtatacgtatatatatatttgtgtatgtatatgtgtatatatatggtacaagtatatcttcccagctattttttcaatttaaaaaaagtttcataccatcaatttgaaaaaattctaaatttaaaattaatttttatacaaatttaaactagacattaaaaaccaaatattttcattcattaaataagtagacatttattgaatgccagctatgaagcagctattatgtttggagctggtgacataaataggagttagacattatccctgtctttaagaaatgtacactctagctaaatgaatatataaataacttattataatgtatgttaatgactccagtaaaccttagaaaatgatcatgacaaatcagagaaaagtgtattgtactttgtctagttgggtcatctttacttgaagatgaaatatgaactatgtcttaaaggataactagcattttgaatgcagagaaggaatggagggaatcacagataacggcatgagcaaaaggatacagatctggctggaatgttaggtgtgtcgtagggcctagagtaaagatggattaggagggagaggaaggagacaaggctagatggagagtggggcagatatttctgggacacacactacagcctccttgaccacctctaattcaacagcagctcttctagtcagttccatgtcagctctgactgaccccaagaaaacagagccccacttcatgctttgctaaacttctttgtaccccctgtcccagggcctctcctgccaccacaagagcctactaagcctgtgcttccaagccacaaaagtacaggcaagtgaataaatactttcagggacagcccttaggctgctcccgccttccatccttcagggggacaattctataaggcttctgcacactttctaggagttcataattgtgatctaaaagtgatacctgcttaagttgacttttgctccttctttgtctcatatttcctcctccctgatgtctatttcccaagatcaactcccaaataggccactttcatccaagtccttgtcttcaggctttgcttttgtaagaactcaaactaaggcagagatgcaatgaggcctgtttgtgaagggtcctatactctgcattcagcattctggacagtttcttacagaagtgagagggcctctgagaattttgagcaaggtagttaccagataagattgtattttggactttgtatatgatggtggtgttgcataaggaccagaaggacaagaaagtgaaagtgattagcagatggtcatttaagaattgtctataaacacaagggcttggactaagtcaagcctatataagatagaaaatgacataaaagatttcattcacattcggagatggactatataaaaccttgtgactaattagaaatgcagagtaaaagggtcaacagtgtcaagaggactcaggttaatgccatttactgtgataatttttaaagtatttagaggataacaaatttgagtttgggtaaatacctgaggctaactggatggaaaacagctgagctacttaaaaacatgaaatataacctattacttatgttttggtttgccatgcatggtatctccagtactgtaaaactgggattctataaatgccttatttataaataggatcctagagctcaaagagattgtgacaatgctgactactagaaagagtttgctaaaatgttattcaattgaaaactgtgtatgaactttaggatcataaaaagcttggtatacattctcctttcctctcttaacagcaaccacaaactggaatttaccgattaaaaatattattatttttgagtcagagtcttgctctttcacccaggctggagtacagtggtgtgatcaatagctcattgcagactcgaacccctcctcaagtgcccctcctgcctcagcctcctaagtagctggtaccacaggcagaaattgaaagaccagtggccaaggatcaaagtattcaatcaaggttgggcagtgacttaggattagcagatgagatcaggtggcataatgggaggcaaagtcagtgtataaggtcaagatggtataatggaggcaagaacttcaaagactggtgagtgaaaactgtacaataatgatttggaagaagcagtgaaataataaaacaattatagtaacatcacaaattttgattacatacaacaagaatttcatttcttgctttcaattttcatccttcttctatatctgtacaagtcagactagccagactgaaattggaagatgatatgggcaatggttgacatagatagatatgtacacatctctttacatatatacataaagttacctttcaccactgtcattcttggcagataaaacactataatcactttatagttgaatggcatataatgcaatgaaaggtcttcacaagaaaaaaaattatgttttcacctttttactttctttagcagtgattagttccagaaatataaggtatcatcacttctcaaaaagcgctgtaggttataagattgctcttctgaagttggcaacatgtaataaatgtgctttattcctaaacatcaatcagtttcaagaatggcacttgcttgtaaaatggtaataatagaaatagtcagctaataagtactataggcattaaaacactggatgacaggtgtgaagacttcttgttataaaagaatactctcttatataattatggttttataactagttacatcagtttctaaatatttagtttttaagatttctgtatcttttttggtaatgaaacttatatgatagtattctgtactatcatatttataacaaataaaatatagagatatagccaaaaaagacaatgaaagtattctggagaggtgtgatggctgtaggtcatttaatctgaagagtaacaaatttaaataattattaaaagtgttgcttgagaagatattaatttgttgtataagtatacaattgaaaaatatttgtgtaagtcttaaaattaccataaaattagaatgtttcagtaatttatgaaatagttgcatggataaactttattgaatgtgtggtttagtagaaacaaacaaaaaacactcaaatacaaaacaaaaggacacatggtgattttcattttccaaagcaaaacttcactctgtgtcaaataaacagaaaaatcaggttcctaacctaaatggagttatattttgctggagagaggatctgcagactgaacataactatataatgtacgaaatctaaatgccaggggaatgtagcagacagtccagagggagttcagagagcaggcaagttccagaaagtacatggaggcagtaagcattttaagtacaaaatcagataaatggaccacaggcatatcaaacttcagaaatgttttcaaagaaggcatgcaagtgagaacacatattttgttttcacagaatgaagagataatcgttcaccataagtaaacagtttgtaaatgatcactgaattgtagataggggtgtaaatagttgctggattgtgaagacttagtctagaattgtgaagacgtatgacaaacacatgacaaacaagtcactggcaaaatgtctggagttctctttccatgtagcttttcgaagtagattcagaaaaggcttttaatataaatttgaaaggaaagaaagggaaggggagctaatggatgcctctatgcgctgggcactgtgatggacacctttaactttagaatacattatttttatgacagctactttattgtaaatatatgtatctgcaatcacatctatccaaaattaatgtagagatccaactgcacaaatatgagaaaattaagtatcaagtgacacttgctagtgtggatgaagttatgatgactttctttgagaaaatgataaaagactatgcatctttttttttttttttttttttttaaaaaagaacgatttgtgtctctctcctaacttgccaagcaggaaaattcaaagggaaattgtgccaaatgactattttatttaaagaaaatagtttgagatggcagttccaaaattacttctgaaggtagcaaagggtatgaatttagttaagagataaaactgtgtttttagaattgagaacttaggctaggcaggcatttggcatacattagctaatttattcctcataatagctctatgaagtctgatttttggcattatcttcagttcacagtgaagttactgaggtcatcagctggtgagtgtgtttctgacattaaaactccgtaagtttttttcatcattcatgtgacttctacctgataattccttaaacactaaactatttgctgtttcttgaaaatatcataattattcacacctctgtgtgatttctcctgctattcctactgcctgaatttttttttgtttttgtcttcttctctttgtttgttaaggctaataccaaatattacatcctttggggagcactcctagaccatcctcaatcaccagattcctttctttttgttctctctagcatgagtgggaacaacatcttgaataatagcaatacccacctgcctcatcttttaatgtgtgagctccgtaagggcaggagaaatgtctagttactactttgactgtaggtatatccattggaaagaaaataaaggtaatctttacgcacactgggcatgaccagataagctccttaagttctttgagtcttggtttcctcatatatgaaatgaggccaatggaagtatctatctcatgtgagttagatgagcgattgcatgtaaaatgctccacatagggttgaacacattgtaagcccttaataaatgtcagttcttaccaacatcatcacctttatcattattattcctagtaattaacaattcgttcttcaacttcctggacaataaaaatgggttacattttccactaaaacttgaagacaattaattttaactttttaaaattctaaagttttgagagtagtaatgaaaaataatctttatttcttttatgatctatattttgtcttaacttctgaacgaagcctctacagaattagcagtttgggatatattttcttttaccagaagctatataaagaacaatataattcttcttatttctttttctttttttaggaggtgaaaattataagacattttctgatagagaagataatatcagacttaggtctacagcaggttcattctggatccatgctgggagagaaaacaatgaatgttacacttcatttataatttccactgtgaacatgataagggctagtatattctcaaatcaaattaatccacaattctagcatttaagatacagtgcaaatccctaattcaagtataaagtatcacctacaaagccaaaataaatggggtaagataacagttctcagtgttgggttatagtgtcaatgcaagacttgagctgtgttaattcaacaagcttgatcttgattgccaaagcatgcttgtcaatatttagctcccagagggcatgtcaggggcctttacagaaactagcttaaatacaaaatactatagcaggatttgtgatccttttcctaatactcagattaaactgctgattttctttcttttagctttttaaaccaagaacgtgttttccatactcctatggtaacaagaagagaagaaattgcatagaagaattgtaaatgctattattagagttccttgaaacccagataaaattctgtcacatgaaatcactataaagcttttatctgaggtctgaaataccatttccccactatgattacaatatagaaaaaggcttggaaaaaaatgttaatctttattcaaaaacaaatgtaatacagatgagatgatgggtaatgattcccacaaacttaaaaacaaatagtttacaattttaataactctgcacttagaatcttctgctacaaggatgctgtgaggttttgaagcttatatagccattattatttattatttaagggttgaaccattaaaacaattacacttaagaaaatatagtgggaatcagtagtacactgatgaaaacctataccctctatggtgattaagtataatacatgatatgaaaaatagcatttttccaaattaatacatttgtttgccttctaacttttattcctcattagatatcaattaattggacatctacattctccttttcactgaacctgacaaaacattctatgagattgggtatggtgagattctgaccaaaatatttccaaaacaaacaaaataaaccctaccaccacaacaaaaacatgttaaacacatacttcagataattgaaaaattacccccttcatttgatgatcaaaattttaatatatgtcaagtacttataacatggctgaaaatagcccttgatattatcttttttcttttatctatttttttctaaaataatgactaaagataaaatcagatcaatgctgcaacaatgagaatcaggctgaaatggaagagccagatcatgatctagattcttttggttacctacagatagctatgactgccaattctgaatcttaatagcaaaattctgtttttttttttttttttttttttttttttttggacaaagtcttactctgttgcccaggctgaagtgcagaactcattgcagcctcaaattcttgggctcaagcgatcttcctgcctcaccctctcaaatagctgggattataggcacacgccaccatgcctggctagtatttttttgttttatgttttttgtttctaatttttagtagagatgaggtcttgccatgttgcccaggctggtcttgaactcctgagctcaagcaatcctccctgcttggtctcccaaagtgttggaattacaggtgtgagccaacccttctcttcccactttatacatttctgaattgaaaattccagtgatttgtcgaaacaataccgtttccattaatcatatttgttttactaagctaagacaaatgcataagccacatccctaaatcctattttaacttttacacagtaataaatttttccatcattgtccctaacttaagcttcctaaatgtcagctgatcttcacaattaccatattttatagataataaattgtgctcagatggatcaaaacagcacaattcaacaccacaaggcaaagctaatttatatttaaattgggactcgaacctgggtctgctgactacaacctttttgctgtctttatccacacatcagatatttcttgatcaaggcaaagcttaaatataaaaccactatgacttcgagacctgaaagtgtttttgttttcagagaaatgttattcctcagcatgtgtcaaagatatggttatgagaaagacaaaactttatagttttcagttatattttgccttgtcccttcaattttaccccaatagatagtaatagcaagactgtcccgttcatccgtggacagtgccattattagatactgggaatcctcgttataaattacatcataccactttcaccttgtttatcagactcctgcctcactgatacttgttgtttcttaaattcccaagctcatggtagtaggtcctttgcatgaccttttccctcttcttggtgttctaaatccatattattgcatgattggcactgttcatacaagtcttagcccaaatgtcatttctcaaagacatcttctctgacccctaatctaaagtcccatctctttttctatcacaattataccacctagttttgctattttcataacagttagaggtatttgagattattcttatgtattttttattctctcctccccacagcaatccctgcttcctgtctgctcaatgctctacgctcagaatttagaacagcacctggcatatggtaggctcttttacaaatatatgtttaatggataaataattgaatcagagcattttaacatctagatgtaatatatcctacaagaattgttttaagaataacatttgtctttatcagtcccacctgtgggagtttgaatgtggtagaatttgtgtcattgtgatgtacaaaaaatcttattatctgttttttattatgtagtgtatagtttttatatcactactgtttgagataaatgtgaccttttaatcttcttattaaacttttaaatacaattttttctttaatcattccaggtctctgactaacatgctcaatttcaaacatgtactctatctactcataagttagaaaattttgatactctctacttagatgactaagtttctaagaaaaccccatcactctattttggtctaaatttgattcctttactcagaagtttacaaattaaactttctatatgagatgcattctacagcattttaattggtaaatacattgtgctttaagtaaaggtaaaaattacttttaaagtcacatgaatttagacaaatagtactacacaataaagttactgctgatcaccaggttttttagctaatagggacatctagaaataaataaacttaatctaagtttcacaataattagctcataatatttttagtagaatatgaatttcagggatatcctgtgttataaaatctgtgtcatttgttcctttgagttcagaagggtattaataaatgcccctaggcagcagtatccaattggcttagcatatcaagggagaatactaactagagaatgaaaaatagcacattagtgttcagaatgctcatctattaagagaagatacgtctgcaccatggagagagggtacaaggacatcaagacaaaatctaggagtgctatctaatatcaattaaacaaatcattgctgtgtcctgcagttcagggttctgcatctttggtgtcttaatctgctgtatgctgctataacagaatactatagactgggtaatttgtaatgaacagatattcatttctttttttattattattatacgttaagttctagggtacatgtgcacaacgggcaggtttgttacataggtatacatgtgccatgttggtttgctgcacccattaactcgtcatttacattaagtatttctcctaatgctatccctccccctgccccccacctcatgacaggccccagtgtctgatgttctctgccctgtgtccaagtgttctcatcgttcaattcctacctatgagtgagaacatggggtgtttggttttttggccttgtgataatttgctcagaatgatgacttccagattcattcatgtctctgcaaaggacatgaactcatccttttttatagctgcatagtattccacggtgtatatgtgccacattttcttaatccagtctatcattgatagacatttgggttggttccaagtctttgctattgtgaacagtgctgcaataaacatacaggtgcatgtgtctttatagtaacatgatttgtaatcctttgggtatataccccgtaatgggatcactgggtcaaatggtatttctagttctagatccttgaggaattgccacactgtcttccacaatggttgaactagtttacactcccaccaacagtgtaaaagcgtttctatttctccacatcctctccagcatctgttgtttcctgactttttaatgactgccattgtaactggtgtgagatggtatctcattgtggtttttatttgcatttctctgatgaccagtgatgatgagcatttttttcatgtgtctgttggctgcataaatgtcttcttttgagaagtgcctgttcatatcctttgcccactttttgatcaagtggaagaaagggtatcagtgattgaagatcagattcatttcttacagtttcagattgaagatcagattcattttttacagttccagaagctgggaaatccaaggtcaaggggcctgcatctggtgagagccttcctgctgtgtcatcccacggtggaaggcagaatggcacaggcgcacacaagagagaaagagattgaactggcagcctcaagcgcttttataatgggcattaatccattcatgagggtggagctttatggcttatcacctctcaggaatcaccctcatgaatgggcattaatccattcatgagggtggagacttatggcctaatcacctcacacctcttattgctgttgcattggggattaagcttccaacaaatgcttttgggggacacattcaaaccacagcattccaccatggtccctcaaaatcatgtccttctcatatacaaaatatgttcattccatcccaatggctttaacccattccagcacgaactcctaagtccaaagtccagagtgtcatgaaagtcagatatgggggaaacccaaggcacaattcatcttgaggcaaattcccatcagtctgggaaatcgaacaagttatctacttccaaaaacacaatggtgagacaagcataggatagacattcccgttccaaaagaaagaaataggcaagaaaaaaggagtaacttgtttcatgtaagtccaaaccacaagaagggaacattaaattttaaagctagagaataatatgttttgactctatgtcccacctcctggacacactggggcaggggttgggcccctagggattgggcagccctgtttatggctttgatgggttcagtacactcagcagctctcacaatttggcgtcttatgcccgcagttctcctaggctacagttgcatgctggtggcaccacagttctggggtccagggactgcctcactcccatggctctactaagtaatgtcaaagtggggattccctgcagtagtctcactcctgcactctgctgtgcattgccctagtaatagctctttgcagtggctctgtgcctatgacaagtctcttcttagggacccaggctaaccgagagatcctttgaaatctaggtggagggtgccatggccccagagctcctgtattctatattcttgaagaattagcactatgtggacactgtgaaggtttgcagcttataccttctggagtgatggatcaaggtgcccctaggattgcttgagccactgctggggaagctgagggtgatggacaaaaattcagggaacaaagtctcaagatagtgcagggcacctaatgctgaggtccgatatgagcccctgtctagaaaccctgccttcaatgtcctacctaacttgccttgaagatctcagaaatgcctccatggtcattctcccatagtcttgatgaataaaacctggatttcttctatccatattaatctctttagcaaacagtcgcttagccacacacttagtattccctcctgaacacattcttttattctttatgtggctaagttgagagtttttcaatgttttctgttctgtttcccttttaattataagttccatctttaaaacatttctctctctcattttactgtaagctgccaccatatagcaccttgaatgctttgttgcttagatatttatcctgccagatgttgtttagatagttcttcttaagttctgtcttccacgaaatcctagaacatagacacaattctaccacatttttttttgcaactgcacaaggatagctttttactcaagtctccaataccacattcgttatttccatctgaaatcttatcagaatgccccttaccatccacatttctacaacattctgattatgaccacctaagtaatccctaagaagatttaggctctccctgtagctcttgtcttcttctgagccctcaccagaattgtcctgaaagctctattcatggaaacctaggctttttctagccttctcctccaaactgttctagcctctacccgttacccagttccaaagtcatttccacattttcagatatttgttatagcagcagtcacacttctcggtaccaatttcctgtcttagtccattttatagtgttttaacagaataccaaagactgggtaatttataatgaacagagatttatttcttatagttccaaaggctgggaagtcggtggttgaggtgctggctgattcagttcctggtgagggctctcttcctagcttggagatggctgctttctcactgcgtcctcactcacatggtagagagagagctctgatatctcttcctcttcttataaagtcaccagccctattgcattagggacccacccttatgacttcatttaactttcagcacctcttcacaggctttatctccaaatacagtcacattggaggttaggaggttagggcttcaacatatgaactttggagggaggggcacaattcagtacacagcgctcaatatctttccaagtaaattacttcatcagcaaatttatgataagatttaattgcccaaattccctctgaaaagcatatgagattatgtcacatcatttggctcaaatgaagaactgtaaactcttccatatttcaggtgcttttcggagggacataggttataagcaccacgaaggcctggggccatgtatgtttccttcatgccattccagcagagtggcatatagaaagcactctatttgttaaaggaagagaggaggcaagaaaagtagtaaagaaagcaatagaatcactaacaatttcccattaggagtctaaattcataaacaaccggagaatgggtttagtcttcccaaaggaaagatatatggtcatcttgcggttgagaggcatcataatattccagtagaatgtgtatagactataattttttattcttccctaccccaatctgtgttcttgcaatatctcaaccaagtgctgatatttctcatattcaagctattcctttgtgttaaatctagaaaaatctaattaaaacacacacacattttctgtgaaagatcattaactacaacatttacaccattccccattcatatggacctgtgctctaaaggctgtgagagggtaaaacatggggctggtaagctctgctgcaagtgtggggccagaaaatatttcatatataaacaattgctacataaggtagagtttgggagaaaaatgtttgtctcaaatgaagaaaggtgctgtgaacactgggaatttgtctgctaaaagaggaagtaaaagtgagagggacaaagataaactttgtctggttatgttcttcaagagccatccttgcctatttaaacagtttaaggagaagttagttatgtaagttctctcacaaactcttacatatttcgagcaaatttattcaggaagatttctgctcttaatacctgcctcttttattctttccccaagtgtttattgagtgcctactactacataccaggtactttgctaatgcaagatttaaaaaatgaccaagaggacatttctgtgctgaaagaacttgcaaactgctaaaagagaaatgcagtaaccacacaaaatgataagtcctttgacagaaacacactgaaagtatgtttcccatcaaaggaagcatcaaattcagctaaagaattcatagagaaggtttgttggcacattgaaggaagctgggatttccccagacaagagataaggcacggagtgtggggagcatggtgcattagagagtagaacagttccctctgactggagcacagctgagcctgggggcaggcagggaaagctaaggatagaaacgttcttaggaatgagcttgtggacatcattaacaaggattttgaaaataaaagaaaattaaatgtagtgtagagaatggacagaagggagagaaataaaataaaatcaggaagaagttaattgcagtattcccagagataatcttgtggaattagacaaaaaggaccagctcagaaaaactttaagcaagtaggttctttgggctttagagatcaatcagatatggcaatacttatcaaagcctcacctgtcctcttagaagaggtaatgtgtactggaggaaaaattgtaataaagatcaaagagagattgctattttaaattcaacctttttcaagaaatctgcatattctccacattctgccgatattatattttgaaaaccccataaaagcatgttttgctaatgcagattaaaagaaattactagggcataaatatatagatcattttcaatttagtccctactcactactgttttgtaccttaccacatcctcaaatagctgcattctcctttctcccacttggtgaactattgaatcacaatatccaaatggaaggacttccacactttgaataattgatctcaagcatgttccctgatgatttgacattcactctgttcttctccctgaagtatatttatatcaataactgcagcttcagttgcccttatatcacagtgttcctttttaagagcaaactgataccgtaagtaattgctagcctctttctgaaaaattttattctttctgcaatttgaacttagagcaacagactttgtcaaaggcaaaccagcacatttttctcttttaaaaacacaagttttgaacgcctgtgaaaggtctccattcaatttgacactcagccaagtcctaggaaaataaaactcacagtcttgtttactttttctctactttttctccaacttcctctatattttaaaacatattttctggcctcatgaataaaaacaaacaaaaatgtggcagagagcacaagcatgaaagttaaatttcagaatgggctacatttagctattctgttgcttctagtctgactctttatttgcacagcaattaatcagctatggtatgtcttttaactgagtaaacgatcatcaacctctcctaaacatgttaagaagttcatttccgtctgaattgtcctgacaaatactaaaatagataaccttaataaggcactaatgagatcattataactagttttgtctgtatttaaagtacagatttaagatcttcattaatgattaactactggaaaactttgttcaatcccttgagttatttttaatctctatatactataattacatatattcaatcataaaactttccatggtgctgaacacaattgaactttgaataagaacaagtacgttacacatcttggctgtttaaaaaggttaatctttaagtagattaatgacatagtgatcttcactcagttcaagctttttttctttttgactgaggaaaagatacgttactacaagctatttcatatctttctgatggaacttacatgaatgactgctttagaatattgaacaatcagaaccctgaactttctattataaggtgtctctgagatcagataagtaggatgtggcctatcactggtctttattttcagttgtgctaaaatgaaacaagtgtgttttctcccgtcagtttcagaggagagtggatattaaatgttaaatcacatttaagctgaagtcaatgtacaaaactttcaaccctaaagttgcctaagggaatcagaaataagggcattttacgggtgttactataaaattaaagaggagacagaaatgtgggatgtttcctttcattaaatgccaaatagttatttcaaacaacttgtagatgactgtattttaatgttatgacatacaattttcaaaattaaatgtgttttaagtcaaatttgctaatagtatccagcaaaaagataaattttagaaacataattctctaactgttcaggcctttcaaaatatagtttgccatgggcccaacaaggccaagggtgaaacgcaatattttctgatcctaaaatctttgcaaaaaaggaatgcagaaaatcaatgcagaattatataaaatatgtttgaggcacagactagctcttcatctatactccaactaaactactccctctcacaagataccactttttaatatagtacaattacctccatactgactgcaaaatggcagttaaacctttaaagtgtaaatctttgcttttgtgtgtttacctgtcatggactttaaacagtgtggagagaggactaaggaaggtggtaagctatttataaattggaaagtctttttgcatttatctaggaatatagacattgtcaatatgtgattgaattactgcaccagttttcctggaggatttgtatgtttattgcttttttgtaagacatttatccagctctctcaatcctgttctctttcttgcatgagttcacacatattaaaatgcaagtgtcttgcttgtctgatatgtcttttgcattatttgaaaccctgaagccccaatatttcttgatatctgtacaattctgaaacaaaattatttagtaataatattccagggataaggcaataatgaaatgtatatgcaacaaaaagttcacaagccatcatttcaattttcctcttgaattttcagggtaaagttgaaggaaacatttacttttgaagaaagaacaaaactctaaattattatcatcacagcctgtgaattattctttgatgcctattgtgctaaataggagattttatacaacataaagttaaggcaatatttactttagcagcttacattttaaagaataaaaacgagaaaataaatatgaatttggatatatacatctaaattcaaggaacctagaacatgatatggtttgtatatttgtcccctccaaatctcaggttgaaatgtaatccccgctgtcagaggtggggcccagtgggttatatttgggccatgggggcagatctctcatgaagggtgtggtaccatccctgtggtaatgcatgagttctagcaatctattatttcacacctgagccgcttgtttaaaagagcctggcatctctcttgtgccctctcttgccatgtgacacatctgatctgctctccctttgttttccccgatgatcagaagcttcctgaggtcctcactagaagcagatgccagcactatgcttcttgtagagtctgcagaacctggaaacaattaaacctcttttctttataaattacccagccttgggtattcctttatagcaaggcgaaatggactaatacaaaataatatgaaccaaagtacaaatactcattcatgatgataaagcagaaaccagcatttactattaggttggtgcaaatgtaactgcagtttctgccattactttcaatggcaaaacgcgcaattacttttgcaccaacataatatgttctattacacaggaagttgctccaggttgtcaaaaagtgatcagtgctggttggtaaccattgtatcctagtgtgtgggtctagggatcagttatatgccaggcaagtctctgatcccctgaagttcacagataagaaattatatgtagaatatgatataaacacgagagagatgcacaggatgcataagatgcatggaatcaggggtaagggcttctaaagtagtttggggagtgtaaggaaaatattggactgagaagctggttctaagggtagaaatgcctctgtgtctaaggtagcagtatgcttgtaggtaccataggtatagaagcaagagcaaccttggcattaggtaaaagtgtgagtagctcagtatggttgattatggcctggggcagtggcaggggatggcaacagaaaaggctggagatgtaagctgggacaaaatcatccagagcatggaataccatgactaggtaacttttatcctggaatcatattctttcttcaagttttagttaaaatgttatctctcccacaaagtcttccctgatccttccagtaagaagtgatcactcccccatggagctcctacagatctttgtttgaattgctcctttgacaggtaccaaattttctactgcaataggtaatggagtgaaaagtataagaatctaggattcagagggcaagaggttctactcccaattttgtcactttgcagtggtctatttgcctttgggcagatctgttcaccttattttcctttacctgtaaactctgcgtaatagtagttacaaacatttgtcattcagggttattatgagtatgtgaaagtggctttagaaattttgaaatttctaaaaattgaggtgtttgaatatatgtcatctatttcctataagaatgcacacaccttaaagggagcaagatttagattctagaagaggtggataatagtttgccaattatttataagcctaaaaccttgaagattaatttatctcaatccttcctctttccaggaaatcttccttcagttcttttccatgataagtcagcttcctgttagcttcctctctccttgaggcatagacatgtgcatagctatctcactgcacatggcttatcatgccttctcctgatcttcttcctctcagcttcttttgctggatcttcttactcttcctgttcataaaatgctaaaatagccattggacctcttttttttctttatctgtatgcatttcttagtttatctcaacaggttccacaactttttataacatgtttatggcatgaaggttcaatttatgtattcagttctttcttctccttgaacttcagggtcaaatatctaactagttaatctatatcttcatttggatgtctgataagatgtcttaagttcaacatatccaaaaagaactattctttcccaaggctgatgtccagaatggtgtttcctaggttttcttctaggactcttaatggtcttatatttaaatcttatgactaagttctcaaaagcaattgcaacaacaacaaaaattgacaagtgtgacctaagtaaactaaatagcttcagcacagcaaaagaaattaccaacagcttaaacagagagcctacagaatgggaggaaatatttgcaaactatgcgtccaacaaaagtctaatatccagaatctataagaaacttaaacaagtcaaccagcaaaacataaataactccattaaaaagctggcaaaagacatgaacaggcacttctcaaaagaagacatacaagtgggcaacaatgaaaaaatgaaaaaatgttcaacatcattaatcaccagagaaatgaaaatcaaaaccacaaagggttaccatctcacaccagtcagaatggctattaagaagtcaacaaatgtgacacagcaagactctgtctcaaaaaaaaaaaaaaaaaagtcaacaaacaacagatactggtgaggttgtggagaaaagggaatgcttatacactgttggtgagaatgtaaattagttcagccactgtggaaagcagtttggagatttctcaaagaacttaaaacagaaccagcatttaatgcagcaatctcattactgggtatatatccaaagggaaataaattgttctaccaaaaagacacatgtgcttgtatgttcatcacagcactattcaccatagcaaagacacggaaacaacccaggtgcccatcaatggtgaactgaataaagaaaatctggtacatacacaccatggaatactatgcagccataaaaaagaataagatcatgtcttttgaagcaacctggatgcatctggaggccattatcctaagtgaattaacgcaggaacagaaaaccaaatactgtatattctcgtttataagtgggagctaaacactgggtatacatggacatatagatgggaacaacagacacttgggactaccagagaaagggaggaaggaaaggaggtaagggttgaaaaacaactcactgggtactaagctcactacctgggtgacaggatcattcatatcccaaaccccagcatcacacaaattacccatgtaacagacctgcacgtgtacccttgaatctaaaatgagagttgaaattaaaaaaaaaaagagaacacaaaaaacacaaaacaaacaaataaacaaacaaacaaaatgcccctcaaatcagaaatgaactattgatcctcctcccttactcttttgccataaagctgttctccagagtttacttaaaatggcactactgtttgttcacatgctcagcccaaactatttgaagttatttataattccctttcctcttgtatcacacattcaacccatcagttaatcccattgaccttctctaaaacatattctgaacacaacattctccctcctccaattcctccattgctactacactggtctaaaccacaactgtctcttgcttagattcctgaattagctttaaaaataattgccctgtccccattcttatgctgtatagtctgtctgctacacaacagccatggtgcccatttatttagaaattgaaattagatcatataactaccttaacaattagaataaatcccaaaatccatgcagggcctacatgatctctggttagtcctccaatctcattgtcaactattcactctcctattcaacttacttcacaccatgcatccttattgctgtttctgagcattctactatatttagccctttgtctttgggatttctgatctatttatttagtttgtgattgcctagttcaccttatgtgactaactctgactaatgtgccagtgttaagtgtttactgtcaattcatctcatgactcagtctgttccaggaaatgcaaagattaaaaagaatttctcttgattgcagcttaatattttccttattctaaaatgtttctttctgtcttgagcaatacctaactactagtaactaccagaaatgttagtgaaagtttgcctactcaggggcttcatctcataagaaagtaccagaaaagccaaaagtaatgcgccagtctataacaaatctgtgtttttgataatctaatttttaaaagttacatttactttctgactgccccttatcacattacagttcagggcagaacaaccagaaactacagaaagtaaatggacagggaaagagatgtgccattgttgttgataatgtgccggcacatgactaagctgtgatagttcaatgtttcttaatgttcttaactcaatgcctagatttaaaaagtcacagatcagagctgcaattatgccaaatacctggtggttttattaaacccccaaacagatttcctgttgttgctcccctctaaaagtttcaaaatatgcagagaaaaatgaggacagccaaatgaggataatctgatgtgtacagttgaaaataaagcatcatttaggaagaaacaaagttttctgttatgtagtaatgatgcaaagggctagagaaatctataaccctgaattctgacagtgcagataataatctgtttttcttgcacaatgaaatttactatcagtgtatgaattttaactgtgtgtagatatatatgcacactctaacacatatatacataaatatatattacactcttactaagacaatggtatttcgtaaaaattttttttttcccacagctctttgcagacactaaacttgagcttctgaatggcagaaattgacttttaaaatatatgacttcttaaaaaaattcaactttgattctagattcaggtgacggacatgcagatttgttccatgagtatattgcatgatgctgaagtctgtgatatgaatgatcctgtcacccaggtagtgagcatagtggtgaatctgtaagacattagattctgatattacaatttccaagggattgtttttgaaattacattaagcataccccatactttgtttaaacatggcagattccccacacatatatgagaagttttggaagatgaaaagcagattgtaaaatgataactgacttagtagaaaaaaaagaacattcaacatgtagaactcccaaaaaggcagctaaagacagggtactggagagcacagttcaagcagggaggcacagtgggtgaaatgtgaagactgtctgaagatggtatatagagccaattggaccccagtttccatcacaaccctgtgcaatcaggtttctagtggtccactggagacagagatttgtttgtttgtttgtttgtttgtttgtttacttgagatggagtctggctctgtaactcaggctggagtgcagtggtgcgatcttgggtcaccgcaacctccgcctccggagttcgagcgattctcctgcctcagcctccgagtagctgggacaacaggtgtgcatgaccatgcctggctaatttttgtatttttagtagagatggggtttcaccatgttggccaagctggtctcaaactcctcaccttaggtgatccgcccacctcagcctcccaaggtgttaggattacaggcgtgagacagaaatttatttttatagaagtgtactagagatactccagatatcaaaactagtggaaggctgtaattgagacaggaaactgaaagcaaggaaatgaaatgaaagtctgcatattgaaagctgggactaccattcatccactgatcccttttttacagaaaggcacattgctttcatgacggagatctgaggatccttctaagaaattgtttatccccagagaaaagacctgaagatactcacatttgtcagccacagtaaaaggaagagcttaccactcaatctcctctgcaataaagctccctagctgttaaatttcactcacatactcaaggcttccaatcaactttttaatatctcacacttaaaaactaaattgaggatgtcttgaatctccagacatttcagaagtctttttttttacatgaactagagaaaccaaaacaaataatcaaaataaataaatgaataatgaggcagaagatatagagatttatatacgcattgaagggaaactgtaagaaaaaaaccaaacatagctaacatcttcagagacagtacagaatgaactgcatccaaaagataatgcaatcaagaagaaaccaccaaagaaaatgatatcaatatgctgaagagatatctgtgctcccatgtttattgcagcactattcacaacagccaagatatggaatcaaactaaatggccatctatagataaataaagaaaatgtggtatgtacgcaatggaatactattcagccataaaacagaatgaaatcctttcatttgtggcaacatggatgaacctgcagggtattacgttaagtgaaataagccaggcagagtaagacaaatactgcatgaactcactcacatgtggaatctgaaaaagttgatttcatggaagtagagagtagaaaagtggtattaagagactggggaggggtagggggagcaggggcctggataggttagtcaatgaatacaaagttatagttaggaagaaacatttctgttgtttcattacacagtagggagattacagcaaataacaatatagtgtatatctcaagatacctcgaagattttaaatcttatctccacaaagaaatgataaatgcttagagtgatggatatggtaattaccccgatttgatcattatacaatgtattcgtgcactggaacatcactacacaccccataaaaatacaattattgttcgattataaatacaacattattttaaaaactatcaaaagcagaaagagttgtacaaaagttaaaatataatgatcaataaaaaataagttacaggtatgatatcaaagaaatctcccaaaagagaaagcaaaattcaaataggagaaacaaaacaaaataaatcagaggggagaatgactaaaagaaagaatggagaaaatgggaagaaaaaatgataaacagataacaccagagaatttccagacctaaaaataaaattttccacatagaaaagagctgagagtaaaacaagaaattaaaaggaaaatccaggttgtgaaaaccagatcacaagagataaagagtagatcctaccaaaaggataaaacaatttgaaagagagaaaatatataaatatatatatggatgtgcatatatataatttaaatcaaagagcagataacagatgagatcagccctctctataactgatagaagaaactagaatattggctataaatacttaattaaaaattgttttcaatataaaattttatacccaatcaaattattaagtatgaggatagaataaaaacattttcaaatatgcaaattttatctaaagtttctcagaatgcttagaatatctcaggaagttatcaaactaagtcccagaaaaataagtaaatatactaagggtgagaaatgtatgggatccagaaatagagggtttaacacacataagctaaggaacatccctaaataacatcaattaggacacacagggaataattttaattttttcccccatgatgtataacaaagtgcaatatcatgagtagggtataaaattatctacctcatcattatctttgaattatatattgcctttaaatattttaccaatttgatactcaaaaatagctcaccattgcttcactttgcatgtcttcgcaaactgagttttaagagtttttgcacataagttattggcttttttccatctattgctcaaataactttaaatatctatctctattttaagccagagcagctcagagttgcttttattgacttaccacttgatattatgtttgatattaaacctacactgagggatgttgtaagagaaaacccactggtgttactgtgttgactacaaagcttttgttgaggatacagctattttatgacatcatactctctgagtgagaagtcatagaccttgattctgaagcaattgcattattgttgtcttatgaacactgtttcatattcgtcttctaattttgttctttttttgatatataaaaaattaaagacaatatgcagtcaaatatttgcaatattttcactgatatttttccatttattttatctttacaaagctttcctttaccattttctctttttttcagagatgcagaggttgtttaatattaggaaatacattaatattattttatgactctaatagacaaaagcagaaaatcatatattttctagatacactagtttatttgactagacagaagctaatttactagtataaaatttttaaaataaaattcaacttttttcttgccaacatttattttaggttcaaggggtacatgtgcaggtttgttacatgtataaattgcatgttgcatgggtttggtgtatagagaattttgtcacctagttaatcatcataggtagtttctatcctcaccctcctcctaacctcctctctcaaataggccccagtgtctattgctcccttctttgtgtccatgtgtacttagtgtttagttcccacttccgagtgagaacggtatttggttttctgcttctatgttaatttgcttaggataatggcctccagcttcatccatgttgttgcaaaggccatgatttcactttcatatgctgtgtagtattccatggtgtttatataccgcattttctttattcagtccactgctgatgggcatctaggctggttccatgtctttgctattgtgaatagtgctgtgatgaacacatgtatgcatgtgtctttatggtgaaatgattttcaaataggataaacatacacctatcttttttcttttttaatagtttaatttagtacaattgttaaaattttagtctactatttattttgatacatagtatgaagaaaagttaatacttagacttttttctaaataaatagctaatttatccattgattatctgtttaataaaacatcttttgtttccctgacaattggtttgagtgtcttcttttatatgcgatattcttggaaatacgaagactatttcagagttctctgttccattggtttaatctactggttcttgtgccagaaaacattgtcttagttattataattttgaaattggtttaaataatctgttatgtatgtcctttttcacctttcatctaggtgaaaaagttgcttagtgattttttcctgtttcctcttgctcttaaattttaaagtaattttatgtgtcttagaaaaaagctcatttcaattttgtaattgacttaatttgaaataactgccatattcatttctaatttgaactaaatgccatattatgagtcttttattataactcaatttaatataactcaatttgaaataaacgctgtatttactatgagtcttctactataagaacatattgtgttttgtcatatattcaaagctgcttctctatgctgaagtagttatgttgtttctttcagtcccatatattatttaagaatgagtgttttatacttcgtttttgctagtttgaatgctggtgtataggaaagcaattgtttgtgtgtctactgtacagtggaacactgggtccaagagtataagccttggaatcagtcagatctgacctcaagtaccaatggacctcaggccttggtattgtttttctcatttataaaatgattctttgtgaaagctgcctaactcagagcctggtacacaaaatctccttaataaaaggcagccgatataataccttaagcatcaccattatcatctcactatcttatactttaattaattctgagatttaaattaactcttcacatttcctaggtatatgaacagagcatctctattaacaataatggtattttctagaatgatacgtcacttctttcatgttacatgtgtcacacataactttcacaacaatattaaataacaatgttcatggtatatatctttgtcttgacttttattttaatggaactatttttaatagtaaactcactcattaagtgtgagtttgacttttggtttatgatgtatattctcaatattaatatttatcataaactacttttagttttctaagattttaaacagaaagtgatactgaaattttagaatgagtttccagatcatttcaaaagaattaagctttttcatattggatacagttatatagtatattatgttaataatgttcataatattaagccatctttgcattcctggaatattcttctttggtcaggatggctatatcttttaatgtgctgttgaatttaatttcccagcaattaatataaaattaattgctagtcaattttttaaagcatcaaataaaagttttagatcaatttcatttatgaatataaatgtatattcattattctgctcccccactcccatcctgctacttcatcatgaattcattttgggttgtctcattgtcaccttctctttcataattttgattactctgtcatatttttctacattttctggagaaattcctatggctatccttcacaacacattcaattttccatgatctcaattctgctctgtcacaacagcaatgtgtattttatttgtgctgctgtatttttgattctgtattgtctttccatttcccacgtattttcctatccattctgtatcttcttgtttcaacccagtgtgaattgccctgctttttctgtctgcttgtttgggaaaatccccttttcaggactagagacacacacaacattgatgctaacgggtctggatcaaagccaaattggcagaatctagcagatttttatgggactctacaagactaaaggtggagggttttaacttttcctccttgccttgacctctaacactctgtatagaagggatatatgtaaactacaaaattcacagtaaatagacaggaaacttgaagtctctgattctacttgaagatcatggcttctgaaaattagacctcttaaacattaggcattgcttccaacaactgcttgctcgcagaaacgaagagaaatgaagaggcttccttcactgtaggttctatcctatggcatcagaacaagagcaatcctgcttgccttaaagtaggtataaaagtgccaagtgcttcatttctctatttttatctattcgtagtttagaaaacaaacacaaaaaataaaatctgaaccacttattacagtatccttataattgctctttgatgtatacaatcatatatacataccctcagaaatacctggtcagaaattaggagtagtaaagaaggactactactgctgaatcccatcactcaaagtttaaatccatatgtgaagttcactaaatggaatatttgtgaaaatttcttggccattctgacaattggctgaaagtcaactttttattgttcctttaattttttttttttttttttgagacagggtctctttctgttacccaggctggggtgcagtggcataatctcagctcaccacaacctttgcctcctaggctcaggcaattctcccatctcattaaatttttgtttatcctctatgtcttcatatattttagtgagacttttggagagtccacccgagtgtccaatcacaaacctaaattccttttaactggaccatttagtccatttacatttaaagttaatattgttatgtgtgaatttgatcctgtcattatgatgttagctggttattttgctcattaattgatgcagtttcttcctagtctcgataatctttacaatttggcatgattttgcagtggctggaaccggttgttcctttccatgtttagcgcttccttcaggagctctttagggcaggcctggtggtgagaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtatcccgacctttctctctggctgcccttaacattttttctttcatttcaattttggtgaatctgacgattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcgtttcacatagtcccatatttcttggaggctttgttcatttctttttattcttttttctctaaacttcccttctcacttcatttcattcatttcatcttccatcactgataccctttcttccagttgatcgcatcggctcctgaggcttctgcattcttcacgtagttctcgagccttggctctcagctccatcagctcctttaagcacttctctgtattggttattctagttatacattcgtctaaattattttcaaaattttcaacttgtttgcctttggtttgaatttcctcctgtagctcggagtagtttgatcgtctgaagccttcttctctcaactcgtcaaagtcattctctgcccagctttgttacgttgctggtgaggaactgcgttccattggaggaggagaggcactctgctttttagagtttccagtttttctgctctgttttttccttttccccatctttgtggttttatctacttttggtctttgatgatggtgatgtacagatgggtttttggtgtggatgtcctttctgcttgttagttttccttctaacagacaggaccctcagctgcaggtctgttggagtttactagaggtccactccagaccctgtttgcctgggtatcagcagcggtggccgcagaacagcggattttcatgaaccacgaatgctgctgtctgatcgttcctctggaagttctgtctcagaggagtacccggctgtgtgagcagtcagtctgcccctactgggaggtgcctcccagttaggctgctcgggggtcaggggtcaggcacccacttgaggaggcagtctgccccttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcatccttgagctgtggtgggctccacccagttggagctttctggctgctttgtttacctaagcaagcctgggtaatggcgagcacccctcccccagcctcgctgccgccttgcagtttgatctcagactgctgtgctagccatcagtgagaatctgtgggtgtaggaccctccgagccaggtgcaggatataatctcctggtgcgccattttttaagcctgtcggaaactctcagtattagggtgggagtgacctgattttccaggtgccatctgtcacccctttctttgactaggaaagggaactccctagccccttgcaagacacagactggcaaattagataaagagtcaagtcccatcagtgtgctgtattcaggaaacccatctcacgtgcagagacacacataggctcaaaataaaaggatggaggaagatctaccaagcaaatggaaaacaaaaaaaggcaagggttgcaatcctactctctgataaaacagactttaaaccaacaaagatcaaaagagacaaagaaggccattacataatggtaaagggatcaattcaacaagaaaagctaactatcctaaatatatatgcacccagtacaggagcacccagattcataaagcaagtcctgagtgacctacaaagagacttagactcccacacaataataatgggagaatttaacaccccactgtcaacattagacagatcaacgagacagaaagttaacaaggatacacaggaattcaactcagctctgcaccaaggggacctaatagacatctacagaactctccaccccaaatcaacagaatatacatttttttcagcaccacaccacacctattccaaaactgaccacatagttggaagtaaagctctcctcagcaaatgtaaaagaacagaaattataacaaactgtctctcagacaacagtgcaatcaaactagaactcaggattaagaaactcactcaaaactgctcaactacacggaaactgaacaatctgctcctgaatgactactgggtacataatgaaatgaaggcagaaataaagatgttctttgaaaccaacgagaacaaagacacaacataccagactctctgggacacattcaaagcagtgtgtagagggaaatttatagcactaaatgcccacaagagaaagcaggagagatccaaaattgacaccctaacatcacaactaaaagaactagaaaagcaagagcaaacacattcaaaagctagcagaaggcaagaaataactaaaatcagagcacaactgaaggaaatagagacacaaaaaacccttcaaaaaattaatgaatccaggatctggttttttgaaaggatcaacaaaattgatagactgctagcaagactaataaagaagaaaagagagaagaatcaaatagatgcaataaaaaatgataaaggggacatcaccactgatactgcagaaatacaaactaccataagagaatactacaaacacctttacacaaataaactagaaaatctagaagaaatggataaattccttgacacatacaccctcccaagactaaaccaagaagaagctgaatctctgaatagagcaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcatgttatgaggccagcatcatcctgataccaaagccgggcagagacacaatcgaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattatctcaatagatgcagaaaaggcctttgacaaaatttaacaacccttcatgctaaaaactctcaataaattaggtattgatgggacgtatctcaaaatcataagagctatctatgactaacccacagccaatatcatactgaatgggcaaaaactggaagcattccctttgaaaactggcacaagacagtgatgccctctctcgccactcctattcaacatagtgttggaagttctggccagggcaattaggcaggagaatgaaataaagggtattcaattaggaaaagaggaagtcaaattgtccctgtttgcagatgacatgactgtatatctagaaaaccccattgtctcagcccaaaatctccttaagctgataagcaacttcagcaaagtctcaggatacaaaatcaatgtacaaaaatcaaatcacaagcattcttatacaccaataacagacagagagccaaatcatgagtgaactaccattcacaattgcttcaaagagaataaaatacctagggacccaacttacaagggacgtgaaggacctcttcaaggagaactacaaaccactgctcaaggaaattaaagaggatacaagtggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaagagagcccacatcgccaagtcaatcctaagccaaaacaacaaagctggaggcatcacgctacctgacttcaaactatactacaaggctacagtaaccaaaacagcatggtactggtaccaaaacagagatatagatcaatggaacagaacagagccctcagaaataacaccgcatatctacaactatctgatctttgagaaacctgacaaaaacaagaaatagggaaaggattccctatttaataaatggttctgggaaaactggctagccatatgtagaaagctgaaactggatcccttccttacaccttatacaaaaattaattcaagatagattaaagacttaaacgttagacctaaaaccataaaaaccctagaacaaaacctaggcattaccattcaggacataggcatgggcaaggacttcatgtctaaaacaccaaaagcaatggcaacaaaagccagagttaacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaccaaacaaccccatcaaaaagtgggcgaaggacatgaacagacacttctcaaaagaagacatttatgcagccatcagacaaatgaaaaaatgctcatcatcactggccatcagagaaatgcaaatcaaaaccacaatgatataccatctcacaccagttagaatggcaatcattaaaaagtcaggaaacaacaggtgctggagaggatgtggagaaataagaacacttttacactgttggtgggactgtaaactagttcaaccattatggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtaaggaaatggatgaaattggaaatcatcattctcagtaaactatcgcaaggacaaaaaaccaaacaccgcattttctcactcataggtgggaattgaacaatgagaacacatggacacaggaatgggaacatcacactctggggactgttgtggggtggggggagtggggagggatagcattaggagatatacctaatgctaaatgatgagttaatgggtgcagcacaccagcatggcacatgtatacatatgtagctaaactgcacattgtgcacatgtaccctaaaacttaaagtataataaaatacaataaaataaaccctaaaaaaaaccctaaattcctatatttgaattactagtactagaatgatcactgactaaatttaacctaccaaagatatatatttttcatttcattctccttaaaacaaacattttaaattttttttacacaaaattataatgcgttataccccacattaggttttattttttttcctttcaaagtggggactaaagttgcatgtatcagaatcctctgagatgctaattgaaaatatatatgcttggccttaacaaacatctactgaattagatgctctaattccaagaatctgtgtatttgaaaagctcctcaggtgactattatcatactaaagacttcagtgacctctgctgtattataagctacattggtctgttctcatgctgctattaaaggcatacccgagactgggtaatgtataaaagaaagagatttaattcactcacagttctgcagggctggggagacctcaggaaacttacaatcatgtcagaacgggaagcaaacatgtccttcttcacgtgttggcagcaaggagaagcgcagagtgaagtgggggaaaagccccttataaaaccatcagatattgtgagaactcactcactatcatgagaacagcatagaggtaactgcccccatgattcaattacctgccattgggtccctcccatgacatgtggggattatgagaactacagttcaagatgagatttgggtggggacatggccaaaccatatcacaagcctatataaaaagggtgaaactaaagaaaggtctttgagagtgatttcaaataatgtacaaggaacaaacacccagacacaaacacacatgcgtgcacgcgcgcgcacacgcgcgagcacacacacacacacacacacacactatttctacaaaatattaccacaccctcatctagtataagcttgctattaaaacaagggtttggggatctgggaacactagggtaaaaagatatttcaacaacacaaggcattgttgttggcctaattcatttctattatgttttcattttaactacttaatagagaaattcataatttcattttagtattggagtaaactaaaaaaaagaccaaatgtttggaactattgaataaaaatccaacatagaaataatttgatccattaaacctttggcatctgccttgaaaagtacatatgtttctttgtgttatttctcagtatattaatatgagaaatgcatgaagcacagaggttaataggaatatggagaggtttactagaccacttacagtgtaattgtgacctgtcattactgtgaatttttttaaaacagtgattaatctcagtgttatatttatagattgttttcagtcaatttttttgtcaagtacaaaagtgactatatattttcatcctacaatatgttaagacattacaaaagcttaatggaataaattaatacagaatgagcaatggagaaggggcagctgaagcacagtgcttaagtgtacagtatgaagagtcagacagtagagattcccatatacctggataccagctgtgtgatgttatagaatttacttgacctttctgtgtctcagtttatatttcaaaaaagcaggcccctaattgtgcccacctgattggtttgttgtactgattaaatagcataacatgtgaaaagctcccagcatctgacatctaacacatagtaagatggcctatattctattagctagaatttcttactaagtttccaaagctcaacagcaaaatcaagatggctggcaaagattaaaagtcagtccaggccgggtgtggtggctcatgcctgtaatctcagcactttgtggggctgaggcagatggatcacctgaggtcaggagtttgagaccagactggccaacatggcaaaaccctatctctactaaaaatacaaaaattagcaattagccagcatggtggtgtgagtctgtaatcccagctactcgggaagctgaggcatgagaatcgctcgaacccgggaggtggaggttgcagtgagcagagatcacaccactgaactccagcttgggtgactgagtgacactctgtcacaaacaaaaaaaaccagtccaatcactaaatgctcctgcttgtatgcaactgaatattaagaataaaatggggtttcttacatgtctactatgtccctgaaactttcataaattctggaggagtcgatatgaaggaaacaacggctcttgcttttaagatgtttataatccaaacaggtcagtcatcaaccgaatgtgctaaatgaactgagactaattaggaacattccttggactcatggtttctgttccatacacttcttttcaaattaatacacactaattaacatttctcacaccatatcatgacagatatgtgctaagacagtttaaccttcttgtttatttttgtttatttatattatatatcgttttgttgtaaaccaggagaaatgagaaagagtgtgagctcctttttcacttcagaaaggacttagtataggttttttaaatctcaatttcttccctacctcaccgtcttcaaaatgtccttctctttttcctcatctaatgaaaaggtagcatatctgaattacttactaggcttttgcaagctcagttgaaattataaaagagatgatgttgctttggggaaaaagatgaatctgttcgaaaagaaggtgagacatatgcaggaacacaggtatttgtaacttactcaggattacaaagaagaaattaagaaggacatccaaagttgctcttggcatcacagttagactgagtgctcagacggttcatccaaggcagtaagaaataaagttttttattactatattgatggcagctacatttctagctgcatgcttacacttcaagaaaaatgcctgaatgatgcctctcatttttgttccttgaaacgaatccaagaatgtttccctaatttacctatctgactcaattttccaagatagagactgagtgaaacaggtaatatcggcccataattttaacaagggtcacagaagagtacactggcagcttttcaaaaccagagagaataaatgttagattagtaagtgacacttgtagactattagaatttaatgagtatactatatttagacagatatgacagatgttaatctctgatattaataaaaatgcctaaaagttcattttggagaaagatctgagtatgaacccagactatgacatatcctggttatgtaaactctggcaagtttcttaagtatctagacttgagtctctaagtctgcagaatgggcccaatggtatccacctcccagggttatttaaataagaatgcatacaaagtgttcaataaagttctgggcacataaagattgtattattccaaggcctcgatattcccacacagctgctatgcattgcttgaatagccagtgctgctgaggaatgcagaaatgttgatcaattttctagcaatacaagtctgtcaacataaatttccaaataccaaaaagagcacatattaacttaaatactgagatttataaatctataaataactttttttttttatagggtctcactcttttgcccaggctggagtgcatgggcgcaatcttggctcactgcagcatcgacctcccagactgaatcgctcctcccacctcagcctcaggagtagctgggactacaggcgcatgtcaccatgccaggctaagttttgtgtttttggtagagacagggtttcaccatgttgctcaggctagtctcaaactcctgggctcaagcaatctgcccgccgcagcttcccgaagtgctgggattccatgtgtgagccatcgctctcagcctgataattttcttaaaattgccagtgctactgtaagagacatagttaagtttatattaaaaggaaaaccaaggtattgcttagttgtcataaagttgtgtgaagattaagtgaaatatgttagtggttttctcacagagtatacacacagagagttacactttacacagaaatctatatatcccacaagtaaactgattttaagggaatcattttctagtttcccaatttccatatgtatgatgtcttaaattttgtatgcctgagaaacaatgcaatcaaggcatcccgctggttcttctgtctcaactcctctgtttcaacagtctttcccttactttcgaaaaaaagcatatttttcattgatctcaaatattacaataacatatacatagaatataaaaatttggggataccaaacaaaataattcaaaatattggtgttggttttgagaaaatgattgattctaatgattgagtgacaaaaattcttgcaaatcaggtaaaacccaggtttctgatttcaataaaatagaaagagcaagtcatcaagttgcttaatcacttttggtgaagatcgctaactaattttaggcttacaatggagaaggtgtccaaatatttaggtaaaatgactataataaactccttccagtttatttatttagataaacaaggatttccaatgtctacacctaaaaaaaagaataaaactgatgataaactctatttaagaataatatgtctcgatagatacatgatcaaattatttaaaaagccatatgtttctcattaataaatgaatcttcaataaaattcacttttattttgaataattgtcaatatttatgatatattcatgctgttttgataaagtataaattataaattctaacaatacaggaaatcatttatcatttaaagactgaatctaggaatttttaaaatgtaaaagtccatttatagacatatattttgttaaagagtacttccaaagaggatccttaagatgttcaaattttaaaaaaaacataaaaataggataaaatttgatggagaaattgttttaaaatatgagtttaaggaggaaaaaagaggcaaaacttcccactatttgttagagcatgtttatgaatttttaaatgggtgatgataaatataaaaaagcacagtggtgttatttattcctagtaggtttatttaaaaaatgctgaaacaatttcatttaaagaattcatatttgcaaaacatgggggattatgtcttttgctagcacttgaacttactgctaaaattctcaggtcaactaaaatgagtgaggagtatatggtttataacgttttaattgtagggtatttgtaagcataacaatttgaaaaccacagaaataatgtactgtatataaaaatcttcagtacactttccaatccaacattttttcactgaattgaattgaaacgttggactctccaaaagcatagcaagtaaagttaagctggcctgaccaaattcctttctcttctctattctgataacaactcttatcatcactcctgtataaccctggcagtctccaccttcaagtatcagacaccatgtatgtgtctcaaaggtttactatgccccacacttaaggacctcttggaatttgaggtgttttctaccagccattcacatggtactaaatttttgggaatgcacatcaggacatttgtctgtcagagaaggtttcaagcagcttccaggattgatgaataatatcatgaacagtctataaagatgactttggaagagctcagtgcatagtgtaacagtgctaacagcagggacactgcattgaaatagcatatctccaaatcattgattatctcctcccttccactaataaaaggatagcattgtctggggatggcaagaaagcagtaaattaagagagaagagcagtaagctaccagcactgctgtttcccacactttaagggtttgagaacataactaggtaaatttgcatgtaagcactgtcctagaagagagctgttatttctcaatatgctagtgtctatacaaagttaagaagaaaaacataacatttcacaatcgagaacgtaattttatccttgcctaactcacacctgtttccttttcaaaggactagtgatatccataaattgtcttcaatggcactcataataaattctctttgcataaacaatggtttccactcaacatttaatcttaaaagagtgaatgttattccctactctgagacctcaaagactgtgttccactttttctaagaattctgacttcatttactataatttgtttcagatacttaactgtgggcagagattcttatttatttatcaaatactatacccctctaattttaccattgcttaaagcgtttgacattattttggaaataagatattctaactaaaatgctcgatgatactaatctttcttcatctactgttctcaaagtgtggttcccagatcggtagcaaaagcatcatctggaacttgttagcagtgtacattctgatacataaggccctccaagccttatgtatcagaaactctggagaagaggtccagcaatctgtgtcacaacaagccttccagtttctgatgcatgctaaagtctgagaaccactgatctactggaatctcacctcaccaagaggatgttgatatgcaaaaattggctacagtttacaagttaaataaaaatatttttctttactaacatagatgaatcctgatccataaaagactcataaatataaatcttaaatcccataaattaagaatctgatttcttcttatgtaatcagacatttgcttctagcaggtttcaagatcttcaactacggagaggcaatgacattttgatagtcctctagatttaaggaataaatatgctggctgtatagtcagagtaatgctagagagtttggtctgatgcttagggatttaggacgacgaatggatagagatggtgaggaatctcattccagtcatgctctcctttcctaatttcccttttcactgtttggtcttctcccccttttccttagggagtcgagtgattgatagcctaatccaatgactgtattacagctgcctcaactaggactcttttccttatcattagcagttagcctatggttaaattcacagctcactgcttggtacagcccctgagatttaagggtctggcctttagaaaatatttaacataaaactgaaatcttgacatactgagaactcagttctctgcaaggcttccttaattaatccaatgtactgtaccattgttctgtatgagactgtgacatggtgaactgtttctgaagcttacagagatgtgtagttctaaattaaacagccactgacgtgtacctacactgattttttagtacagtagatatgcatgaatctgtgaatatttaaattcaagctcaaacagtgacacaatactctctagttttactttcataatagaacattttttgattaatttcaagcttgaaatcattctttatgaaaaaacacacacagaggaaagaaatttaataattcattaccactgctgcaaaggtaagttttcttaatatgcttgtcagagttctttggtttacaaagtctatcaaatattttcttaggaactggaacagacattaatttattttcctaatttttaaccaaaggaaaatatatataatatccaggtacccatgaatttgttggctcttaaatactatttggttctaccatttatctgcaggacaatagttatcttaaaatacctaaggaaaggatgtagaccttgatctatgctttaaacctttgcccttgctccagtctgtccatgagctgtaagcatctatgaatatggcagctgagtcccagatgaaaaattatgcatctcataaactgctattctgctgaaatgtcaagccaaggcaaggctgtacctcagactcagcacttggcattttccttctgtctgctttgttgccatgaagcaaacatgaacagtgaagatttgtgtagggcaggtagcaggcgagctcactgtcaaaaatctattattagggccctggtctcctgcacagaccaacgatggctaaacagtgagatactgaggctctgagaaaggcaacataatgaaagaggggattctttgtcaatctgtacatgaatatattcaaatgagcattatttaaatgagaatatttctaatggtaagcctctctcaaccaaagtgataatttataataaaattgtaatctagcatctgtatttgaaatgcctacttttgactgttctgcaaatatagtacatacatatttgtataacaagttctttaatagtttgatcagttaaacttgtaataagctaagaatgtttttacataggtgaataacaggccagattttttgcattacttttgtccatacaaaaaaaggaaaaaagtgagtataaaatggaaggctctccttttaattattctttttgcatgaattactacatttttatccatttaaattctatctttatctatcaggttattttagatcttcaatgttaaagcctaagctcttatcgatcaagatgattacaatagatagcttaaatttgatgacagataataggcatgtttttctaaaagcaatttatgcatcgataatcatgtgattgacacataaaaaaatccagcacattaaaaacaacttcccaattaaaaaaatactaacactgttttttatgatggaattgtaatgtgtggtgtaagaacttaaagcaatcctgccaaaatcttcagttgctggcatgcgtgaaaatagttatttaaagaaaaatgtaactaaaacttctgagtttgtaatctgttttgttttgccatctccctgattttacacaaatattcactaataaatacaacaaaataagtgtatgattagagtgggttacactggatttgtgtttacgtaatgcccagtagcacagtgtatgctgccaagttattattgcattctaacaattcacgcctaagtaactatcttaaaaacacataaactatgcgatgtgaagtcgatgcctaaaatccctttctaagctactatattgattcacatttgtgcaagttttctaaattatacactttgtactcacttctggccctacactgacgcagatctacaaattactagctaaatttctaacttgtaccttcttttattagtatttcctatgttggatttacaatgaaaacacctttaggaagctagtaaccatacaagccagtgtccaatatctcacacagctagatttcaaatcattcattattcacttgtagactctaagaacattcatggaatattccattataacttatttagaaatacacagtcatttactggattctgtaataacctctatgagaggagtaactttgagctgaaacagaaaatcttaaaagccatcttttatgaattattcagaaatcaataataaagtttatgtcttaatactgaaaaaaatgtgttctattgttgtaattgtataagttcatacataatgaataacttcaaacaagcattcaaaatttgaagttaagaacaagaatttcctttcctttggtgaaaatagaacaaatttggcaaataaaataatttaaaataataagtttttcaagcttgtgggaagtaaattatattgagcctaaagtgtctatcattatttcaatttaagtgccttctgcactctttcctatatatgtgaatgtgcatgtgtttgtaagtgcaacacacaaaatatatacaggacaatgaaattcattccccattaataaaaaaaagttaaaaacacaaggaacaacaacgaaaacttcaaatgaattcaccccattgaaaaatgcttgaatactgtttctcccgaagcacctgtaaatgaataaaggttatcctcatgaagtcagctgcaagaaagacatctttagcttatgccatgcaggactgattcttaaccagctctgaaagaatcttacccacagggaggatttcatgtgaaaatgtcacaccacagctggataacaccatttatataggtgatagtaatcactgatttgggggctatcttaagatgccctcattatttgggaatgaagtcagaaaaaaaggtcaaaatttcaaactaaaacaagaaaaaaagaaattaaactgggaaaaataatgggtcacgcagtcaaggatggagtttataattgttactgagattagggtttttttccaatcaaataagtcaaagaatttcttcttcctttcctctctccaaacccaataaactattcagctgtgtgatgatacatgaattaactgctgtttgatgcaacagaagttttctgcatggattctagaaaaaggaaaggtcgtaacaacttagtgttacatctatactgtccaaagaaaggtacagaattatttagaatcaatggtttagacagagtacttatatggtggagagctgaatcagccatccttgtttgataaaaaatattccttttggataccaaacaagatttccttttatactgttctcactatgaaatcatctggtatataattcaactttttaatggagcaatactatgatgtatttctcccataattgaaattcaagtttataaatcactttattatgagtttgtttcatatatttaagcaccgccccccagagtttaatcatctgtagatgaattagaaaaagtgcttctaaaatagcaaagctgaggataagaccttggagtgaggtcctaatttgctctcttgatgtaacttttaagctacagcaggtagaagttatctttctatagtcttattgacttcttttatttaacaaaagagacctccctctgaaacagtaactctcaaaatattttgaagttaactaagtaaaaagtgcgttttacattatggcatatataagtgtatattatgtgtataactgaaaaagaagtttggccaaacaatgcttatcccaactatatgcaaagcattctgacatttcttattctatttcattatttaaaatgttgattacagttcactaaacttgattgcatagtatactcatgagttgggaaccaacctttgaaagacattgctctcaaatccaggctacttatatcggaaataattccactgacattccttagctgagatcccgttttcccaatgcaagtcactgtcccttattagctaatgcattttctctagaagaacattcctgaaatgtgcccagttttctacagcaggtatactactccaggtgcctcactatttccgtatttaaacaaaacataatcttcatttcaaagagcagaaatcttattctgagaaaaataataacaattgaataaacagctaaagaatatattgaaaggggaaaatatccttcactggcaatgaaaagtatgtattgtgttcaggtggctatccaaaattaaactctatttagttttcactttttaaaaatctgtgattcatgcagcatctctgaaagcagacattgccatgctctgagacaacacttgagcagatattagcactgtgctatggtaaattttttaaaaatcttataaaaatatctagcttattttgtgtaactttcagtattaaggcagcatttgaagtcctgacaaccatatttgatacaactctcgtaaaatttgaaaccattattatttaacacaattttgctaggctaagttttgctataactcatactgaaggtactctgttatagaacttgctctgtcctaaaatatattatcattgcctatttaaactgcttttcagattctattacttttaaacttaagcaagcattactttaaaggaggaaaactatattaattctgtcaatgtggagaaaggctattttcaaaacagattgtttaatgtgaagaaacttaatatagaacctattagaaatgaggtacaagtcctttaaaatgttagggattttttgttgtttaaaatgaaagttctacccaggcttacctaagcttatagcccaagtgaatatttatatatgaatttataaatcttagaaatagagttttatggaaatgctaacaggccctgaggtatgactgagcttgttttcaggtactgctataatttccagtgtgtgtatgcttaaagactgcaacacaaaagactttttctaatgctgtaattttgtagttttattagactgagttatagtatgggagaatattcagacattgcagcttaaatgagaaaacatgaatggtgttacttatataaaatactactgcaatagttcttttattaatttttaatgttcagcaccctctgtgacctcctttattctcttgctgtcaacatggcaggctggaaaaattgaaatgggctgacagaaaacatagtgcatgttacagcccaactctggagtctcttgactctctttctgtggcacatgctaacgcggtccacgttattctgcattacaataatatttaaggccctgtttgatagctcctgataaaagcgagctgtgtctggagcctgagcaggtgctcctcgtcagccttcttctttctgacattgtgggaatggcattcaattaaaagcagaatataaccgtttttgttcttcatggctcacaggcatacttcatactctcaaaactgaatacctcagcatggatagagctttatttgtgtctgtccagcctcttccaaaagcacattttggtctgattcagcaatgcttttcttgaacagtggggcactgttatgttatgtatatttaccactttctctatcaccaaggagactaatcccaaaccagtacagtcaagaaccttacagcattgtctttgcaagaccaagttcatgttgtcacagtcacagagtgcacagggtaaagatactgaacaggaccttgagattaaaacctctctttctttttcaaattcaagcgtatgctgatgagaaagagcgtgcaaaggtgtgaggtctgcaaatgtcttgtcagctgatgcttaattcagtgttttaatggcttgtttgggacagttgggacaaggtttttgaagaaggtagatgtctaaattctaggaagaatgaaaactagtccagaccatgaaaaagatattataatgagggtacttatatttttctctcagagggccctcatattaacccttactagtaagtggcaaaagaactgagagacgatgagaaattcttaggaaagcatggaccacaagagaatagaatttgtgcaagaccttatcttgatattctctcatcctgtgctgtcacttgagctttcatattcaatccgttctgtcataactattaggaatattgatcagctatgagttataagaatttgggatcataaagggcacaaaactcttgcaacatgaccttctgatttttcagcaacctccaagaaagcacaatgcaagaagtgggcaacacctaccagacactcctccatatgtagttcgctttgcaatccccactgctggccaaggtgtgccatcagattttaatcccatcagacctgagacagtgttggtggctgtaacgccattggcaccacctatgcaagacacatcaacattttcatgcagctcttataagacacgatagttaaaacccattcaaaccctcacatcccagaaaaatgcattctattttatcttgagaacatgtcttctcctcaaagttcttcactaatttaactcctacatttatgtttaaaattttaaacattaaagaagttttaattaccacaactttactttctcaaatattatacagacttgttgttaccaaatgttttgtatttggtgttattttccaggtaatttacaatgtctttgcaagtcagggtgcaatttccctgggatggaacacaagcacgcatgatttttgtattcaacagatatttattgagcatgtgtttaaggaagtcagctaggccctacaaaatatgaagagaactcataagaaatttcacattgtgcaaattgaattttctttttttcttttttactcattaaagtttaatatattgaattgttacattatgaggtcatttattttggacgggtttgctgtgactgtgttttttgttcttataatgtgtgaaataagtgtttattaggaaaaactataaaggatcttgtgtttccagatcaaaattcatggtcaatttgctagcatgagtccaggtgtaaatctcctgtgtttgtgggatcaagtgctcaactggaaacttttaaaattgagacaaaaaatatgcacatgtttgtaggaaaagacatacttgagtatggctacataatgtgggccaatatttacaatagcgggcaactgattcaagtcaagttcttaccttcctttgcagctcttgcgatgctcacaatatcagtgacatttggggtcagcttggcaaaaaaaggaatctgaacagcttgcctaacccagcggcagatgttccgcaccagctctggatcctgttcaaataggtcggttaaatatagaacaaaattaaagaattgtgatcaaaatgtgtactggaacaacagcaaagctggagacgtgcaagacaaatccaacttgacaatgagctacatgatatatttctcaaattcctcctcagtattacacctagactcattagggaactaaggttaacacacttcaagtgaactgcaaattcatcacataaaggttaaattcctcaacagagcctttagaaaataaaatttcaaagaacaaaatggaagacagtgtttcccactttcagttaaatattatcaggaatgaaacacaaacttttgatgttaagtacaagaaacattacaaaatttctagtgatctcattggtttaagcaaaataaaaaatatttaaaactgctgactcaagtgaatgatattaaatctaaagcttgttttcattattagacttagtcttgatgtgtattcaaaataaaatctatgacttcatcatcaatctacatgtgatatatagtatatgcaaatatggaataattcagccttgtattatacatgagctgatcagtaactttaatttacttttgtaaatgttaccaagatctgtgcagcattttcagcactcacaaacttgacagaattgatcaaaatgacaaaaatgaaataaaatatcaaatgctcattttaaaaagcaagaaatagacatttccatgtgcctattttctgtgattttccaggctcttattttctcatggggcaagtatcatttagagggcaaacacctatcctctccattgaataacttagctacagtacagtaatgttctttgatttcaacacatacaatagtcctttttttcattacttttagtgcaaaatttattctgacaggtactgataatgtgctttgataaattaccttaaagtatgcaatagcaattcattatcgaacttggtaatattatcttagcaagttaaaatgtttttgaataaaagaaaaacccagagaaatacagtcatatatttaaactatgaaatagcaggcaagcatatcatttgtaattaatgtttttgtatgtaagaaagttgctctttgcattttaacctttcgaattcctttaagatgagatttgtaatgttataacctttagaaagaaccttctcacttaggtttaatgtgtcttgatccatcatcctgtattactcaaaaagttatgcatttttgtgctaagatactgcaatgaggtaatttctgttgattgttatcatctctattaagcaaaacttaatacttttaaaaagaagtctttggcttggcttattctctttttagaacagtaatttcttcattaaacataaatattaaaaaagtgctatatggaatgctctacagggcatagtgtgcattatgaatagtaaaatgtggagacttagctgtacaaattctaactcatgaaaatggagatctgcccctgcccatgcaatgctcatgaaatatttataaccactgcattggtattatgaaggcagttgcatctttgtgactttcatttctaagttatgaatttccatgggacttagcctagaaatgacagtaactctagatgatatgaattgcatgtcctttgtggaagctctctttaaggtagactttgacaataatttaaagatcacttgaatggcataatacatggaatgtgtcctgataagaattactgaaacaaatttgaaatattatttggttccaatagagtaaacactaataatctgatataggcttccaagtggctttcaatactattgacccccatgccataataatttactctgaacatctgtcagacatttttcctgattttcactaggtgactgctttaaatgactgcctcttacccattgcttaatgatctggaatttgttcaaagtttttcaaattcttagaaacacatggttttttttggttagcactgtttacttgaatcatctgtctctattttgagataccataatttgaccctccatgagtaaatttgaccctccatgagtaaagttgacggtgttcacatatatttttctcatcttcatacttaggcaagccagctgctgactaatcatcacagccaagggtaagtacagtttggctacctgagaattttaaaaacaacttctaaccaaaattaccataaaaattaatgattgttctgtaaattgcaatgttttgtttgacaggtataatagagaatattctaatacaactagaaatgtggtgaggtcaataacatcatgaaatgaatctatatacttcagggaattcacgaatagactgtaactatttatattttcctggtttcttcaaaattttgatatgaatgttcaagatctaaaagcaattagtagtgtttctacatcttgaccttctcattttctagtgatagcatgagatggctttgccttttgtaacaagccagtttttagaatcttattgaaataaataagttttagacaatttctaattcttcccaaaatcttcaggatctgaaatatacaaaagtactcttatctctcagacaaatcaagagtttaccattaccaatacatacaaggagaagaagaagaggaagaaggaaaacaaaaaacaattattgactgctctatttctgggcactaaaaaatatatgttgtgtcaatgaatgagaaatgagtgaaaacttggcaacttggcatattttcacattatttccttatatatccatcaaaatataaactatgtctagatttaagaaaaacccagctatattttatgacaatgtccaaaagcatgaaatgtaggaagactactttacaaatcactggtaattctgtgaaaaagtgatggataattaagaaaaacagaatagcttaacaaaatcttaaaaatgtctaatacacaaaaacgtctacgtagatcacaaaggctttattggtgctttctaaaggcattaatgcttctccctgaacatgatttgcaatctctgtcacagtagttgcttgtcttgtgtgtgtgtgtgtgtgtgtgtgtgtgtgtgtgagcatgttcttcaatacctgttaacccttttgctattcaatgtgatcaccaaagaaagctctgaagcaacaaaatgatttcctgtgacagaggtgcatggcattataagcagaaagacacttgaagcccctaagagaatgagtgacagatctagggagcaaatggtggtcttgaggatactacataaagtgaaggtaccagagcagacttgtgaagtgctgagaagagttttgataaaagcaagctagaggcaaatttggcctatttgaaaattttgatgaggtacagcccagtgtctgcctgcaactaatcttatcgggaatagattcctatgaaaatcaaacaacggtgacaacacaactagaaaaggtaatgctgaggaatgcagattacttgctgcagtaatgtccattatgcaaaactggttgtttttaaagcttaatttctaatctgggacacaagataataatttttaattctagtaactactctgtatttagttacacattaagggagttctataaatgacccatcctgctgcttttgagaccctgaagatgacctcttcattgtagagcaggtatttctaccaattacttagggcatcaaatctcactggtttcatgtcctctgcaaaggaataagcactacagaatgagactgagaatttcctgataagctaaattacaagtgaaattttgacttgaagaaacatttctctcccatttacctagtaattttcactctgtacaattcatttcaaaatggctttcttagaatctggcatttcaataaatccactgcaaaattttaccagttataaaatgtttttcactaagcaactcttaagtcttaattcatatgacatgccaagaggtggctagaattttcattacatccatgtttctgatggaaagaactggggcccagaagatcaatctgagtaccaatttcaccttcttaattttctttcccattatcatgtcctaaaccttcatcttctttagcaaaattgctccctgaagtgaaattcagccatcaattgtaaactagaactatcgaaggcttctacttcacttattcctgtaagactagaagtagctgcaacataatgagcaaacgtgatgtattatccttctatgtcaataaaacaggacaggcagtcaactgttccaggcacaattataatattagtgaatgcaaagactatgtgttgaaatggagatgtttttattaactattttttagcatgtgtccttcttgcatctgtttttctgacttaagtattctaaaggtggtccaaccactttggaaattagttgtgcagtttcctaaaaaggtagacatggacttactaattaacccagaaattcaactcttaattatatatacaagtgagatggaaacatatttctacattaaaacttgcacatgaatactcacagaaactttttcaaaataggcccaaatttgacataatgccaatattcatcaatatgtgagttgaataaacaaaattgctgcatatccacgcaatgaaatatgattcaacaacaaaaagaaactaatgaatcatgccacaacttggaattaataaaacaaaatgatgctaagttacagaagtagacattatatgcatacatttattaaaattctgtaagaggaaaaaccatgagtatggaaagcagagcagtggttgctgagactgagaattaggctggaggagcaattaagtggaaataagtataagaaaatttttgagggtaatggaaatgttccattttctttaaaggaaaactattgatatatttgaagatattaaaattaaaatgttaatatatttaaaaacattgtgaaaagacaaggcacaaagtgggacaagattctgaagcacaattcataaaggagtagtatccagaatatataaaggaccacctgaaaattaatgagaaaaatgggcaaaactttaacatacttcgttcaacatagcatacttcattggatttcattcaagatgaaatccaaatggccaaaaaatttatgaaatgtgatcagccttatgaacacctttcacattttttccatataaggacaatgctcatttaaaccacaatgtgatgccattatctatctaccagattggggggttgggggaaagtcaatacaccctggggagaatgtaaatcagtacaagagtctttgggaaacagtttcacatgatctaggttccactcttacgtatatgtccttttaaagatgcaaactccagaatacatgttcaaaatatccatagtagcactgtttgaaatagccccaaagtggaaaaaatccaaattgtccatcaagagtaaaatgaaaaataaatggtaatatagtcatacaatggaataaacacactagagctatatacaatgataaggattaatctcataaggcttagcaaaagaaaccagtctcaaaagtatacaatataatttgattcatataaattccttaaatagaaagtaaatatggtctttagagacatatatatgggtgataaaactacgaagaaaagcaaagcaaagagtagggatggtgttaaagtggacagagagggttgtgttagggtgggacatatagggagcttttgaggtgttggagatgttctatttcttgacctggtggtcacatggtgtgcacattatgagttgttaaaaaatatatatgtgtgtgtgtaggtatctgtttataaatgcatacatatatgtttcatgtatgttgtctatattccacaataagaaaatatacaaatgaccagcaaatatgaaaagacatcgaatctcgctagtaattagaaaaacaaaagaataaacatgatcacctatcatgatttgccgaaaatgtaaagactgataatatccctctttgctgaggttgcaaagaaacaggcattctcataggctctcaataggaaagtaaattaataactcctttttaagaacaatgtggtaatatgtataaaaatgtaaagctcatcttataagttttaaattccaattccaaatacctagcctaattaaatccacatgcattcaaaatatgtgtacaaagatgtctgccattcactacagcattgtttgcagtagtggaaaaaaagaataaatgtcaatatgggaagatttgtgaaaagtactataatccatacaatgaaatactatgcagccattaaaaataaatctttgtaaactgacatggaaagatatccaaaacatattaagtgaacaaaagcaagacacagaataacacacagatagcctaatcctgtttttaaaatataaatatgtacatatatttatatagaggtctgaaaaacagactatgcatttatgctgtaacctgttagcagtgattacctctgaaacgttccatattttgaatgtggtataatcgggtatagacatttgccaaaacacatcaaactctatacttaagtgtgttcatgctaatataggtaaattatttctaatatagataaatttcatctattattctaaaaataattctaaaggcactcaaatataaatagaaaaatgaaagaaagtggcattgtaggtaatgtgggttctacccttttggcaaatatttattgaccatgaggcactacaaattttccgtgctgaacactaagatgaatgaaactagagtctgcaaggaaatgcaaaccaggcacacaataaaatggacatctgatattaagtgtcacaaaagacaagacatcctgaaagtgttctatcatttcagcttatttcagagcatgtagcgcagaacctgacacatagtaggcattcaacagtattgttgaattgatagagcctacaccacacaaattgacactgactttcttatttctatgtacttggaggaaaattgagagtacagtatactgggtccaggataacataatagataactgttttaggtactatattggataatacagatttagagatatgtaatatgctatccctgttctttaaaaacataaagcaaaatactttacaatctaggggagacaaatgcatacaacaaacacataatgtgattataaaatgttgtaactgtatatacctggaatgtgtacatgtgtgcctgtgtgtgtgtgtgtgtgtgtgtgtggctacttccttgtgccttaaatagaagatgacatagacccacctgtgtgtcctctcctccccaagcacatagccttctctattctgtttctcatttcaagttttttcttatttttctctttctacctggaatgcccttcattttttgtcccttgaataacacccttcaacgcagccctccatgacaaatccttccatctcacttcagcataggatggattagtaaatgactgcctctttagtgctcctataatgtttctttattactgcatttatcacagtgttttatagtcatcttctctgttccataatcaatttctttctactagactattagtcttttaggggatgtattttactcttttatcctagcaaagagcctggtacatgaaagacaataaataccatgttgaatgaaagaatgaagaatttctaattgcataccagctttccatcatgaaccacaaaacatttgcatctcctcttccatggagccaaaataagctggagatacaggatattagcagctcttgctccaggagccaactgagtttgaaaacagtcttttgatgctctccatcagtgagctaaaatacttggagagaactgtctcctactgtggcctagaagtccacgagaacccacctgaggacccaggctgaccatgatcctttctgtctgaacctttaatatattgagggcttttccagagtttgtacctctgaccctgaccctgcctcaactctcagtctttagtccctgggaccttgaggggaagggagatgctgtccatatttttatcagctaaggggaactatattcctgttttgttcctttaaatatcatttctggtgaacataacttaatgatgtttttttcttcctttcagacaaaatttccctagtgtaccattcctctgacattcttagtgtcaatgctccccattccacttagtcgctaaagctttctttttttttttttttttttttacaaatggacaagaattgccatacactactcactgtttagttaattcctgactgccagcgttctttcaggcactattttaattctctgtgaggactctcagatcctctccaccagctcacttctttactctcaaatggcagtgttaattgtagagatcagccctgaaagctgttcaaatttcagatctcctctgccacaatttgtccctatggaatcagattcagatttcatagaattatcttgcttctgccggctaatcccaacaggaaatccacggcctcacctggccatggtaatgaagtttgagaggtacctgcccaaataaacagatcaatgaacaccttctgcccacagtttcatgtgctattctagacactgagcctctcaggggcactgtagcactgttgctattttaatatgtaaataccttgtctctattccaggaatcccatgttgcatcaaagaaatggaagcagggctcagaccctgcatggtagagggggctctgcaatttaaagggttaactttctgcaatgttgaggagtcgcataacttttcacgagaactgatgagtagatatgctaaagtaactaagttctgaaaacgtctaagaaaaatacatgcagaagcaggcaactgcaacagacacagacatgaaccactcggatctaccttcaggaacagactctggcccagctgcaggagtgtggtgagctgactgcctctaactgcttcctcctttaggtgtgcctcgcttttaaactggggtcatgctcctttcagggagaccccagtgaatgatagcaaaactgtagtacaagggtctagctatttccggtgaatgtgggactcctctaataggcactttttgtcctgaagctccctactgggctagcaaagacttttcttgtgtctgtatcagggtccaatggctccccttttccaattttgcttccacttttttcctttcacaagcatttctctccaataaacctttggccctcctaactccctctctgtgtctgattcctggaggactcaactgacacaacagttctctacttgtatgaagaattctccctgtaagaggattacgctatattctaggaaagtcaaagaagaaagaaacttgcccaagtgaccccaggatatcttactgagaggaattcaagaaagctacgctgaatccaaacgaatctctcaaatttcttctgaattctagttctacccttggcttgacagaacaaggtctcttggaatgtcctgaatacagttaagccttgttggtgacctacccagcaatagccaatatatgctcaggggaaagaaaaggtccaataccaggaagcagggctaatttttttcctagaaaaagactgcttttagggacatggtaggagacaatgattgagtgacctctgcaaaaagacaactcagagacatccttaaagagtttggacacttacttgatcttttgattcagaacttgctcaaactcactattgtgatgtgggactctggaagcaattgtgcaaatgcccatggataaaggacatgatgcctttgtgtccgcaagacaaaattatccatcaagggaggatggccagaggaatcagtgtagatgctaatactcattccaattctttgtctcttacagatgcaatcaatgacaaaccctttaaaacatcactgagaggctgggcacattggctcatgcctgtaatcccagcactttggaagactgaggagggtggatcacttgaggtcaggcgttcaagaccaccctggcccacatggcaaatccttgtctctagtaaaagtaaaaaaaagaaaaaaaaaaacaaaaaaacaaaaaaccaggcatggtaacacatacctgtaatcccagctactcaggaggctgaggaatgagaatcctttaaacccaggaggtggaggctgcagtgagccgagattgcgtcactgcattccagcctgggagacagagcaagactctgtctcaataaaataaaataaaataaaataaaataaaataaaataaaataaaatatcattcattgagaggtcagatgaaacttcttccaggtgtgttgggcctccaatgccctctgttctgaactgtactccattctaatgtctgccttagctttcataatccattctgcttgtttgaagtctagttctccctttccgctatctgtactctacatttctagactttatccattgttcacttctttctggattggatccctctgagcctctatgcctgcctgaattgacctaaagttgcctaccttgcacccaaaattgatccatgacttgtctgtcacttaggggcagccattcctttctgccttataatgtttttctttacctatggtgtatattcccaggtctatttcccttgtctttaattttatcatgttttttttgtaaaaccaagattgacacaggttccataggcctatcttcacaggcaaacaaaaaactcttcgagagccatacattggccatatttcgcagtaattaggacacctccaaatcttctacattaaagcatttcagaatagtttattcttttgttgaatcctttatactgggccaaaaaatgagcttgaactttctttatgtgtgggatattatttatctttaaattaaaatgctagttttatctaccatacaaaaagggtgtcatccatagtttgcttattaatgagggtatgcagcataatttggaagatcttaatatatgcagaaacaggtcatgtacacattttcctgataccaccagtaggtgttcaaaattgtggaccagctgagccaaaatgaaccccagcaggtttcctaatcattgcttagaacacattaaaaagacctcagtgggttatgaaatataggcagctgcttgccctactatgtatggattcattttggataagggcaagtgtgtatgtaaatgtataataaggagtttttattctttgcagacttcaagcagcttggcatttgttttcttaatgcaaagcattagtgtaaacagtataacaatttatattttatacatctgctggtctattcacttagcttatgtatttcagtgctagacttagaaaacaaccacaagcataaaacctcagtatttttataattccatattgaagtgaatgattaaccaacacagggaggaagctagtgtggggcaccattctgccctggagcacccaccatgctgatacatttaggatgaagagagtctagggaagtcacgcttctgtcctgggaatgttatgaaatccaagcaagaaagaattactattgaggcaattttaaataacctatcagagaaaaactgcaatcccttggcaatgaatggttccgactaaggagaactcatccataacaagttggtatagttctttaaagaatttcaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaactggtaccagccgctgcaaaatcatgccaaaatgtaaagaccattgagactaggaagaaactgcatcaactaacgagcaaaatcaccagctaacatcataatgacaggatcaaattcacacataacaatattaactttaaatataaatggactaaattctgcaattaaaagacacagactggcaagttggataaagagtcaagacccattagtgtgctgtattcaggaaacccatctcacatgcagagacacacataggctcaaaataaaaggatggaggaagatctaccaagcaaatggaaaagaaaaaaaggcaggggttgcaatcctagtctctgataaaacagattgtaaaccaacaaagatcaaaagggacaaagaaggccattacataatggtaaagggatcaattcaacaagaggagctaactatcctaaatatttatgcaaccaatacaggagcacccagattcataaagcaagtcctgagtgacctacaaagagacttagactcccacacattaataatgagacactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagcactcctcagcaaatgtaaaagaacagaaattataacaaactatctctcagacaacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaacctaacatcacaattaaaagaactagaaaagcaagagcaaacacattcaaaagctagcagaaggcaagaaataactaaaatcagagcacaactgaaggaaatagagacacaaaaaacccttcaaaaaatcaatgaatccaggagctggttttctgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagcagttgaatctctgaatagaccaataacaggctctgaaattgtggcaataatcaatagtttaccaaccaaaaagagtccaggaccacatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatacagcatataaacagagccaaagacaaaaaccacatgattatctcaatagatgcagaaaaggcctttgacaaaattcaacaatgcttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaagaaataaagggtattcaactaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaagtcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagagtcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattacagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaaaaacagccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaacaaacaccgcatgttctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaataataaataaataaataaaaggaattaggaagggaaaaaaaaatttcttcccactgctgctgtaggagctggaaagaaatatctaggccattttgtttgtttgtttgtttgcttgcttgtttttgccagctctgtggactgatatccctttttgaggtaaatactcaaaactaaatactaaaggaaataataatactaaggaaatactaaagtgggtgactttggtagaagtctttggtgataatgtgggatagagaaggctttaaacatgaccttttgtaagtgtagtattcacaaattcaaaatgaaattcatggatactggattttatctaaaatctttagcaatcttgaacctaaaaatccttgaatatatttattacactcatgtggtggtttataagcatacatgtcataaggggtgtgtctgtgtaaaaagagagttctctattttaatctttcaggtgtcaaggaaaggaaacatggcgaggttaccccattttggggagtttattacaactatacatggaaaaataaaaaagtaagtgaaatgtttttggtaaaggaagggctaggcctctggggattgggacaccataaatcattttgtaagacatacagcagctctaaagagcagctcctgttttcttgttgttactttaggaatgggtgtctattgttttaaggattaaaaactctgcaatacgaatacatctgctcttatttctcagcatctcttattccatttctacttctactcactttctcctttttcctatattagctttttggttctccaattcaatttttttcaaaattgagttgaacttggttttccgattcaatttttttactattttttatatatatatgcatatatatgtgtgtgtgtttatgtataggcatatatatgtgtaaatatatatgtatatatacatatcatatatacacgtatatatatccacatatgtgtatacatacatatgtatatatgtatacacatttatatacttatatacatatgtgtatatgtacacgtatatatacatatgtgtatatgtacacgtatatatacatatgtgtatatgtacacgtatatatacatgtgtatatgtacacgtatgtatacatgtgtatatgtacacgtatgtatacatatgtgtatatgtacacgtatatatacatatgtgtatatgtacacgtatatacatatcatatatacatatatgtgtatatatacacgtatatatacatatcatatgtacatatgtgtatatatacacatatatatacatatcatatatatacatatatgtgtatatatacacgtatatatacatatcatatatacatatatgtgtatatatacacgtatatatacatatcatatatacatatatgtgtatatatacacgtatatatacatatcatatatatacatatatgtgtatatatacacgtatatatatacacacacacatatatatacatatatatataatatatttaaaaacaaatccacagagaacaacactcagtacaaatagcgttctttatattttggctgtctgaaatttgacttcccttcctatttgcaggaaatttaaatcatatgaagcattggtaggacacaggaactatccccatttcgcaagtctttgaaaagagggtcttactctttctactgtcttgcaaccaaaaaaccagtacatgatctaggcctaggcaactgaagatccagcccaaagttttaacctcacaatcagaaaagtggttaaattgtatttgtggtagtgtgttgtgcagcatctcctgacagtatcccatgatggcagtagtggtggatatcaaccctggtagaggctgtattagctggacaactcttggtgttcattctctgagccttttcgttttttgcccattttctaagcctgctgttcctgccttctttgattccataagccatcttgtatcctgccaataaatctcctttcacttctgacagccagtcagtttctgttgcttgcaattaagagtgttaattgatacaggcagttggccactatccagtgtggagtgacattattgcctgggttatggcatcacacttcctgacaagttgctgacctctttttatttagtctccaagtggttgctttttgctcagggatacaatatctggtccaataaattgtggtcaaggtagccaggacacacacttttacggcaggtgtatgccaaatactgcttctgtttacttttctttagaaaggagctattggcctggccgagcaggtccttagtttcatggactatgtggaaattacaagagtaaggcatcaactttgtcctcaaagaacttacaatcaagttatagtttcagttgtgacacttaaactatgtcaggttcagcagaatataaaaatggcctttagaattacaatacatctctattcctctataaatcatttagcattttaatatgtcataatgagtaagccctcatataattcaggagacccttgcagaaagaagtgataaatatcacccagatccaggaaagctttatttgaaatgtattaacagtggctatgatttctacaagatggatatgtagacagagaacagtaatatagtccataagggaaaatatcttgaggcactgaagttaaattaaaatatgatctccctttcattctcaatacctgcatgattaccaattcgacaaggatctttcatttatcccaactcaactttacagaagtgcctgaagcctacattgttgataaaacagttgatgaagttttcatgggggaaaaaaatctttaaagtgcttgatatacaaaatcatattagtactaaaacagatgggtatttacttttgcaatattcaacaaatgcagagtacccaaaggactgctaaatttagatagtttaaaactttgcgctttttttcacttaacaaggaacatactatggtgaactttgctggttatgtaattaacacctagaagcagcagcacctaattagatttttacatcatctgggcaaaggcagcatccagcactataaagaagtctttatttcatacctttcaaattgctactattcctagaacttaacataaaactgctaaaatcacaaatgcaactcacagatttcttactgctttttcctttttttgaaagtgaataatttgtgggaatactgaaaccttctgaatctggaccaatgtccttaaatgagcacttgcaactatcctgcctctaaccatgaaagctttacagtcttcatggtttaggccattctgggtttggtaaaataaacagacataaaaatgatccaaaacaatctgctctacttgaagtgtttatgaagtgaatgaaaacttagcagtggagtgattactttttattaacttctagagtgtgtgtgtatgagagagatgtgaggagacaacagtgaaggtgattgtagtttggaatcttgagggattcacaaaatcactggctggagtagagcctatggaaaaatgtatgactaaaaaatacttaagaaaaggttcaaaagcataggaatgcatggtatcatatgaaatgggaaggaaactagtgcatatgaaggaagcagggaggagacatgtccacatggttcagctagagtttagggtcaatttttgaaagattttgtgccttatcctttaggcaataagaaaacatggaaggccatatgtttaatccatgttttagaaacataactcttatatatgtctatggggtgagagtataagagtccaagcaggagaccaatcagaaagagaaggtatggctaatgtgaaacaatgtcagtgaaaatcaataatttcaagtggactaggatgttattttaaagatgaatgttaaaaagtttcaagataaggacaaatcagagttggggaatgaaaatttaaaattttgcagatttcaattgctggaggatagtaatgtattcaatcaagttaggaaacacaagagaagcaggttttggcaagggctggggaagggtgaatgaatttcagatacattgagtttgaggtctctatgggacatctacctgaaagaatctggttgagagttaatagaaatctggatctcagaaaggagttttggaaacatagatttgagagtcattggcataactctcaaattaaactctaattagtagatggtggttgatgtcttgtgaatggatgagaagatggaaggaaaagggcttaagctttgggatcattaatactaaggtgcagaatccttataatggtcagagagagaggagaacaaccaggaaaaatataaatgagaagaccacttcccctaaaaaagatgtggatgaaattattgaggtaaaatactgcagagaaattaggtagaatgaagactgaaatgtaagtaatagaatataccactcacagttattggcaacttatgggaatgtagttatagacacctaataagatggaaggcagattgcaaggggttaagaaattaatatttgcaaacatatagtcaaagaaaactaacaataaattaatctgaactatcagagtctataactgtgttttacataaaatacgtataaaacaaatatagcaattaattatcattttacagttctcacaattagaactaatgacatgatgaaagagatcatctgttatgttacaaggcaataagtgtatgtaaagataaagagattataagacattttaaaataaatcaattgtggtttaaacaacatcctgaattcttacaatgtgaaaccagcaactgtctgagacaccaaaaatgaactttgcttattaaacacataattgagatcacaggcctaaataggacctgaagaagttcccagacaatattaaaactaacatatataccacagttaatgattttccaagtcctctcacctattagctttacggtgcttaaatcattccagctttcttattttctttcaaattatccctagcaacagatacagtagactctgcttctcataatatttataatcatcaaattccaatgaatatctttcttatcctgctacagattaaaatcatatctacttgtcttaccttgaatgagaaaagaaacaactatttaccataattcattcaatattcctacattatatttttcaaatgttattttcctgattataaaaaaagttcttaattattgtggaagcaaataccaacttgaataaagaagaaaaaactaaaattactcataatgaaacaactaaatagaaataaaattaaaaaggtctatttcctttgagtaagaaaattttactcctttattgagtaaatacactgtactcaaaatttaatgcttatcatttttagttatatatccttcatttttatataaggtgcattccctatgtcactaagcttctttaaaaatactattttaacagtcatatatttcatataataatttataaatcatatagatacaccctattttacttaattatttatttctcaatttttggatgttgagattatttccaggttttgttataaataacatggcactaaatctcttctaataggtggtgctcatacattgccttgcttttgatgctacgtgctgtgttcataggcaaaactgatattacaaaaagcaaatacataacaataggcatttagaagatataacttcttagaagaactgggtaatccatagctctgggcctggcacaagcaggaactttgatgctgtatgttaacacaagggcaactgatgaaggagatataagtgggtatttcagttgatgcacgatacccatccacaattggtcttcaaatctcctctgtcctctgagagagagtagagtatacagggcttctatgtcttgctcacatacagatctcctctcagatagcacatgcataattcgatttgtccacaatgtataatctgagcctatgttattcataatagaattgcctaaaccttatacaccatagagatgcctcttaagaaataaaacagtaatgctactatattatagacatggttatttctaaataattaagaaagagacaatagcctatataatacatataaatcatggcatgcagcgaaaaccagtcactatatagtatgttaggaaagtcatattagtctacttatgtttaactcccaggccagagtttattaatgttgtttcctccatccacaatatccatcccattcatatcacacacacttgctcctgcccttgagtgaatttactcatttacttttccttcagattttactcagatttttgcttaatagaaatgtacttaacagatgaataaatgaatactacttgttatataactggatactatgataaaattatttgaaaagtatcaatagtgttataggtatccaaaagacacattagttagaaaagataacagaactatatcctactagaaaagggaaaaatggtcagattacataaaatataggtttacttttacaaagtatacttaagtagtattttgttaatcatttcagagttatagatttacttttatacaaataaatgtacttaaagtatgctgaaattttactgtgattatgttgcaatcaattattacagaaaagttgtgaatattcaagttggacttatttgtatcagctctttacaccaaagggctttttattgtatgcttttgttttatttcacatttaattaaagctaataatttgtttaaagtttgattagagaaaatattttccaaggtgagtgagaaacaacttctgaatattacttcctagatttttggacaatttggtaggatgaacttaagcctaaagcacctattaaacaagaaggaaaagaagaataatagtaaatctgaattttgttaagatttcatgaatagaaatgagcattacaaaaagatatttcaggatgtggaaatgctaccaatttgaatactgcataaattcatttttgtggtgatgtcactaactttgaattatccgtattagagtgggaacagccatttatattacaagcatattcaaaataaagtatatgtctctttgggatgtaatcagcattacaaatgtacactgctaacattctttattttcagtatttaatcctgtattaaagtgatgtttgatgagcactctgtggctactaatgggtaagggtaagaaataattttgaggctgggcgcagtggtttacgcctgtaatctcagcaatttgggaggcccaggtgggcggatcacctgaggtcaggagttcgagaccagcctggccaacatggcaaaacccggtatctactaaaaattaaaaaaacaaaattagctgggcatggtggtgtgtgcctttaattctaggcactcgggaagctgatgcaagagaatctcttgaacccaggaggtggaggttacagtgagccgagactgtgccactgcactccagcctgggcgacagagtgaaactccatcttaaaaaaaaaaaaaaggaaagaaataattttgagaccccatgcatgaatggcacactagataaatgtcttaccctatgtttgaacacagattcacaaaagaatgactatcaggtcatttttaccatgtttgtgacttttgatgaaggttaaaatttacaaagaatggaaatattttgatatcttatttctatgttatttctggtcacttctagaacaccaaaatatgcaatgtatttccatctcaaaaaaaattcaagtcctaacttgactacaactttcgttattatgtatatatgtatataatcctaatatacaagaaacattttacttatatttcttaattcctaattagatagtgaacaactgtttggacattaaatttcctgtattttgccctgacacaatataaagtgaatcaataaaaataaatactgattttcctggctttaaaagaaatcaggatgagctcaaaagcagccctaaaaaattgaaaattgaaaagatgataagttcattctcttttatatcactccttgttgtggttcattgttataactgttgtttaattaatatccaaacttgcataataactaaagtatgtgaatggtaaacagtagggtatcatcagccataattatcttatttgcctagtagtgggctgcatgttatataaccagtctgtaataatccttatttgatgatactcattaattcattcactccacaaatatgtattcaactgctactctatctgccagagctcgacagtaataagacaaagctacttttctcatgaagttttcattctagtggaaaatatgataagaacaaaataaataagtaatataatttcaagtaggtgatttaaaaatatacaacagggcaagggatgagggggtagagagtggctgtaagggtgtggtacactggggatgaattaccttggataaccttttgggaaagtcacagttaactccgtatattctataactacacaaattatccatttgcttttatagttgcctttaaattattttaatttcatgaacttaaattttgtctttgctcacagattttgagttgctcaaagttagagatcatgtattttttcatcatgcaatatcatccacagggacaatcataatattggtacatgaaagacacagtagatatctttgttgactgaatattaattcttgactaaatattcattacttagataaaactttttaaaaataaaacgcaactgcaaagcaaatgtaatgctgacatatttcatatgatcattgcctgtctacatgatccagttctatataacacagtaagaggaaactgagatacaggtgtgagaaagcttctaagagttaggataactcttagccaagtcactagctcacaccagcctcatgactcaaattttttgcaaacctatatattgaggatgggtgtggtggctcatgcctgtaattccagtgttttaggaggtcaagacaggaggatcgcttgaggccaggagttcagagccagcctacgtaacaaagacctcttctctacagaaaaagaggaaattaaaaagttagtcaggcgtggtggtgtgtgactgtagtcctagctacttgggaggatgcggcaggaggctcgcttgagcccaggagagttcgaggttacagtaagctatggctgtgcgactgtactacatcctggatgacagagcaagaccctgtctcaaacaaacaacccccctgccaaaattgtgtattggtatattttatacgagtccattcaccaatagttgaaactgcaaatgtttgcactcatgttcatatgggttatgggtaggtaatgagattttcttcacaaaggagaaaagcaaagaaggaggaaagaaagactaaagaagactagagctaataaattaaattattaataactcctctgaagtattataacatttagcttttgctacaaattatatgatgatgccatttgtgtagggcagcttaagaataaagaatagtgtttttgttgttgttcagacatggatacaggataatataaagaatgcttgtgattttattaagaaaataactttaaaattccacttggaagctatatatgttcaggtcaggatgaaaaattctgagaaatacagatctaatgggagtattaacgggatattctcatcactgttttatctattatccagaaacttttaccttagaagaaagaatgctttatttctctcgtattcaaggtttacatatccaggtcctatgaattccatctgagatgctattagttgatcattgttatcttctaattgtgtgcctaggaacactgagaattccgttggtatttctgagcctagatctactgtccagagtcatacacccttcttgtccagctctgcaagtggtaatctgaagtctgagctgcttctctacaatgaggcacacatcctgtctattcctgtagtctctgagctagttctgcttctgttttacaatttaactactttaaatgggccagattgtttttggaaaatttaaaagagctaaataaaaatgtacatgtataaaacagagttatttcaagtttctcacacatgcattcaatttttattaaacacacacgcatatatgtatttttagcaatataataaggatggtagtaatattaaagtagaactaggaatagcattactataggcaaattattgaactaggaattctgagtttgaaggcttgatgatttcgttgagttttgtgtcctagaagcatcttcatctgctccaagccaagtactctgtcttcatgcttgggcatgaatacaattcaagatagttaccaacaaaacgatagtggtgccttgtcatgtaatagaaaagatattgcacttttttgattcctgacatagtatgaatagtaatgtaaatcacaaactctggaaaaatgaacaaaatgcatagtcaagtaagtaaattctttattattgttgatggatacattgaaaaacacaaaagaggctgaaattaaataatctaaatctctgagagtcatagactaaacatttgctgtttcaactatttgtgaatggttgtaaagaacatattaatatgtaattctgtaagaaacttgaatcatgcagtgagggtatgtgaatgactcacatggctaagaatgagttgaactttcaagagcttttccagctagcccctacactgtagtctcaactctttttttaacttagtagtttaattttgtgaagttttatttaaaagacccccaaagaaagccaactgctaattcttttttttttttttttcagacagagtcttgctctgccaccaggctggagtgcagtgccatgatctgctcactgcaacctccgcctccctggttttcaagcgattaccctgtctcaggctcccaagtagctgggactataggcatgcaccaccatgcctggctaattttttgtattttaatatttggtatttctgggcctagatctactgtccagagtaatacacccttcttgcccagctctgcaagtggtggtctgtagtcagagctgcttctttataatgatgcacattcggtctattcctgtagtctctgagctagttctagagatggagtttcaccatgttggccaggatggtcttgatctcctgaccttgtgatccgcccttctcggcctcccaaagtgctgggattacaggtgtgagccaccatgcccggccccaattgctaagtcttaggatttttttttttttttttttttgagatggagtctcacactgtcgtacaggctggagtgcaatggcaagatctcagctcactgcaatctccgcctcccaggttcaagccattctcctgcctcagcctcccgagtagccgggattacaggtgcctgccaccacgcctggctaatttttttgtattttagtagagatggggtttcaccatgttagccaggatggtcttgatctcctgacctcgtgatccacccgcctcggcctcccaaagtgctgggattacaggcatgagccaccgcacccagctgaatttttaagtacagtttttgaaagttgatgggtcctagccaaaaaagagaagttctggataaatttgatggtgactcagacaaaaatgagcataccatatgctctatatggaaacaagaaaaagtgatatttgaaaatgttttagccagtgctcaattcagaatttacgttaatagcattataaacgactttagttctgtttctatagactcattaggggtctacagggatcatttaaatatttcagttacactttactgcattttatgaggaaaattatatattataatgatacttggggatttgagaaggtcttgggacatatccctcatgaatatctaagtctcagcactagtagatttacttttccccaataatttcttgttaatttttcagtaattgcaaaaatttggcttacttagcttattatggaactctacttttttgaagatgcagagttttcttgcaagttattttaaatttgacagtaaaatgcctaaaaacttaagacttaagatgctagaggaactgcaactgctccagatgtacaagtgctagcatggggtatggttgaagttataacccctgctcttgctaattcctgctgcatggtcattgttcaactcatctgtctacattaaaaaacaaacaaacaaaacaatagcagaattacgggatttgtaacatgcatattgcgtggtctgtgaccataagtcgctttcaggctaggagcaaagacaaagtccgagtaatcaaagtattaatagaaggtggtatagagtagggactgcaacttgcaaagcaatgaaaagaatgttggctttggatcaactaagcctctgctttcctggctctgttgaatagcagctgtatgactggtgctgaccacatagtaggagctcaataaattataattataagatcagtgtcacaaactacagtagaatttagagaagagaagtcattttggatatcagtgctcagcagaactatttaaatttgtccttggagaacaaatagacttgatgaggcagacattagaggggaatttgtgccgccacctaagaatgaacaaaggtgctgtagggaacaagagagcccggtgcatattgggaaaagcactgtgtgtaagtgtgttaccacggaggttctgtgtgtgttggggcagtggggaacagacccaaagagtaggtttttaaaaaacgacagaatgcctgtcactgtgacaaacttctagagaaaatatttcctgtgtttttcatcatgctttcctttgcagcctgcatagaaaactttgctgtcagcttttgtagaggctgcttcctaaatttaattagaagatgtttcctaacagggaagcagagcctcccctcttctttccatggctgcagtttatctaatcaaactaagctcatcaaattcctggcttagttgttcttcacgctggctatgcatcacaatcatttatggagttaagtacacacacacacacacacacacacacacacacacacacacacacacgatgcctgggatccagaattcctgaagaatctcaggaaaaaggcagtccatgtaactgtttaaaagagcttcacagattccaatattcagaaatgattgcaggagaactttgagctcatatcaccttccttagaaattttttaaaacagggtgtgaaggtggaatctatttagatatgataatgctgtgtttctccatgggaatcactatatatttttccttaaaacaactgaatacataatcatcaggcattatttgtaaagatgtcaaaactcaaagagttccatttaccacagctctctctaacttagttgggtccccatagccctctgcattaccttttccactcagccaattcaacagataggtatcaaaataactctaaatttcttgcattttaaaataacatatgggaaaagaaaatagtacagttgctgctttacttcaaagaagtccacctgccttttgaaagcaaagacaacagagtcaatttactctttcatattttttgtccttctgttcctccccctccatcccagtgtttcaaggctacccagacctccttctccctttgactctcatgggcattttcctttgcccagtgtttcgtatccttgtccttcgtgtctttctctatctcttcaagtctctctttgaggtgactggtttcatattttagtcatgaagttataaacagcttaatagtttttccttataaagaatattcatattttaaaagaaagctccaaaaaagcaacaatgtgacagtgtctccacctcacagaatgactcaataatagtgcataattcaaacaccatggcacaataatagaagagatacatttgagcaagtaagcctttatggagtgcctcttgaattacacctggtaggctattcaaagcctgacccagaacaggtaaatgcagtatcaatgagcccaaatcaattttgaaagttttacagcagtttttaaaacataactgcaaagatgatttaaagaactaagtctagtaaaaccaccaggcatcaaacctgaggtgtcgatacctactaggttctcaataagtgtttgtagaatgaatggatgtactaacatatttaaatcatatcaaggaaagaaggctgggtgtgatggctcatgcctgtggttccagcactttgggaggccgaggtgggcagatcacctgaggtcaggagtccaagaccagcctggccaacaaggcaaaactctgtctctactaaaaatacaaaaaattagcctggcacggtggcgtgtacctgtagtcccagctactcagaaggctgaggcaggagaattgcttgaacccaggaagcagaggttacagtgagctgagattgcaccactgtattccagcctgggtgacaagagcaaaactccatctcaaaacaaacaaacaaatcatatcaaggaaagagatgtgaatcaggagctaggaaagctgagttctacttctgacttaggaacaaggtgaaaatggaacagcagagggtagaaactgaagtggtcacagagatgggattgaatggaaaaatacaatgttaaagaggtttcaaggagaagttataaataaggtcaaattctgtgcagtacatgaaaagggagatgattgtgaaaacgtgactggtgacacttctgatagtgttttgagcagagtaggagaaagcacagacagaaagagtttggagagtggaagcaaagaattttctgaatgaccagaaaggaaggaatgatgaaaaatagacaagtgtattgagagggtggcagaatcaaagcaatttttatcatgcatgtaggagaatgggaatggaccatgaagaggcagaaatgaaaaatgtaaaagctgaacagagagtaagatttttaagaagttgatgaggctcagattaagcatatgagtagggaagtttgtctccgaaaggagaagttcttctatctgatactgagcttaaagtacaatgccgagcagaaacaaatattcccaggtgagtcagagctgggaggaagcagaattcctcaggactctatcaaatacctcgtgttatgcttcctgtccaaacgaaagctactaatttcccactctccatccttctgccctgaccaccacatgctggctcacctctgtagtgtaacacatctcattcacctaggcctcctaagacagccctctgatttccactgttctaagacagaacaccttcaaacgagatcttagctgatggctgacctcctaggccttttgctaagaaactaccagggctaagttgaaggctcatgacttaacacattttttttttttttttttggaattggtttccagttaggagattgtctcaaatgaaagcaatacagatctgagtggaatttttaaaaagctgtatttccagagacactttaagtctggcagaatggcatgggattgcttaacagttgagtaccatttaactatgttaacatttatgactgtgccaatactgggcaagggttattccccggcaagaggacctgaagctgtggcactcagtctggctacacaaagaacttgctttatttcatgggaagtgagttgccactaaatctcccaggcagaatgggctctgtacttagtaccattgacaacttacaccttgattctctccttctccttttctaaatgtagtggttcctccattcctgtttgctaaatgtgtctgttattatacagtctatttgttacagagttttatacatgaagtatcaagacattatggtgtcattattttcacctgccactttaaccccacagctatttttactgagacattgggaaaattagattcattagagataatctaagcaaaataaaggtgaaaataaaaaaaattgtatacggtaaaacctttacacttggtggcaatatttaaaactgtgaaaatggattctaggaagatgggaagatgccagggtaagtcaacacttaaataagccaagtagtaccactgaagccttgagtttcctggagaagagagcaagtgtgaggattcatttatcttggggaagggagaagaacagaggtcccaacaggtctgaagctaatatatagcagattccttggccactggagactgcccagccacatatgccggtggagcttcgatcatccaaagaagagcacgtctgccaaggtctcacacagtccttcaggaggttgcctcatgcggctggtaggcagtcctgggagggtaggggtgatgcaataggtaggacaaaatgctacaagtttttatattttagaaggaactttgtcccccttggacctagagagtcttaggtcctggtcttatacctgtcccagtgaagaggttctggtatgctagggtgtaatcactagctcaccagacaaaattgccattgcacccacaaacctccagtttaccagtgctcaagaaaacctcaaacctggcctgttcttgtgtggcaaaatctacattacaaggaagtcaaagaaaaattgctacctatttcatgtactcttaaacttgtgggagggaggtcaagcttgaacaggtagctactattaaggaagagctaatgaatgagacagaggagaatgttagtttcaatgtaatgagtattctcaaagagatacaattagaaaataaaaataataattacttgaactaacaataatgattttcacagttctaaaatcaaagagaggaggtaaaaaaaaaagagagtagctactgctgagacctgaattaactgtctggatgaccaaaataaagggacaaagaaggaaattagtgataaaataagtgatttagaggaagatctaggtgacataacatgcaaagagaagtagttccagatggggaaaacttcagcttctatcaaatagaagtcataatcatggaaataacagaataaaaattctgttgaagaaaggcttgtgccttttgactgaatgggctcactaagactcagacaggattaattttacaaaaagccacacacctagacataatcagggaaaatgtctgacctccaatgctaatgaaaaaaattctttcttctactcagaacaaaaaatagttttcttacaaaagaaagattatgcgactatgttattaaaagaaaatgactgtcgcccaagaatctttataccagccaatcaatataataatcaaatgttaagaaaaaaggcacaatggttttcaacaatcaagaattcagaaaatatgccacccatgtactgatatcttatctgaagaaaatactcaaggaagtactcccaatctcataaaatttctaccagaagcaaatctcttctttacaagaagagcaaagcacaatgcagtgttaatacagtgaataaacagtgttaacttgttttagtttatgtgatgataattctataactaagacagaatagaaattataagacagtgttcttaaaatttatgtttgtgtgtgtgtttaattaaaacccgtaacaaagagctttcagctactcagaaaaatccaaaaattgtggagaaaagaaggaagaggaagtaaggtagaaaggagtttaaaagtctctaaaaaggtacagggagtagagattcaggagtaaaatgggcaagtaggctgtcttagtgtgatcattgtcattactgaactggatatactaagcgagaaatattgtttcacatattattgtgaatagcagaagaatgcaatttccaaattaagagacttttaaaaaaggaaaaacacccaacaaagtaaataaacagtaaacacaaaatattataataataagtaaataggtcatttaccactatatatgttaatggaatgaattatgaaaatagagaaaagaaaaaaagaatgcaggaatggaaatattaatgttaagaaaacaatgaaaactcaggtcaaaagcactaataaagataattagtgatataatgattacaggaataattctcaaagctatatgcataaactatatatcaaacaagaaaagacatatagggaaaaagtgggaaatgatataaaaacacaacgatggccaggcatggtggctctgcactttgggaggccaaggtaggagggccactttagcccaggagttcaagaccagcctgggcaacatagggagactctgtctccacaaaaaaagtaagaataaattagctaggtgttgtgatgtgtgcctgtggtcccagctactttcgggaggctgaggtgggaggatcccttcagcccaggaagttgaggctgcagtgagctgtgagcacgccactgcactccagcttgagcaacagagtgagaccctatctcaaaaaataaaagaaaataaaaacacaacaatgggaaattttaataggtatctgttagattttgactgatcagtcagattgaaaacagtaaatacgtagataagttgagtgatacaattaacttgcttgatttaatagataattgtgaaattatgtagcaacatacatagcacatgtatttttctcatatactcatgtgaattacttgacatacagttggccacaagaataccttggcaatttcccccaaaatagctgttttatacattgggttctttgactagaatttaataaatctaaatctaaaccaacagatgacctacctcacccctttatcaactgcttatatttgcaggaaagtgacagtaaaggctagttaccaagagaaattgaaggaggagtaccatgacattaggtccttgtctctggtcttcccccatgtcaggagtactgccattcctatggtttggctctgagtcaacaatttctcttactgggcttaggctagtttgccttcctttctgtttcatagcaaaaggagctgattaacacagggttctctctttttctctccctctgtctctgtctctcactacatatacatgcggacatgtatattgaattcatacaaataccttcaattacatcaagttgaattgcaaagcccctaatttactgcagatatgcttagattgatatttctatgcacaagacttgacaagtaaaattttttctcatgaatccttctctctcctaaagtaatataatttaaggaacagatctcctgaacacaggatatacataggaacccatggaattttcatctctctaagttcttttactgaacagagaccacaccattaaagaggaacattttgagttctctaggttagcatattaaaaaggtgaaatttacattaaaaactttttagttttaccttaccaaattaaggatccttatttcctttatgtcaaagcagataatcacgaagacctggtaagaacagctgactttctggtcagccattttatcactctgtttttctccttaaggaagattagcacatccttttctactgttagtgttctagtcatgctaacagtagctgcagaatcaagtctttcctagagaaagcctaactgtttcagtgttgtcctggagtcgattccatgttgagtgacatcaggttggtagcttgaaattggctatagtgagagaattcataacacagaaaccagcaacaaatgctacaaataggagatttgttttcaggagaactgcttcactagcatagtagttgttttgttccaggtagctgatctgacgaagtttagaatctcatactctagtgagaagaaataaactggggaaaagaagtattaaaaattgattatgttcttcttgagtcaatgaatttatttcagagaagtataattttttagaaaaataatggagtccttaaactaataattttggaaaatgttaagtgtgaaaaattgtcatataaaattgtaagctgagaaaaaatagtacttttgcttaaggcgacttaaatacatgatcttgtctactttcttccttttaatctcctgtattcttgtagtattgaatctttctagtttctacttcgaagaacaactaatttaatttttcaaaggatggttggaatggtatttcagtgaataagaatatttcatattgtgccttaataaaacttggaaacctgttattattataaggataaaaattactaaggctttttctttctagaaaatcactgaaacattcttattacttcatacagcttcacagtgctaagcaaagtcgacttatgttcttagtggaattaatcaatgtacagccaattataactagtagtaggttcagagttgacaaatatgcgtatcaaagtcatgtatggaaacttgaactgaaaccccttaatttacattccccaaatgtccagaagaataagaaaattaaaaacaaagtcaaaactgagcactgaaagtttagcactgatgaatgttcagaagtctaaaagatacatttgtgttgggagttgaagtcgtggtaagggtgctgtcagtggcatgcagggatctggcttcaaggattttgaattgtttttatttagtggcctttgcaattactggccttgccagctcatgaaggagcttatcatcactccccctaccacttaccatcaccaccactttgagaagaacaattcaatttatttttatgatagagcacactttttgatctctggatgaagtcagttacatctcctgtatttgacttaaaatttcaggagaggaaaaaaaaacactcaaagaaacaaacaaacaaacaaataaacaaagccttttaaaaaatactgtgaatcagtacatttccttaatgttataaaagtcttttgagattcttgtatgtgtgtgtttaattgtcccagctatcttctatgaactgagaaaggccttcttttgtttgaatgtgacagatcagttagaactgtggcaactaccatttacagctattgatttcaatgtgacattaaaggccccaaattccaccattattctcttcaattgtcacaaacaaaggttaataatagttgagtttggactgaaggaatcaagtaaagattgccaactgaaattacatgttgtttatctgaggcacaagtcagtatgagggtctctggtccctaggttgcatgtgtattatcattattttaaaaatatgccttttgctaaaagtaatatttaaaatacagaaaatgaaagtgtagtataagaaatcatgctatttaaaataaataatttaaaaaatatacttgtccttaacacagagtaaaaacattttgttttgttgcttctatagcagcaaaataatgtttctcataactgtaaaaagtggtatgtagcatgattaaacaatatttcaactctttagttcatgcagaggttaccagctagagggtagaaaggtttgattaggtttatgtcttccatgagaattttttttaaaaagcatacaactcccttaatatatgagtgctaaagctacaaatggctttcttttgtggtcaggtatgaaagaacaaagtccctttactacaataaataggtagaaaatagctagtgagatattataaatcttcacaaaagcaatgccaagttaaaaaagtctgtaagtctttaaaattttaactcgtttatatttatatcatcacttactacctatttactccaatggtaaatggtaaatagtttcatgtgctgtttccatggtaaagcttcttaaacaagcatcttattttttaaaaaattacactaataattgcaattatattaatacataattattcaatatttacatagaactgcagaattacacttattagtggaaaatagctattttaaagtattttatgaaaaggaaccctagattaagtaaatgaattgaggataatttattattggtcattatttcttaaaaataaaaaaaagagagagagagagagagaatctcgccaaaagtacttgctagtaaccattctaaggaattctagaagtagggcagtatgattccaaataaatatggtttattttttgaatagacagaccaacattcacgcttgagttaatgctatgcagtaccatttcataactcagaagataacaataaaacacacaggtgttgagaattgttcatatatagacaattgtacaaagaaatgaaagttctcctttcccagtaccagaggttctaaacactagtagtgttggtgtctattcttttcattctttaaaccctatgtttatatatgtacatctttatataatacatgtattattgttattttaacattcaatttttttctctttacattatatataatctatatatgtcaccacacacacacacacacactacattgatatatgcgaaaattgctttactttttccctttcattaagacatagagatctatctcactgttttttatagtgacagagtatcccattgtgtacatgccataagttactcaacgttctttaaggatggacatttgtctccagttgtgttattaaaaatggtgctaacttgaactacatgaaacatgtttatgcatgtactataatttttataggagagatttttagaattggcctgctgggactaaaagtatatgccatgaaatttacttagatgctgcaaaatgctttcccaaagggtggtactgtttcactttccactagtaaaatatgaaagtgactgcttccccacactctctatagcactaatggtaatcactctttgccaaattagttgatgaaaaatataatatctgtgttggtttaattcgtatttccattctgaccagctgggttggatatcttttcacgtttaccggccattggtaattttgcttctttaaattgtctatccatttttaaaaatctgaattgtttgtcattttcttagtaactggctaaaaatattttttcctaatgtcccattttcccctgcttacatgaagagtgcattatcattttaaaaaatacatatggacaaaaagaagatgaaaactgtccataatatttttggtgtatattctgacattagtgttaaagatgagatggaatcatgcttcccattctatttgtcattgcttttcttcactcaacaaaatgggctctacatttttgtatacccttaaatgttcattcacaactatgctttttaaactttgtgatcaaaacaaaagtaagaaaacattgaaatcctttcaccaagcaaaatttcattttgaaaacacaaaaatggagtccaagtggaatggctcaatcacctttccctcataactcatatcctagactggataacggtgactgtcgggatgcgagaaaatgctttttaattgacaggtagaaaacagcaggaagaaaagtgatgggtacctcacttgcaattatgtgtgtaagaaggcttctagtcttgattacaactccatgagatgaatgctgttattaacccattttacagaagacaaaatgagtgcaaagtcacttgctttatatgataacatatagtatgcatagcatttgaattcagcaatccagttctgaaatatgtgctcttaatcactatgaaacctgcctaatagaagtacacaaacaatatttacacttgggtcatattattttaatgattttttttacaagactttcccaacatgttgcaagaactgtaaaaataggtttaaaattttgtttaatgcagtaaatgcaaaagaatatttataatacatatattaggtaaagtaagtttttatttctcattcctttgcttttaaaagttttaccatatacatttatatctccaaagaacatataatttagtattaaatgtttttatcttccatatacatgaaataatattcttccttattcttcagcaacttcctttgtcaatctgacattatatcacagagatttatttatgttttccatatagccatatatcattcatttttattgctacaaagtattccactgtataattacaagtctttttatctcttctaccataaatgggcatttggttgtttctagtttttaaattattactatatcttctcttaagtggttgctcgatcctttttttagtttttatattgagttgtcttccgcttctgaatttgaagaaatgcatatattctaaatatcactcttctgtctcttgtttgtagaacaagtgtttattcctaatttatatcttgtcttttcgttttcctcatggtattttttgattaagaaattttaacaaacttttatgatctctgtattttctgccttgtttaaagaatccttatagattataaggtccataaggcatttttctatactgtttttgaaacatttaccgtactgcctatcacataaaggtctatctacttaaacttgatttttatgtatagataatgattgtcttactagtatttagttaatagttcaaaattttctcactggtttgtaatgatagctcagacaaaaatcaagcttccatatctgtctgggtatctttacgagttctgtgttctgcgagtttgctcaatttatccaactgtgtgtcaaaacccctatcttaagagatatagctttataagaattgttgaaagtggttatgaccaagttaatatatgttaagtgcttagaacaatgtctagcataaatgctatataaaatattttattttattattattattgaatgccttggtgatttggggccttttaaacatccatataaatatataaatcagtggattcttttggatattttttatagattatcagaagatatgtgaataatgtcatttttcccaatcctgatattttcattttttatctctttattttaaattcatttttcaagccttactgtattggcattttatatctagtacaatgtagaatgaatatgctaacagcaggcacccttgttttatttctgattttaaagacatgcttaccacatttcactattaagtttgatgtttgcagcagatattttgcaaatatctttgatcactttaaggaagttccttcctattcacaattttctaagatgtttttaaaattatgaatgaatcttgacttctaccaaacatattttccgtatctagtgagatgatcatataatttttctgctttaacttgttaatatgatgacttacatgacatgatgttttctttcggttaagccaacctggatttactgagataagctccatgttgtcatgccatattcatctttttaatcttttaatatgttgctggattctgcatgttaacattttgtttcatatcttgcattgatgcttatgagtgagactgacctataatttcttttcttacactaatctttcaatatcaaggttgtaccgggctcataaattgagggagtattgtgtttttttattgactgattgttttttcaattgacagacaaaattgtaggtatttatcatgtacaacatgatgttctgaagtatatatacattgtggaatagctaaattgagctacttatatgcattatctcacacagtcttcattttttgtagtgagaccacaataaacattctcagtattctcaagaatacaatatatcattttttttgctatagtctgtaatagcttaaaacctttcctcctgcatttctgactttctaaagcctgtttggaaggccagctttctcttgtgtactgaaaaccaatctcactggaatgctggtcagccattctacagttaaaatggaaattaggaatctttttgactaattagatttcaaatagcttttgcttgtacagtatattcatggatgttaagaaggcattgtcacaattaaggtttttgagaaaatcctttccaagaggatgttttccatcaacaaacagaagaaaaattaaatgcccgattaacaaacataatgtcctctttaataattctcagcactctggtaattctgttaatattactgtgctatatctacagttctttccttttgtttcatgttctgaataattcaattaaaagtctgacaaagcaataacaagggattgaatgctgtcgaatcgtaatttgaaataaaaacataagctctttgggaacacttatttaaaattctgcaaaaccttttcaagtatctgagattgttgcattctacaaaagaaacagttaactacttagctaagttatcctgcttcctttcttgtaaccaatttccgtaaataaggaaaacacagttgtgtaaaacaatgaagttcttgcaaaacagaccactttgtctgcacctggcttacatggaaggaagaactattcctttttcctgaattttgaggaaaaacagtggcacagcttgagtactgaacagcagaattgcctggaaggctcatccacagggcctacaatttctgtccttttatctggaaaatattaatatacaaggtaatgtgagggaaatgaaaaagaatgtgataaagaccttgcccttagaaagtggccactctagtaacagagataagagctgtcatgtgtgacacaatctcatgcagttggcggacagaagggagccagaaggtatgaaggggaatattgatccagatgttaaagccataggcttcaacttcccctcccccaatatggacactattctgcttcagttctctgagctgtcatcagaattcatgataaggaaagacacagtgaggaaatcacttattctgacatcaagaagaaaagcaagtaatataacctggtgtcattttacagaaaagctacggagtagtgattaagtgtacagtcctgtagtacagaaacctgtggtcaatttctggctgtagaatttcagccaagttgctcaacttttctatcctgcagtttcctgatctagaaagtacgaataatagtacactagctcagagagttgtttgaggattaaataatataatctacttaaaatgttaaccatttcctggcataaaataagctctcaaaaatgagaaccatttaatattatcaatgtgagccaatcctacaagttcttactgaagaaagtagcaatgattcttttttttttttggagttatttctttttattaattttattattattatattttaagttttagggtacatgtgcacaacgtgcaggtttgttacatatgtatacatgtgccatgttggtgtgctgcacccattaactcgtcatttagcatttggtatatctcctaatgctatccctcgcccctgcccccaccccacaacaggccctggtgtgtgatgttccccttcctgtgtccatgtgttctcattgttcaattcccacctatgagtgagaaaatgcggtgtttggttttttgtccttgtgatagtttgctgagaatgatggcttccaggttcatccatgtccctgcaaaggacatgaactcatcaatttttatggctgcatagtattccatggtgtatatgtgccacattttcttaatccagtctatcgttgttggacatttgggttggttccaagtctttgctattgtgaatagtactgcaataaatatacgtgtgcatgtgtctttatagcagcatgatttataatcctttgggtatatacccagtaatgggatggctgtgtcaaatggtatttctagttctagatccctgaggaatcagaaagtggcaatgattctaaaagaatccaaaaaaaaaaaaaatgctgcagattcaaacaagagaaatgctatgtaagcaaaaagagaagaaatatgtaattaaagaaacagaaagacaaagttaatttttaagcaaaattcagtgagagaaaccagtctcagagctgaagaccactcctcttgtaggctgggaaacagatagaggtaggagtgacaaagaaggagaccaaagaaaaagaaaggaagccatgggaaaattgaaatctgctttttaactaaaaagaattaaactttattgtaatactggctgggatatagctggtaaggaggaacatattaaatactcaaaccataggcttttgtccaaaatgtcttatttaaacagttttctaatctgaagtttagtactaatctgaagcttagtactatatacaactgatacttaaaaataatttagtcattcaaatttacttacattctttctatgcttacaatttataatggaatgtgggttgctcataacatttttatatttactcctccatatataagactgaacttttgtaggcagccatcccatttgacaaatccaaggtgacctaaaagtttaggttacaggggtcagtgaaataaattaactgatatattaatagcttattattggagcagttgtgtttaaatatgacaggttttgtattaaaactggcactagttaagcacagccagaacagagtttcaattattaataatgctgtgagtcacaaaatcagaaaaaatttaaaaacatctgacatagttgttcagggttgttttacatactgactttaaaatgtaatcatttacccaagtgtttatgttataactggaatctggtcaatagaaatgcaatatgagattcaacagcaaccgatactgtgtgcttttaaaaatgagtgtgtcatgtcaaagacttgtaaaatgggagcagtgccttaccaaggctgagtcttttagtaatgaaatgaatgaaactctatatggtgaacttatagaaaagccactatgtttgatgcaattggctacaggaagtcgtggccttcaggaaagaatctgtgggaggtttgctgaactttgtatctcctattcagccactataaataatttccctgtgacatcctctaaggaagcaagtgtccccgttatcacatttgcttatttattttcagtttattatctctctttcaaaacttcatagctctttatatctgttcctccctcttctccaaaccgagaagagagtaattaaaaattagaagtttgaaatatgtaagatctaacatgaacattccactgcatctggaagctgacagggcaactgacttattcttgcaggtgcttaaaatgaactatatgacaagttggagagtttactctgaaagcccaattagtaaaaataaaatgagagaagatgttcccacggcgtttgcaaaatgatattaaaagaaccaatgtttcttttaaaaataagcctgatacaggaaaaaggtaaagggcagaatcaaagtggcaagaaaagaaaaaaataaatcatggaatgaaagaaacactgaactggaaatttagagatatgaggtcaaggggaaaggttaaaattataaaggacatgaatacagagatagaagaaatcatgtccgtggtagaagacagtacactaacttttttgagctactatccccaatcttatttaaaataataactacaacaaaaataaaaacagcattaatcttagaatacaataaggcaaaaaatggagaattagcaaacacgatagggagagaaacaaaatcaaacgtgtttcaggagaaacaggattagaaaagagaatgtttataaaagaggaaatcagtcaggcaaataaaagcaaatggagaaaaacatttaaaaggaacaaggaactcaataccgtaaaagaagaattgaattgcagattttgatgtaactcacttatatttcataactatacatctcaattcaatttaattcagctactgcaagtattacaaaaatttgtagccataccagaggtggagattactatttttatttcattttgagtgtgacacaaaaatggggttaaagaatctggcacattctttggtattcactgccaaggaggtttgaactttctaaaatgatgcagtgagattttcaagcagaaaaaagtccttctcaaataactctaaataaaaagaaggagctctagatccaaagggatcaaggaagtgaaagtggaggaggtcagacaacaagtgccaatgtggcgtgtccacacaaagaggaaagaaaaattgggaatgatggacataaccaactaaggaatataaaagattgaacaaaacctaaactgatggttcccagtgtctctaacatctgcatgaggcctgctacctaatagttgctcaattaataactaatgaattaaatgaatcagtgaattaactgaattccacttagtggaactatcttttcaggctgtactcatcagtgggaaacaatgaaagaatgagcagacagctggatttacaagaaatagtgtcaaaaatttgtcactttggaaaagacttgctcttggagaaaagaggaaaatattgaacaacctgaaatagtaaaaaaaaaaaaaaaatcttacagattctatgtgaactgatctacagggaagaaataggtctacactgttttcaaaaaaaactactctggttgtttgatttttttttccccttccctactttgtgggatgatgtttgattgttttttattgccatcagcattggcactcctccggacacgtgtttggggttcttggaaccaaaatgaatagtacatacagtaaagtgcacctttcgtgaagggaaaatgacaactacataacaccatgtaaaagaatgcaggcaaaaagagaatttgtttttctgtattatatgagacaataaggcggaaagagaaagaaaagtaaggcaaacgacgcatgacagaaaggagaacaaggctcagaacacacaagatcaagcaaggggggtgggggagcccatgaaggcagaaacaaggtaacaaaaaggacaaaaccagcagtagaaaagaactgtcagacacaaaaccctcaaaacaatagataggaaaaaaaggaacaagatgacaggaaaagagcagcatggaatctagtaagaaaaagaaacaaaaatttcaaataatggattttctaacacccccgctgttcctccagtgcattgtgtcacagtctcacagagcagtgcataatttattatggtcactcgctgccaggctgctataaagggcagtagctatatgaaaatactcctcactgcctggatggcttaatgatctaccatttgtagaggggcagggctgcggaatggcaggcaagggcaggaggagcacttgtggtgctggatggcgctctgcatatttagtgcttcccaccgtttgaagaaggggtgtattaactctcaagacacctcggtggggttttttcccccttttaaagcctttcctaaataataaacttctgtccagagcagtttcttaatctgaaactacatataccctcctttaaggcaggggtcatgtcaaagtaaacaaccaccaaaagatggattttaaacataaaatctgacttggacaattaacattaataactggaaaactgcattctgttttttttttttttttctatgctacagtttctctttagaaatgaattttgggtgcagaaaaacttaaaagtctcaaaaaaaatagagaccatacaaatcattttcagcaatcattttccagaaactggacttttcggtagtatttatatagaggaactttcataacttccacaaatagcactgtcttcaaactgaaatgcatcatcaagatatctatcaataatttctgtgattgataaagccagggattacttctttaaaattcttctttgagaggcagtcatgtctgagggacaggagcacaggctcttgagccagatggccgagatttgggtccagatgaggccactgacttgccgtgtgaccctgccatgttacttaccctttctgagttccttcatctgtaaaatgggaacaataatagtaaatatatcatagaattgctgtgagaattaaatgaattagcccttgggtgagagcctgctaaacaaaaagcacggcaggtgtcaggtgttgtacctgctctcaacaaagcatgatgggacattagggcatttgtaatccagaaccgttcgccatttggtcataggcatagagacagctgaaaagtgcatcccttaattccacaaaagaccaggctagacagtgcactttctctttctgtcctctcatccttggatacaacccttgcttatataggacaacagatgtgtaaaaggaagtcacagtcagctgttttgacatctttcatcctccaaactcctatagtaaaacgcaaaatgcaaaaaatgctcattcttaaacaaaatgatttttgagttccaaagataaaatattttgaaaaagatggtccagatcacagaaaattgttaataatatgcatatataagtagtatgtaattctggacaaggacaaacatatttaggttggagaaatcagacatgtgaagcttaaaatagtagaaggtggaaagatagcaaaaaatcagaacaagttatggagagtggtcacagaaggaagaaaattaatttgaaatgtaagttctcaatttaaaaaaatcagaactactttcctgggtcatactcaagaacaatccttctcaggatcttctcactgccaatgacacgaaaagacattttgtgtcaaaggtgaattcattcaattatccactcattcattcgttcattcattaatctatccccaaattatttactgaatacctgccatgtatcacattaatcacattaatccctggagaatcaatggggaacaagtcactctaccatcagtttctttatttttcatgtggagaatattctatcttccccctcaaagttgattgaggaatgaatgtgatcccatgtgtagaaataggcactttgcctagaatacaaagggaactgactgaataaaatcagtttctaatcaccataaaaatcatttatgaatttattattttgggatatatttacatcatgataactatacttttattgcaatcaccttaagacacacttatttactacctaaagggaaactatatttcactttatgtattctaaatctatcatctctataggaataataggtatatgtttaatattcaaaatctttcatttttgaaattttattttttaataattgaaaaattattgttgtatatatttgagttaccaagtgatgttacaatttatgaatacaatgtatacgttaaaattaaatcaagttaattaacatatccatcacctaaaatacttactttttgtggtgagaacatttgaaatttactctcttagcaattttgaaatgtacaataaatggttatttactatattcaccatgttttacaatatatctcatagtaaaaagaacccttattattcctgtctaattgagactttacatcctttcaccatctcctccctattctttgaccatcttctccctattctccccaccccgagcttctggtaatcaccattctactttctgtttctttagttttagattgtttcattgttttagagtccacatgtaagagaatatgcaatatttgtctctctaggcctgccttccttcacgtaacatgttctctagttccagtcatattgttccaagtgacacaatttctttcttttttaaggctgaatagtagtccattgtgtatatataccatattttctttatccattcatctgctgatagacacttaggttgattccataagttgcctattgtgaatagtactgcaaggaacatagataggcatgcagacatttctttgataagctgatttcaaatctattgcataaatacccagaagtaggattgttggatcatatggtaattctacttttggtttttcggggaacttttatgatgtttccataaaaagtatactaatttacatttccaccaacagcgtgccagggctcccttttctctgcatcttctccaacacttattatctgttgtctttttgataacagccattctgacaggtgtgagtgatatctcactgtggttttaatttgcatttacctagtgatcaccgatgttgagcattttttcatatgcctattggtcatttgtgttatttcttttaagaaatgtctattcagctcccttgctcattttttattcaaactatttcttttctttccaaagagttgtttagtctccttatatatatttgatattaaccccttatcagatttatggcccaaaaatattttcttcaaatccatgggttgcttcttcactctgttaattgtttcctttgctgtgcagaagctttttattttgatgtaatccaatttgtctatttttgcacttgttgcctgtgatcaggtagcaatatttgctgttctgcaatatttgctgttctgcagcctccgctggtgacacccaggcaaacagggtctggagtggagctccagcaattaaaaaattaaaaaatcattatctagaccaatattgtgcactttttctcctatattttcttctagtagttttacagtttaaggtcttacatttacctctttaatccacttgataatatttctgttaatgctgtgagataatgatctaatttcattcttctgcacatggatatacatttttcacaacaccctttaatgaaaagatgtcctttttccaatggttatacttggcacccttgcttaacatcaattgactatatatgaataggttcactgctgagttttccattctgctccactggtcaattagtctatttttatgccaacatcatgctgtttaactaacatcacttggtggtagagttcagaatcagttagtatgatgtccacagctttgttctttttgctcggactgacttggctattcagggtttttttgcagttccatacacattttagaattatattttctatgtctatgaaaaactatattaaattttcataggtattacactgattgtgtagattgctttgggagataatatgaacattttaacaaaccaattcttctaatccatgaacacaagatatatttgtttttgtatctttttcaattgctttcatcatgttttacagtttttagtatatgggtaagtttctcacctccttggttaaatggattccttttgatttctttttcatatagttcattgttaatgtacagaaacatcattgatttttgtttattgattttgtatgctgcaactgtgctgtgttaatttattagttctaacagtgttttttttttttggtggaatccttagtattttctacatataagatcatgttagtaaacagcaacaatttgacttctgcttttcctatttgcatgcatttaatttctttctcttgcttgattggtttggtaaggctcttgcttgattggtctggtaaggacttccagtactatctttttaaaacagacttacgggatacaaatgcagttttgttacatggatatattgcatactggtgaaatctgagttttctgtatagccttcacccaaatactgcatattgtacccattaagtagtttatcataccttaacccttttccacccttccacccttctgagtctccagtgactattattccattgtctttgtccatgtgtacaaattatttagctcctgcttatgagtgagaatatgtttccgtttctgagttatttcaattaagataatgacctctaggattccattctgagatggccgaataggaacagctccgatctgcagcttccagcatgatcaatgcagaagatgggtgatttctgcatttccagctgaggtacctggttcatctcattgggactggttggacagtgggtgcagcccactgaggatgagctgaagcagtgggggtgtcacctcacctgggaagcacaagtggttgggggatttccctttcctagccaagggatgccgtgagagatggcacctggaaaaccaggacactcccacccaaatactgtgcttttccaatggtcttagcaaatggcacaccaggagattatatcctgcgcctggctcagtggattccaagcccaaggagccttgcttatggctagcgcagcagtctgagatcaacctatgaggcagcagcctggcaggtggaggggcatctgccattgctgaggcttgaataggtaaacatagcagctggggaagctagaactcggtggagcccaccgcagctcagcaaggctggctgcctctgtggtctccacctctgggggcagggcatagctgaacaaaaggcagcagaaacttctgcagacttaaacatccctgtctgacagctctgaagagagcagtggttctcccagcatggtgtctgagctcagagaaaggacaggctgcatcctcaagtgggcccctgatgcccgtgtagcctaactgggagacacctctcagtaggggccgacagacaccacatataggcagctgcccctctgggacgaagcttccagaggaaggatcaggtcgcaatatttgctgttctgcagcctccgctggtgacacccaggcaaacagggtctggagtggagctccagcaaacttcaacagacctgtagctgagggacctgactattagaaggaaaactaacaaacagaaaggaatagcatcaacatcaacaaaaaggacatctacaccaaaaccctatctgtaggtcaccaacattaaagaccaaaggtagataaaaccacaaagatggggagaaaccagaagagaaaagctgaaaattctaaaaatcagagtgcctcttctcctacaaaggatcacagctcctcggcagcaacagaaaaaagctggatggagaatgattttgacaagttgacagaagtaggcttcagaaggttggtaataacaaacttctctgagctaaaggaggatgttcgaacccatcgcaaggaagcttaaaaccttgaaaaaagatgagatgaatggccacctagaataaacagtgtggagaaaaacttaaatgacctgatggagttgaaaaccatgacacgagaactacgtgacacatgcacaagcttcaatagccaatttgatcaagtggaagaaagggtatcagtgattgaagatcaaattaatgaaataaagcaagaagtttagaggaaaaaaaagtgaaaataaacgaacaaagcctccaagaaatatgggactctgtgaaaatatcaaatctacatttgattggtgtacctgaaagtgatggggagaatggaaccaagttggaaaacactcttcaggatattttccaggagaatttccccaacctagcaaggcaggccaacattcaaattcaggaaatagagagaacactacaaagatactccttgagaagagcaactccaagacacataattgtcagattcaccaaggttgaagtgaaggaaaaaatgttaagggcagtcagagagaaaggtcgggttaccaacaaagagaagtctatcagactaacagtggatctctcagcagaaactctacaagccagaagagagtgggggccaatatacaacattcttaaagaaaagaattttcaacccaaatttcatatccagccaaactaagcttcataagtgaaggagaaataaaatcctttacagacaagcaaatgctgagagattttgtcaccagcaggcctgccttacaagagctcctgaaggaagcactaaacatggaaaggaacaaccagtaccagccactgcaaaaatatgccaaattgtaaagaccatcaatgctaggaagaaactgcatcaagtaacaggcaaaataaccagctaacatcataatgacaggatcaaattcacacataacaatattaaccttaaatgtaaatgggctaaatgttccaattaaaagacatggactggcaaactggatattcaagacccatcagtgtgctgtattcaggagaaccatctcacatgcaaagacacacataggctcaaaataaagggatggaggaagatctaccaagcaaatggaaagcaaaaaaaaagcagaggttgcaataatagtacctgataaaatagactttaaaccaacaaagatcaaaagagaccattatgtgatggtaaagggatcaatttaacaagaagagctaactaacctaaataaatatgcacccaatacaggagcacccagattcataaagcaagtccttagagacctacaaagaaacttagactcccacacaataataatgggagattttaacaccccactgtccactgtcaatattagacagatcagtgagacagaaggttaacaaggatatccaggacttgaactcagctctgcaccaagcagacctaatagacatctacagaactctccaccccaaatcaacagaatatacattcttctcagcaccacatcacactaattccaaaattgaccacatagttggaagtaaagcactcctcagcaaatggaaaagaacagaaatcacaacaaactgtctctcagaccacagtgcaatcaaattagaactcaggattaagaaactcattcaaaattgcacaactacatggaaactgaacaacatgctcctgaacgactactgggtaaataacgaaattaaggcagaaataaagatgttctttgaaaccaatgagaacaaagacacaacataccagaatctctgggacacatttaaagcagtgtgtagagagaaatttatagcactaaatgcccacaagagaaagcaggaaagatccaaaactgacaccctaatatcacaattaaaagaactagagaagcaagagcaaacaaattcaaaagctatcagaaggcaagaaataactaagatcagagcagaactgaaggagatagagacacaaaatatccttaaaaaaatcaatgaatccaggatctggctttttgaaaagatcaacaaaattgatagaacgctagcaagactaataaagaagaagagagagaagaatcaaatagacacaataataaatgataaaggggatatcaccacggatcccacagaaatacaaaccaccatcagagaatactataaacgtctctaccaagtaaactagaaaatctagaagaaatggataaattcctggacacatacaccctctcaagactaaaccaggaagaagatgaatctctgaatagaccaataacaggctctgaaattgaggcaataattaatagcctaccaaccaaaaaaagtccaggaccagacagattcacagccgaattctaccagaggtacaaagaggagttgataccattccttctgaaactattccaatcaatagaaaatgagggaatcctccgtaactcatcttatgaggccagcattatcctgataccaaagcctggcagagacacaacaaaaaaagagaattttagaccaaaaaccctgatgaatatcgatgcaaaaatcctcagtaaaatactggcaaagcgaatccagcagcacatcaaaaagcttatccaccacgatcaagtcaacttcatccctggcatgccagcctggttcaacatacgcaaatcaataaatgtaatccatcacataaagagaatcaatgacaaaaaccatatgattatctcaatagatgcataaaaggccttcaataaaattgaacagccttcatgctaaaaactctcaataaattaggtattgatggaacatatctcaaaataataagagctatttatgacaaacccacagccaatatcatactgaatgggcaaaaactggaagcattccctttgaaaactggcacaagacagggatgccctctctcaccactcctattacacatagtgttggaagttctggccagggccatcaggcaagagaaagaaataaagggcattcaattaggaaaagaggaagtcaaattgtccttgtttgcagatgacatgattgtatatttagaaaaccccatagtctcagcccaaaatctctttaagctgataagcaacttcagcaaagtctcaggatacaaaatcaatgtgcaaaaatcacaagcattccaatacaccaataacggacaaacagagagccaaatcatgagcgaactcccattcacgattgctacagagaataaaatacctaggaatgcaacttacaagggatgtgaaggacctcttcaaggagaactacaaaccactgctcaatgaaataaaagaggacacaaacaaatggaagaacattccatgctcagggataggaagaatcaatatcgtgaaaatggccatactgcccaaggtaattcatagaatcaatgccatccccatcaagctatcaatgactttcttcacagaattggaaaaaactactttaaagttcatatggaatcaaaaaatagcccacataggtaagacaatcctaagcaaaaagaacaaagctggaggcatcacactacctgacttcaaactctattacaaggctacagtaaccaagacagcatgatactggtaccaaaagagctatatagaccaacggaacagaacagaggcctcagaaataacatcacacatctacaaccatctgatctttgacaaacctgacgaaaacaagaaatggggaaaggattccttatttaataaatggttctgggaaaactggctagccatatgtaggaagctgaaactggatcccttccttacaccttacacaaaaattaattcaagatggattaaagactcacatgttagacctaaaaccataaaaaccctagaagaaaacctaggcaataccaatcaggacacaggcatgggaaaggacttcatgtctaaaacaccaaaagcaatggcaacagaaggcaaaattgacaaatgggatctaattaaactaaagagcttctgcacagcaaaataaattaccatcagagtgaacggacaacctacagaataggagaaaatttctgcaatctacccatctgacaaagggctaataaccagaatctacaagaacttaaacaaatttacaagaaaaaaacatacaaccccatcaaaaggtgggcaaaggatatgaacagacatttctcaaaagaagacacttatgcagccacagacacatgaaaaaatgctcatcatcactggtcatcagagaaatgcaaatcaaaaccacaataacataccatctcatgccagttagaatgcccatcattaaaaagtcaggaaacaacagatgctggagaggatgtggaggaataggaatgcctttatactgttggtgagactgtaaactagttcaatcattgtggaagacagtgtggcgatttgtcaaggatctagaactagaaatatcatttgacccagtgatcccattactgggtatatacaaaaaggattataaatcatgctactataaagacacatgcacacatatgtttattgtagcactattcacaatagcaaaaacttggaagcagcccaaaggtccatcaatgataggctggattaagaaaatgtggcacatatacaccatggatattatgtagccataaaaaaaggatgagttcatgtcctttgcaggatcatggatacagctggaaaccatcattctgagcaaactagcacaaggacaaaaaaccaaacactgtgtgttctcactcataggtgggaatttaacaatgagaacacttggacacaggatggggaacatcacaccccagggcctgtcatggggtggggagcagggggagggacagcattagagaaatacctaatataaatgatgagatgatgggtgcagcaaaccaacatggcacatgtatacctacgtaacaaacctgcacgttgtgcacatgtaccctagaacttaaattatacgtataaaaaatgataatgacctctagttccatccatgttgctacaaaagacattatttcattctttttatggctgagtagtattccatgatatctatatctatatctatatctatacagatattagaagagaaaagatactgttatcccttcatatatcaatttcttccatgttacccaaaacacaattacaggaaaaacaggagtgccaagcctgccatgttgtttacagttttggtgtggtcaaggaaagaaaaaatgttggcaaaggaaaattgcaacaaagttttccattcacttaatagaaggttagacattttacaaataagagaagaaagctgcatgttcttttctgatgaatcatgaacacatactaaggttaatggaatttgcaacctatctatgaggactttcaaaactgaatagacccagtagcaacaaatagggagaaaggggcaaaaactcaagcaatcaatcctagaaaaaaataaataaataacatgaggaaagagtcaaagatgtttaagacatctcaaagacagtaaaattgtaattcatgctttaaattgatttttccttaaacaaaacttttttttggagagtacatatattcattaagcatactgatacttaaagtgcttttggtgagagaacaaaaacaaagttaggtataaaacaaaattttcaataagatctctgcaatataaacaatgtcaagagagacttcatgttggtataaaatctgtgattatcaataagcaccacctcgtgtttgtctggggggttgtaatagttctcagagaatatggcttccccaatgatcatgacaaaagagccttcagtcttcagccaatactcctaagttgtaaaatgccgtaattttaataactttatttttcttgacttaccttatctccttctctagtcaggcaaatccatacgcctccttcctgacagctcacctatcgcagttggaaaccttaaactgactgcaccataaaagactgactacctcagcaggaagcgtgtacaaatttctctttgcggtagaagtaccttaattttaaggtctttgtgaaggtggtgcctctgataccttcgtttaatttgtcttattccttatcttctctcttgccttatcttgaactctgttggctctactctcagccgctgagtacttactagttttctggtccaatattgctttttagcctgaaatgcagtctcctttactctcgagtcatttgtggcttctaatacatgactcagtcttgtccaccagttcttccaatattctaggccagtcagatcacgtaactagaccctcccttttcctgccaatattcatttcttagcaatcttggtgtcccaccttgtctctactctgccctgacaatctctattattcttctgtgacattacattacctgaactcttcatgaaatcatgaactaagaccatagcctctcctccatctcacctctgtctctgtctctctttatgacatttttatttcatccttatgctatagtcaacaaatacatagagaattctgctatatttctcaaactcactgtgatgtgaacaaatatttgagggtgatttttaaaaaacttaaaaaatacttttgttgcttatttctggaataaaacaaatgagaacaataaaaaccaagtaagttaaaaaaatccatagttagctgtttttcctgtaacattcaccaggctggagtgcagttgtgtgatctcagttcaccgcaacctccgtctctcaggctcaagtgatcctcccacctcagtaccccaagtagctggaaacacaggtgcacaccaccatatccagctaatttttgtgtgtgtgtttttagcagacacggggtttcgccatgttgcccaggctggtctcaaactccttagctcaagcaatcttcctgcctcagcctcccaaagtgctggcatacagtcatgagccaccatgcctggcctatatataatgttttttactgccacataatggttgggctacacaaaaacaacaatatttcctgacctagaactgataattcagttagatttaaacggtgttgctttcaactaaaaaaattacaacttttaaaagcagcaaaaatttttacatcattaccaacattaataactataattgaaaaactcatagagaaccagctgtaggcaaaatattggcagttacataaatgtctcttacagatttcctgtagtttatctacttatgtaagcacccatgtctatcaaatggctgagaattaaaatcaaataaaaagttgggcaacataatatagtataaagcagattttttttgattagagatagtttttctcataaacaagtggataatttattttaaagaacttcaaaaattataatgctatgaggaaaataaaataggatgaatccaatgaatatggctaacatcagattttagtcacttttgcagaagcttataccacacagtcatttctcatgtttcttcatggaactatgttatttcatagtgcaatgattttcaaacccataaaagtgatgcctcaggggatcatcccactgaggccaacctagtctatcccatacttatcaagtcaaatcatagacctggagttccaactctctagcccaaacctacatgtgtccatgctgattccggcataactaaacatcacattcaggataattctccacatacatagctcatagaggcttaagtcacaaggaatgagaagaatcaagaacctgcagaagatgtctcaggagcacatacctaatcagtatcaaaaagcgaacagaactcagcagtgatcctcaccttagattctccatgagatgccagggaggctactgtggcttaagtttgttgtattttacaagtgctggggctcccacattcttttctctaacctttgggatttcttatattcccaaactcctgagtttcaactctgggaaatatggaaaatactatgacttttcagctgttttggttttaaaaaagtgtcttcatattgtctcctccacagacatctatgggggtctgatccaagcagggctgtggtcattgctccctggacactgcattgcatatgagatagagggtctgctaagccagctgctgaaggaagactttatttcccaggggaaattctagcacatctggggcactgtggtcctcacacttggtttggattctcttcctgatgacggacgtctgctttctggcaagggtaagagtaataatctgtggttaatgtctaatgaaaaaatgctggcatgttgaaacagaaacaaagcctctctcttttttttaaaaaaaaaaacatacagttttatgcaaattaagtttgaacatagaacagatcgtgaaagaattatcaaagtattgctctgggtggtatttggagtaataatctttaaaaatcaattttaaggtttaccacttttaaaccttttattcttgcttagctaaatcgtcatgaaagcaggacttcatacatctccctgatgacaaaactaatgtttggactgtttgagttgaacattctaatatttaaaaattctatgcatagaattgaacaatatgattaaacgcaggaaggggactgtgaggtggcaagatataacagatgatagcggttgtactgccatctttgttcaggtccttatttgcctgtaaagctacggcagtcttctctctgattatactatcatttttgaactttctatccaaagaaatcattactaaatgagtgtatactaaatagttgttcactctttagcaatcatacctacaatgaaggcactcaaaccactgaacaattggaatccatcgagggctagggaaataacatctttgtagcctcttggaactgttaggtaaagaaatcaaattctttgacagtgattcaagctctaggtcactacagattcaaatgtgagtatgcactgggtttctatctttaaaccctttcacatatattcttcttccttcctcatggaaagtttgattgactgataatatacacccagctcatgaattagaatgtcatttgaaatagaattagagaggtgatttccatttggataattccagctgagaaggtataaattccaagcagaaggaataataattgtatgcaaaaaggtatagtagggagtagccagggcaatgcgttgacttttcctgcttgaccagaaactttgatacgccaaaataacacagttgggaatactagacagaacactagacaggggtcagtaacaaaggcactaaagctgtgggacttgctacttggttaccttaggctaaggcagattaagcacttttctggtccttaattcctatcctgtatataagggagatgaattggaaaatctttaaggttcttctcagtcacaaaattctgtgctttactatgccccgtcatcaactcaaggaaaagaagtaagcagctttaggttttctgatggcaggaaaaagaaaatcatcccaagagggttatatgactagcattgagaagtcctgtggagcatgctgcatcttgctcttctttattgccatatggaaggcaaggcctcttaccacatatctcactccatttatagctcctgggcaactatttttcttttgatagctgatggaaggtctaagaattaaaggtactgctggccaaagaaggcagcccaaagacaacaatgtcaggaactcagaggttcagtagaactcctggggaaggttggtcttgatattaaaaggtgaatcagaaagatatatactggtcaaattcatgtttgagaatgagcacatattcttagtcaaatgtttgctactattcacatgcaccagaaacagtgtcagaggagcctagttaaggtctaccttgttattgttgcatgacaatgcaggccagggaaggccatatcttgtcattattttaacagaaataataggatttttttgccacctattgttggcaataattttaaaaacacaacaaccacaacaatacaaaggcctactcgaggtctattcagtactagcctgaactgggtaagaaggttctgcaggatggaagtaaaatatgtaatataattttagtaggctaaaagagggttagtactcaatgtggtaagaacatgtagcatgtaggaaaaggggaaaacctcaaaaaggtgtcattttggctgaattttacagaattggttataaaacaattaaatctattaagtaatatgctgttacagaaaatggaattatataaattgcatgtagacaactttaaatttggatgctaatacaccagagaagcaccttgagtcgcaggagacagaacctaagtagtggattcaggtttgcttgtagtttcatatatttagagaaatgaaatagaattataaagacaactttagagcctatgtaatcctgcacttaattttcagttaacaatactgatacttaacattgatattgcaatacctacttattaggaactgttctagacaacttccctttattcaggctaatatcaaatcaaagtgcaggtctagaagccactgaccaaatctttgacctgggaaactcgagggcctctgccttgtgaaaaatggaacaaaaactcaaccggcttcagagggttgttgggagggaatggaagaagagtcatattttatttttcatgctgtaatacaactttgattctttggaatgaatgcaaccaaagccgaatgatattttcacctttgcttaagcatcagggttattgacaccgttaactaaaatggaagcgcagcctccagtataaaagaccaagggttctattctagccactttaagtacaagatgtccacttaaccaatcatagcctttttgagcaactgctgcctagattctcattcatcaaagtaaaatataccaaaaagcgagcagcattagttagggtaagcattagtaaaaacaagaatcactaagtaaaatactgccttaatgcaggctaaagaaatgttagtgtttttaaaaacagcaacatattttctttatccactgtatcattgatgggcatttgggttggttccaagtcttcgctatgtaaatagtgctgcaataaacatacgtgtgcatgtgtctttatagtaaaatgatttataatcctttgggtatatacccagtaataggattgctgggtcaaatggtatttctggttctagatccttgaggaatcaccacactgtcttccacaatatacaccatggaatactatgcagccataaaaaatcgagtttatgtgcttttcagggacatggatgaagctggaagccatcattctcagcaaactaacacaggaacagaaaacaaaacaccacattctcactcataaatgggagttgaacaacaagaacacatggacacagggagggaaacatcatcacacaccggggcctgttgggggttggggggtcagagggctgagagcattaggacaaatatctaatgcatgcagggcttaaaacctagatgatgggttgataggtgcagcaaaccaccatgggacatatatacctatgtaacaaacctgcacgttcagctcatgtatcccagaacttaaagcaaatttttttttaaaaagagcaacacaatatgcacttgtttatttctttgtttttgttttaacaatgctctttaaagttagtttaaaaataacagtagcctgctatttttaatgttaacattaacagaaaattaaagcttaaaggagatttaaagatcatttagttcaaatcccatattttagagatggacacttatccttcaggagagcaagtggcttgataaaggtgacacagatggctgatggaatgaatacatgagactacttttaaacacttagcaatgctgaggtgttttaagatttgatatgaagctttgttttgcaggaatacacaatgcaatttcccaaggtcagcttgagattctgtttccataaatttcataaataaatatggaacccataatgttgcagagtatggattacggccttccctcttcataaatttcatgatttttaatcacttattttatatagatgtgtatatataagcttatatatatgtatatatatcagtgttacatctatataatgttgattacacacaggcaaattacttaggtacaaaggcagcatttttcactcattaaatatttgtgagaaaatatttgagataaaggagaaaaaaatcaagtatttagagaggaatgtgtactgaacaagaaagtgtctctggcagataaatattttagccatggaaccgacagcatgtctaattcgtgaagcaaatattaatcaggctctgaccatgcatgcagctctgtgcttagcacatagtaagttttcaacagatgaaatgcaagatcacatagcaatggggaagagggactagaatgactcttcagtcccccaccactgagtataaattctgcaccccaccaattggcaagtgttcaagactttggaacttagagaggtaaagggagaagcaatgggaataggaggcagagaaggggtaaaaggaactagaggaaaaggcaaataagcccaagtgtgtttgtgctcacttcagaaagtcagagtcacagaaaagcattttttaaaatgcactaatattctgccttccctttatttaaaatatggaacattcatgtgtcctcaggcagagaaatcatttaaaatatgttggaacaaaaatgattaaattagctttattcttcaatcatataatttacaagagaatatcattcaaaagaaaatttctaaacttggctgatatgaagaattggtttcagttgtagagattataactaataagtgaaatggaaatgttcctaaatttttttcagccaagatatcatggtttttggaacatgtgttttccaagagtttttagaaagcttaatgatatctctgattgcaaagttttagcatttggcattctcattcagccaaaggctgtgcaaaactttatgtggctaaataactctccagaaaggatgcacctaagacacttaatggctgagtaaattcagatgtgctcatatagcaaaagcctactccaaaaaataaactcaggtgggactagggcaacattttcaaaataattgtcgtatttgtggtaagagagaaatattgaattgcattctcccctaacaaagcaatcaatagatttaaaacctccgtagttgtttctatccatgtagctaaaaaatacttcggttctgagattcacagactgtgaaacaagtggagggacaatcttgacttgagatgggaaaagaatactaactcagcccccattccaggtatcctttaaggaatccttctcattttaatcacattacttaaatgctactatctaatcatgtgactcataaaagtcacgattcaatgtcatgttttccctatactagatagttctgagtcttggttctgttatcatatatcatagttactgatcttctgggcaacctgttgtgagtggaacagagaatatatttgaagaatatttgactagaccctcctttcttgttgttacataaaaatggtttctccttaagtcacaaatctattctgcatgttaaatatttacaaagtactttaaaattcttcctgaatgctaatacaaagatagcaatctatgttcatttaaataagcagaaatgtttgccctcccaaattaagggcctctgagtttaattcaaatcaatttgatgacttgagagaaaaaaaaaaaggtggggacctactaagtacaagatcctgtgccagacatggagataaaataaactttccaggactagacaatccgtcagaaattactacatttcacattatttaattcacaccatttccttctgggcttaaaaggtaaattataagatgcaaaatactcacctttttagcattaagtttttacagtgctccttaacatccaacatttaactagttacataaagatgcagtgttttctatatattaacatattatttcacattttgttcattaggcttttgaaagtattttagtatgaaggttccatttattgtatccaaaaataaaaatagcatcaaagtctttttgcaactccccaaacacagttagtgaataatgatcgtatgctaaaaaatgtaaaatgcaatttgtgccgtgccccatttactacaaaatcactacgaacaatgcattttgtacagtatattgctccagggaaactggatcggcatcaggaatgaataaagaacactgcatttgaaatcagctaattctgcttcagcgcttttaaaaactatttgttatgatattacttcctgtcaagcacataatgtgatattttcctcaataaaactaaacagttgctataatttcagcttccctcattttccactttttaaacactaaatatttaaacaatgcagacctggaagtctctagccagtcatctgatccatgcatctccttgcctaaggtatagtaactatccatacgggggcctgttatgtcacactgacatacttagtggcagctgtcaaggtccttacctgcccacaggccaggcccattcctctttctcccatgccatgtggacatgataaatttaactccagggcatctgctccagaatcctttaaacaagaaaggaaaatgaaagaaaaggcaaagctttatttatataccaataggctttcaccgttgataacacaagtcacatttgtcaagtgttaactattctgttttctgcatcacagctatcttgtgaggtatagtctctctctctcaaattaaggtctatataacaaccaccaccacaacaacaatcacacaccaaatatttactcagtgctcataaggggccactcactgctctatatgttttatatttgttacctctaattctcataatctttgtattattatgctaccaagtttacaggcatgtgaactgaagcatagggaggttaaatgacaagcttagttattaggtgacacagtagagattgtaactcagatctgtttgacatcacatttattccttcctaaatagcttctatttttatggacacaaatcttactaattatggataactgatgctgggattaggcatacaaacaaaaatgtagtaggctagctagaatgaataagcaaaatgtaaaatgtttttaacagaaaatcaacattatcatacttaaaaacagtttgtctaagaaataggaagtattgatagttttgtcttaattacttaataggaatccttcttatttaaatcattaattccttgatatacaaatagatcttgtataaatgaacaacataattcattctaagtattcttggaatactttgagaatcttagaattcgtgggaagtcttctgtaaagaacatgaagaataaacaaaacacttttaaaagttattataggccgggcacagtggctcacgcctgtaatcccagcactttgggaggccaaggcaggcagatcatgaggtcaggagatcgagatcatcctggctaacacagtgaaactccgtctctactaaaaatacaaaaattagccgggcatggtggtgggcgcctgtagtcccagctactcaggaggctgaggcaggagaatggcgtgaacccaggaggcgcagcttgcagtaagctgagatcgcaccactgcactccagcctgggaaagagcaagactccgtctcagaaaaaaaaaaaaaaaaaaaaaaaaaaaaaaagttattatagtggccgggtgcagtggctcacaactgtaatcctagcacggtgggaggattgcctgagcttaggatttcaagaccagccaggcaacacagtgaaaccccatctctaccaaaatacaaaagattagctgggtgtggcggcctgtgcctgtaatcccagctacttgggaagctgaggcaggagaatcgcttgaacctgggaggcggaggtggcagtgagctgagaccatgccactgcactccagcctgggtgacacagcgagactccagttccaaaaaaaaaaaaaaaaaaagttattacagtaattttagagatggaggaataaactagctgattcaaattttatattcttttacctaacttctataatttttccagtgccgcggtttatttttcggtaaggccaactagaagcttgaattggttataagagtattttaacaggtttatcacatgcaaaggcttaaaaaatagttcactactttctaagtacaccagacctttctttagggcaacagttgtttcttctttctctttccttcctaattgtttaagattttagcctattttttcctgctttgtgaattttaagtaggacctcaacaaatttaagaactccagctagtcattaatcggttgatagtcttgcctatctttattcattagtgagtctgctttttcttctgcacatttgttaaagtccatttgatcattgagcctgtttttaacatggtttccttatggttttgctttcctaatccgattttaaaggtcttcatgttatttgagagttgctgaaaaccatgctgctctttccttgatggtttggtagtgagcatggatgagcacagcctgctgaaccctgagttctaatcttacgcctgtagctaaggaattggggatgatttggacaagtcagtcaatcttctttgtctccagctgctcaagtgtcaactgtggataatatgacctgtctcaaaaccatgtcatgcggtaattaccagcttagtgaaaagattgtatagtgcaagtatacacttataacatgtttcttattatttcctggttacttcaaatatttcctgtagacttctctatttaactgaaatgcagcaattaacagcaaatcaattcaacatcattttggattaaataaggctttgcataataattttatacatatttacattatgcatatttcatttcaaacttacacctagctaccatattacacaataatagcttacattaattgagcatttacaatatgccagatactttactatgtcctttgtatgttttatcttactttatcttcacagcaactctaagaggtaggatatatcatcatttctactttacaattgataaaactgagacataaagagttcaagtgatttatccaacatcccacagcttatagctgatagtagggtcttgaactcaagcattttgagtccaggacctgcatttatacccactattataatttactacaaatcacttattttatggctggagttgtcatagtgtgttacgaaaaacataacagctcaatatccttacagcttccaagcttgaagtaaaaattaaaatattttaaaatcacctgttcaatataaaattttttcactgactaattattataatttccccaacattatacacatatacaaatgcccactcaccaaacacacctggcaaggcctttgaaatgtgtatccaagcctcaaaaacagacaatgctgttcaaggtgacaccatgagaacaggaacattcatgtggcctctgcttgaaaattcctgtctcaggatgcacaccaccttaaaaggcagttaattccatttccaagcaactctaaccattcaaaaagccttaattgctgaattagcatgaaatgttaaattaactgaaattgggcatgcattctgattcttgttagtcacaagctttttagtttagtcacttacccagagtttattccacctcacctaaatggttataaaatgaaatatcctagtgatggcagtgacataggaaatacactgttactaatttcctacattatctatttatcatccatctatacacagtagaaagagagagtttgtgtgtgtgtgtgtgtgtgtgtatatatatatatatggtgtggactctgagccaaactataggtttgaatcccacttttactccatcctagctgtgtgaacttgaacacactctttcactacttttggccttagtttcctcaaaaaaagaaaaaaaaaaggaaaacatcaagtcagagaagctagaactccaaaaaatattaaaaattaaaaataaaaatatatttaaaaagtggaactaagtcacagagttgttgttgtaaggcataaataaatttgatatttgcacagaagagttctagggagatgtatttttaaatgtttccaaggctaacacaggaaatgaaaggtgccaaaaaagaaagtttattttttacagttttaagtaaacagaaaagaaaaataagagctttaacatatataagagtttaaagaggagtgataaaaaataaaagtaaatgacttctggaatgtagtaaatactataaaggtgtatactatctatctaaatactttatctatctacctatcaatcatctatctatctaaatacttatctatccatccaaatagacctctgacttgtccttcctctgccttgatatgaaaatgatttaagataactcacctggtcctacattgtctatacctcaggagggaaaggaaaactatcctgagaaattcttggaatatgacagtggtatagtttttaaaattctctgaaccactttataaaaacacccagagaaactaaggtggcaaaaccacaaactcttgtgcaacatatacaatgaaatcatgcacaaagcatttctcctctcttctccttctttccttacctcttcctttctttcccttaccttcctgatcaatacagctctaaagtcactggtcaggcagggcaagacaggtgagcacgagcatttgaggagccatgagggcccagtgtgggatgtcacagcctaagcggagcagagccagaaggatgtctacatggccagtggcatggtgtggtatatcacggtccaagtgggaagggaagacgtccgtgggtgataaggtctggcaaaggacatcagagctcaagtagggtgagaacagtgtactgtactggggcatgaaaggcacagttattggattccctcttaacttcttctgttaaatgaatacatggggtcagatgttgactttccaagtagcaatgctatcctctagtctcaactattcaaaactggagttaaagttctctgggatcttaaacctctctgagatagacctgggacaggtaaaacactcttggcttgggccccactggatgtaaagtcagttactatctctcatctccagctgcgtgtctatctcctgtgattccattctgtcctgttactgtccctgttcagagacttaacatccaactggtcctacatatctctgtaatgtgcctctgtttgatttttacctcaaactatttgggatttctaactctcacagctatttaattcatgacatattgctgtccagattcaggtaaagaaactgataggaaactggcttgttagtgttttagtgttttattttggccccgccaggaatagtgtggtcacttggttttaatgcctatgcctttctgctggaccttccttgtctcttcctaccaaaggtggtcagaaccttggcaatctctcatcaggtacctgacttaaaatcatcatcactggattttaaacacttcaagttcatgggtgccaaataaaataccattcttcccatttattctgtaatggcttcctttttgtttgtcacatggcaatactcgaactgtatacttcttttttacttcattcaacaaatatctgctggtaaagaaagccttgtgcttggaattgaggattaagcagtgaaccatgcaagggtctcgacccccacggaacttgctttctaacaagcaggacagaggaactattagtagtggccaatgacacaactgttaatcaccactttattatatgctacagaggaaaaacacagacagaggtagatccagattttggggagcctaatgcttaaataatttggaaaaccctctttaaggaaaaaacaataatcaaacattgtaaacacagagttaggtacagggacttgcaagtggcccatgcaagtaaatgccctgaagcttaagcttcattaactatctggtcaactggcctctgaagacagggtcttacagaataggacagggaggtttaaactacgtagccagaggctcaggactgaggaagagagaacattgcaggccaagggaacaggaaaagctctgagttgggaacgtgttggaggaggaaaagaaggcagcgggatctggaatgcagaaaacagacccacagtgacaatggggagaggcaggcagggcaggggccaagtagcacttaatggtcaagttaagggttctgaaattaggaaagatggaaagaatttggattggttgagagcaagaagattagtggagctattgtagttaaacttggtaatgatgcattttggaccacagccaattatacgcttcctcaaatttgatggccctacttgtcacccaggaattttgccactagttaaaggggagccccagtcccttttgctatcttcacatctcctatagtaactgtccgctctcacagactccctccagatgagagtgggttgtgtcacaacctccactgagcctgtcaaagtgagagctccaggagcaccagtgcccaggccccatcaggaggctctggccttcccctacaattctgggtttagaagaagcatcacaccccatgctagcaaatctagcttccctagcagctgccctgaaggggcaggacatgcaactcaaaagttcagaggaaaggagagccctacggagtgaaatggggccagtgagagacaggagactgaaggagccagtagactcattccttccacttcctttcctagaaagtgatgagagaatgggtgattctatcatcttgtgaaatgatgtgctattccctgtcccatatgactgagcaattggctccatttccttgtgaagttgtggccagctctggaatgcaccatattgcacttgttttcccttcttcccatctcatttttcttttctcctcagtctttctgctctgagattgtatacttcaataaagctttttcacattaacttttactcgggctctattttcaaggctgattacaaattacaaaagaaattgattcaagatcgactacactggattaaagatccatttacaagtgaatattgtgaaccttcagaaatggctcagtttggcatatatctgattgctccctattactcatctttgttttggctagccagggactttatacatagtaggtgtttcataaatcttcttttgcatagaattggagtagactaccaaggttccagaaaagcaagagagcctgtgatcaggtacctggatcaagaaaactaactagattctaacaatgctactaatttgacacaagcagtagaaacttctttgtggtgctcaaaaacatgacaaattcaaaccaggttgaagaatatagaacatgaaatgcatgtgcattctaaggctctactgctccatatgtgtcatttctgtttcagatgaagtagtaaaaagctgatagcaggtttcctcagctctccattgtgtaattcaagaattaatctgccataaagacagttttataaacttaaggtttagtatacatcatcatcacatcacagcattagctaaacttgaaacagttggcatgctagagtgttggtgtggtgtctctgatttcttacatccctatatcaccaccccaaaagaaatgtatatgttaggtagtacagtaattttgacttgaatatgtttttgttggtttgttttaacgtgggtttttccattgtaaggaaatctgttttaaccggttttgaagcatattcataaaaccaaaaccaaatactgattctacaaaacgttattgggtgcctaccatatgagctgtgatgaaatcatgctgcttaatgctaccctcctagaagctgtgaaggcctgcgggatacttccttcatatgatatctcctgggctagtccagacttaagattatagtgaatatttttattttttaattgacattatcataacctcttgttatgtagactgctctcctatggagagattttgcagactgttttgattgaacaaaaggcataccttttcctcccttctttcttttttttctttcttcctttctttttatttatgtttttgctacagagtaattagaaggtgatattaaataaaactgaaattaaagaaaaatatgaaatgtgaaaaatatctttaggttagctagtttgcttataattaaaggcttttgacttataaaaagtaatgttgtctatttaaaaattaatgtctaatattgaaaaaaataattttgaaaagtattttgttcttacagaaaggcagagaagcaagcggcatgataaagccattcatcatagtcagcttaaaattggcaaagctcatgccaagcatgggctctgtggaagatttcatggtcaattaggtaaatacatgtatcaaatgaacccagcatggaagatcacgaggccaattactgatcatgtttaatttcacccctctaagtcccagtagtaatttttcccttctcagttttaaaatatccaaataaaatgtataatcaacatttttgaacactacagacagctttgcaatattttataatgtagcgtcaattagttcattggtatagttagatttagtcttctacattactgagaggttttcaaggaaccccagctaagactctccagactattttccatgacagcatgatggacataagtgtataattttaagtatgtatttttctatttgaaatacaaatttaaggcacatggttacttgtttgcatttgtgcaggattcaatttatattatggaaaacctgctgactagtgttccattcaggagcattctgtcccgctcttttatgcatgtctgtattcaaactagaatagtattaaatgaaccttttatactttaaatattcaagagttttatattcaaaatttcttctcttactgtcaaactagtttgcctaaaggcaaggtaagatcaagttagactctcaaaggtagaattaaattttatcatggcatccatcataatatacagtttgcttaacatgcaaataaagagtgtatggattcagagaataaaggatttttaggtagtgtgtgaaatccaagggaccgcttttatagaataaattccttttaaatttacatttccatcattttaatgaaaacacagggtaaacaaattataatagaaatgttttaagttacattttcaattcagttttacttctactgtattatttctcatggcagctctttatttaaaactaataaaaataggagagaagaaataaaataaatatatactaaagtaaccattacctcagacttcttggcaagttccgtccagtcatttttattgtaactgcacataatgctagcaatcacaatctttaaaaagaaaaacaaaagaatataagttcaagtagttatccagttgtacacaaagatatattaatatttacataaatttataatggtaaactatattataaaattagttttcaaactgtgaaaaaataaatcattagaaaatagcagggtaagatagcaaaacactggatgacatttggggctttggaattacattaggagattttctcatttactatctgtgaacacttgggcaagttacttaacttttctgatcctcagcattctctttttcaaaatagagaggattttactggctttgccatcctctgaaagtagcaatgtaaatacatgcatgtacgtgaagggattgtctaattatacaatgccattaaaatgctgtttgtaattactggtacagtgaaaaggttttaagtgatggaaaagaaaaaaaatagtgtctctttcaaacataactcactatagtacacataataatatcttaaatattcatagtgcattatagttttaaattttattatgtattgattatttaactacattattacagaaatcccataatggagactgtatagagtagtaattaccaatgcctcctctgaaactaggatgtccaggttagaaccctgactctgtcacttacttgtggccctgagcaaagtatttagtttcctgattggtaaaatatgaataatcgtgccacttattaagaaaagtaataacagaaattggccaggcgtggtggctcacgcttgtaatcccaatactttgggaggcagaggcgggtggatcacttgaggtcaggagttcgagaccaacctggccaacattgtaaaaccccatctctactaaaaatacaaaaattagccaggtgtggtggcgtgtgcctgtaattccagctactcgggaggcagagacaggagaattgcttgaaccaggaggtggaagttgcagtgagccaagattgcaccactgcactccagcctgggcaacagagcgagactctgtctcaaaaaaaaaaaaagaaaaaaagaaaaaaagaaaagaaaagtaataaaagaaattgctaagacttacatagctcttacagtgtgcttggcactgtttcaatggtttttactttattaacttatttaatcattcccaatgttattctccccactttatagatgaagacgccaaggcaatgacacctgacagtcatatagctgataaggaacagcgccaggacccagagccaggcagtgtgactgagcaagagtctgtgcttttaacgactaggttttgctagcccaaagcacatacttgatacacgtaagtaattatttcctaccattatcatttaaagactatgagattgaggctgggtgcagtagctcacgcctgtaatcccagcactttgggaggccaaagcaggaagatcgcttgagcccagaaattcatgaccaacctgggaaacagagcaataccttgcctccacaaaaaaatagaaaaattagctgggtgtggtgccctgcccctgtagtcccagccactcaggaagctgagatgggaggatcacttgaatccaggtgttcaaggttacagggaggtatgattgcattactgcactccggcctgggcaacagagcgagattctatctccataaaataaaaaaataaagactaagagattgagacacaaagagtttgtgccaagcttaaagttgcagagtctagtggtaagagtcctctaaaagccactgtgctctcactacatagagcttttttatttactttgagaaaaaaaaaaaaaaagatatgctgtaaaagtcagataaacgttttcatcaggagaatagaaagttgtgaccatattggagagagttctaaaaaccagggaaagaagcatgtctttaaagttttttttttctttttctttctggatagactataaacaccatgaaagctggagctgctctgcattagtcatcatctatctacagtaactagcatggtatttggcacgtatcaaagactgaaagaataaatgaatgaggtcaccagaggtttaggagcaaggggttgcattatcagctaacccttttaagaagattaagtagaaatggataccataagttagagaagtgaaaaataaacaattgaaaactgctggcgattatatgagtaagagtgaagagtgattagggctgatgaaggtatctgtcttggtgatgaaaaaataatcagatattaaaatacacaggactagtcaactagagaagcaattaaaaagaaggaagcaaaagatctgagactctgaatcaaagccactgagaaattcgcagaccattagtcacaaaaaggttgaacaacgttccgaaatatggaagccagaagaaacagcaattttgaatagattccttagagagaggaacaaagagaagaaagtaaaagtagatgatggatagagaaggaaaattaagcatgccaaattattgttcattgagtttaggattcaatttttttcgtctagtgaaactacagcttttcagaattggggagaaaaatgtaagaatgcttgttccatggccttttccctaggggctaaaaaagtgagaagtcatactccaagcttcatttgcaagtataaaaggggcaccatgtaattacacagcttcagttagagatgctttccgccctttccaagtgatctaagagctcagggatgctatgccctattctccagttagaaaaaagatcagggagaactatcaaagagggcaccagatcttccaggactagacctaatacctcttggtgtaggcattccttgcaaaaaaaaaaaaaaaaaaaaaaaaaaaaaaaaaaaaaagagagagagagattaaggaccttatttgaaaggaaaaatcaactggggaatgggcagagccctgaggcttattgctagaacttcaagggcagagacagatacagagatacagactgaagaagaagaaaaaattagctattagatactagttaccctgtggcgaaactgataagcaatatgcatagatttttagaaaatttttttcttaaaaaaaaaaaaacaaaataaaacaataacaacaacaaccacaaaacccccacctcctaacataacaaaataatcccccaattcacattctcatgcaactatgaagtggctgctcaatcagcacagtcacagcatgtgcacctccctctccagctcccctctcagggttccacagaggacaagaaaaacctttctcgtgggctgaatctagccaggcagatgggttgaccacagaaatccacagcagggaagcaaggtttagcagccttgacagtaggataagatatatcctctcaagtagggactaacactgtttctctcttttacatggcaattttaattttaacagagctatttttgcttcaaatttatattgactgtgccaggttggttaattgttcaccctgtaggttgctgagaagcatgaggcactacaattggacttgatgaagggaaataaatatcatacagagagttgttcaggacattgcgagaatcatgccactgaatgctggtggggcagcctctgactggggaggggtgaccacagatgggagagatacattatggtaagcagtggtttccattgtatgctctgagcagccaagcactaccctgttctcctttccctatccattgaaagcagactctatcttcttgcccagaaagatgagaaagtatccccacctgcactgatcataggaattaggtactctgcttctatcaaaatccctcagtggaactgggaaagttaaaacttttttttttttctccttggtcactaaactggaatgaagtttattcagagctgctgttgatcactgattcctcatttaaccactttccaatcccaaagcttactacactgggaaaaaataaaacagagacaggagaaagtagacaaacacacaggatggagagagatcccctttgcagccacttttaaggctgggtgcctcactaacatatctgcatatttaaactaataaataccacactttggcttaaggaaattctatttttacattcttgtttctatgatttaacagtcttgacaattactacatgcaaaactaaagttgtcatgttttgaagaaattttcaaagcaattttttaaatcaattaaatttcaggaaaaatgactttatatttattttaaaaatgtgaaatggtctaaggattctaaatatccttatctaaagccagaggatggtttgtgaaaatatgtggtagcattctatttctgagaaataaagatgaccaaaaaataattttactttttattaaaagagaaagcaatttttaaaagagtcaggctaaaagacattaacagtaaaaggacactggacataatttaatatttatttgataattaggaagcccttcagtattttgctgtactccgtttttaatcaagcaggagggaacagattttttttcctaagaaaaaaaaccagaatgatggatattttatatcgtgaaacatcatgcaatgttattagaaataaatacccaatgaaatatatttttaaataaaagcaacatttttctatatcaatatttcacttaatttatgccatttctagtgctcaatttttatggctcatattttaaaacattattgaatgaagagatagtgaaacccagatgctacacagtatttgaactttgtcttcccccatcctacagtttatgttacacagtctggtgggagattcaatgtcacctaattgattaataagcaaattgagcatctaatataagaggaattaaatggcacacaaaaaggagcttgagacattgacttagcattttcgtgtattcaacttctaaccaatatttcttgagctccactatatgccaacagctgttctaactcagaagtgatgaacaagacagaaaaagtccctgccctcctgaagcttacattttagggaggaaaatgtcataatgagttaaaaaaagatactttaattggaccatttccagttccaattgttagacctatttataatattatttttaggaaggtagtaatagaggaggagagcatgacagagaatcaccagaatacataaatgcatgtcagacacatggtcagtaaaaagctccctgagttgaaaactgagagatgagatggcacctcacattaaataaaatgtggaagtgagtaaaagcagccaggtatgtagaagtaactgcaggtgcaaagactgaggtgggaatgagcatggtatgttcaaggggaaaaaagaaggcttttgtggttgtagattcatgagaggacaggaatagtatgaaagaaaatgagagaagcaggcaatagccagatctctgggagctctgaaccctgtgggagattgggttttattgttggtgtaatgggaggccgcagaaaggtttaaaggagggtgataaaataatctgatgtacattttcaaaagatgcttgtgactatagggaataggataagtgggttaagggtgaaagcaaggagtctgattatgttgaaataatgtggctttcataatatccacggagatacagagaagtggatagttctgaggttctagttggtgaatgcttagattcagagagacatagagaaaagtagaaattaagaatgatcctagatatttggcttgaactactgaactgtggaatgtagacaatttactgagatagaataaagcctaatgaagaaagtattgaagaggtccaattttaatattttatatttagtatgtctagtaagcatagcattagtgaagacatcaattgtgccactggatatatgagtggagaattcactaaagaggtcaaggataaaggtgcaagttttagagacttcaaaataaaatggtatttgaagtcaccaggctagatgacttcacaaaaggaagaaaataatatagagaaaaagaaaggccctaggactgacctgggggcacaagagagtgtgatgtcgtgccaagagaaggaagtgttccaaaaagtaaggaacaatcaaccgtgatgaatgcttctgaaagtctgtgtcaaagagtagaaacgtgtccactggatttgaagagacaaaaaccattcgtaacctttaaaacaggggtttcagggaagtgacaggacaaaagtcaggctagaatgaattgagtgaatagaatatgaagaagtagaggcaatacatgaatctctctaaaggttttcttgggctagctaaaagacaaatgaaggcagcctgtacaagatcacgggaggactaatgatgttttcttaatggactatatttgagtatgtttttacactagtgaaaatgatttgggaaagagaaagaagctcttgagaagggaagaggggatgatgaatcgagagtacaagtggagaaagtgggctttaagagaggcagaggcattgtttgtatctaacaggatagaagacgagtagagagagaaacaaataagtatggatgcatttaggtttctaaattcgatgtggaaaaagtaaaatcattcttcttggtgtctacattttctttatgaactagggtgtaaggtctcttactgagagtaaagagaactagttatgggtttgtgactatgaggaagagataaaatgtgaaatagtctctaaaaatgggccaagcatggtggctcatatgcctgtaatcccagctactcaggaggctgaggcaggagaatggcttgagcccaggagttttgaggcttcagtgagccatgattgtacctctgcactacagcctgggcgacagaatgagattttgtctttgaaaaaaaaaaaaaacgaagaaagaaaagaaagggaaagcaaatttactagaacatggtatgattatgaggtcaaaaaggcagatatttaatcagtgttgataatatttatgaaaaatatgattagtaaaaatcaaaggacaagttgatttacaaagttggaacacagattacagtcccctttatattactgaaaacatgaaattgggttttatagattgtcttagagttgagacccatcttatcaagatgctttttagtgcttaagtcattaaaatttgatatgctcctgaaaagccattcttttagtgaattctgcttcgtagaaaatacttttaaattggagtatttaatagttttgactttcattttgactaattaatacaacttaagaaaatgtatacactttttgtaaacatctaatttctatgagacattaacattttgaagcatataaaatgcaaagtatgataatttactaatcaaattttgcatatttctttctctctaaaaggtatctcaaaggtgaaaaacaatgtgcagatgcttatttggcaaaaaaaaaaaaagtagtgctatatggcttccattgtcatcctttgaaattttaaataaaagaatcaaatttaatggtcaactttttttgttttgacaattccatttccttagggaataaataaaattattttattaagtagcttttaaaaactgaatttcattaaagtttacacattaaaaattaaggtgaagaacaacataaaacttgcaatggcttacaataacatgcaggctgtcttgtcaaattcccattgacttcaggtctatgctttttaaaacacattgacaatgctattttggtattctgtaaccatactgtgaactacataggaaatccagtcaacaattcagcttcaagacaatctaaattttttagtagggaaaaactgcaaagtgacgggggtgaacaactataaattacaagcagccaagttaggttttgtcaaacaattcaacaaaatcattcctaagactactgggattacattgatgaggaaaaacagcatgagacatttgattttcaaagacatttaaacaaagaaaataagtttattaaatgttaattaaccatacaacattcaaattttagatgtcctttatgccttagttcaaatttagtgaaagtgagattggtgcaatattcctgaaatatatacattgactataagacatttaaggtgaaataataagcttttctaattttatttgttcattgcttacttaatggtcataaatgagactagtatgcttacaagttgtcttttaaaattatttaaaaattcatcattttttggtttattttggggctgacaaatgtcttatttacacaactatttcaaatatagaaaagtaacatttaaacaatatacaagagtttctataaaaaatcagagatgttttccaacacaacaggaaacaaccactgtaccactctaggagctacagtaacttgctttttcctccccttttgatcactccataatatatttttatttagtttctgtccccaatatgcttaggaactgatctccccaaggttaacagtgacctcaccaaatatattatatacttttcagcccagatctgtactaaactctcttcagcatttaagactactaaccacctccagtttcttgaacccctcttctaactgagctttggagataccacttacttttcctctttttttttttttttttggtgttctttttctacctctgtcaatttctcacatgttgatgctcccagagtccactcacagtcctcttttagtctcatttcacatgcattcactagacatcatattcgcaatgactgtaaataatatctattaatacatgcagaaaatctcgaaagtgtatacctctaaactgcatctttttcctaagtgcaagaattgcatatacgactacccgttagcacttaatttccatttgtccaaaaccaaacttaaatttctccactctaaatttgcttatttatccacactatatatgcttttgtttcactcttttgtcccagatcagaaaactaggaatacctatctttgtcgcccacatccagtgattaaccaagtacttggctgagcattgaaattacctagagagttaaaaaataataataattccaaggattctgtgttaccttgtatggagtgaggtgcaggcatcagagtttttcaagtctctctaggtggtcctaaagtacagggaagtttgagaagtactgctctagtttattttccaaatatctccaggttcctcattgtgactacattaagatcctcaccatttcttccctggattactgcagaagattccttattagttgccccatatctgatttcagccaatactatctgccaaagtattctaaagagacaaacctcctcatatcacactttggcttcaaatccaatttcaggataaaataataggctatacaagaccatagtgcaacttttgctttgaccacactgaattgctttgctttctgagtgtaatttgcatgctgaattctcttgatcatatgtctgtttcttttgtctaaatgtataaggaatggtcaaagcacatggcataataaaggaaacatgaaaattgatacaaaaaaaataatactaactaagataaaatgagagcaaaagaaagggtaatcatttgtaactgtgtgaatcagggaaggcaccatacaacaggaacacttggccaattatgaaatcacccatggacatttagaggtatacctcgaagatattgcaggtttgattccagatgacagcactaaaactaatatcacaataaagcaagtcacacaaatattttggtttcccagtgcataaaagttatgttttcactacaatcaactgagcctttggtgaatcataatctttttgctaaaggaatgtcttgtcttgatggtgatagctgctgattgatcaggctggttattactgaaagctgtagcattttctttctcactcttttttttccttcttttttttttctagatagggtcttgctccgtcacctatgctggagggcagtggtgggattatagcttaccgtggcatcgaattcctgggtgctgtagcaatttcttaaaataagacaataaagtttgctagattgattgactcctcctttcacaagagatttctctgtagcatgtgatgctgtttcatagcattttatccacagtagaacttctttcaatcctcttaaatctctaaaactcagttactgctttatcaaataggtttatggaatattctaaatcttttgtttttatttcaacaacgttcacagcatcttcaccaggagtagatttcatctcaagcaaccactttctttgctcattcataagaagtaactcctcatctcttcaagttttatcatgagattgcaggaattcagtcacatccttaggctccacttctcattattgttctcttgctatttctctaatctgtagtgacttcctccactgaagtcttgaatccctcacaaggcttgcaatcaatttcttccaaactcctgttaatgcagacatctgacttcctctcatgattcacaaatgttcttaagggcatctagaatggtttgatattctatccagaccactaaaatgttatccagaccactaaaatgttctccataccagcaataaggctgttttctttcttatcatttgtgtgttcactggagtaacatttctaatttccttcaaaaactcttcctttgcattcacactttagctaactatttggaacaagaggtctagtttttgccctatctcagctttcaacatgtctttctcactaatcttaatcatttctagctttggattaaagtgagagacatgcaactcttcctttcacttgaacacttagaggccattgttgagttgttaaatagcctattttcttttttttttaaattattatactttaagttctagggtacatgttcacaacgttcaggtttgttacatatgtatacatgtgccatgttggtgtgctgcacccattaactcgtcatttacattaggtatatctcctaatgctatccctccccactccccccaccccacaacaggccccggtgtgtgatgttccctaccttgtgtccaagtgttctcattgttcagttcccacctatgagtgagaacatgcggtgtttggttttctgtccttgggatagtttgctcagaatgatggtttccagcttcatccatgtccctacaaaggacatggactcatccttttttatggctgcatagtattccatggtgtatatgttccacattttcttaatccagtctatcattgatggacatttgggttggttccaagtctgctattgtgaatagtgccacaataaacatatgtgtgtatgtgtctttatagcagcatgatttataatcctttgggtatatactcagtaatgggatcactgggtcaaatggtatttctagttctagatccttgaggaactgccacactgtcttccacaatggttgaattagtttacagtcccaccaacagtgtaaaagtgttcctatttctccatatcctctccagcacctgttgtttcctgactttttaatgatggccattctaactggtgtgagatggtatctcattgtggttttgatttgcatttctctgatggctggtgacgatgagcatcttttcatgtgtcttttggctgcataaatgtcttcttttgagaagtgtctgttcatatccttcacccactttttgatggggttgtttgattttttcttgtaaatttgtttaagttctttgtagattctggatattagccctttgtcagatgagcagattgtaaaaattttctcccattctgtaggttgcctgttcactctgacggtagtttcttttgctgtgcagaagctctttagtttaattagatcccgtttgtcaattttggtttttgttgccattgcttttcgtgttttagtcatgaagtactttaaatagcctaatttcaatattgtcgcatctcagggaacagggaggcctgaagagactgacggaatgagggatttgcccatgagtgtagcagtcagaacacacacagtatttatcaattaagttttccatattcaacgggtgttcgtggcacctgaaagcacttaacaataatatcaaagatcactaatcacagatcaccataacaggtgtagcaataatgaagaagtttgaaatattgcaagaattaccaaaatatgaacacagaaacatgaagtgagtgtatgctgtttgaaaagtggcaccaatagacttgttagaagcaggattgccacaaaccttcaatttgtaaaaaaagcaatattgcaataaaatgaggtatgtctgtattggaaattgatttcaaaatccaaggaggtagagtactccaggtagagtgagcagcaagatcaaaagcaaaggatggtgtatttaaggaatatgctgtgtttaagaaatctcaggtagttcaatttggctgactttgaaacaaatggttacgtttcataaaaaatgaagcaagatatctaagtaggaatctggtttatgcaggtaagggacaaaacaatggtttctaatcagctaagcatttggatttgaattttcgatcattttctctagtaaattcgtgcttctcatgtagacattgccttctgggatgcctctcctgtgccctattgctcctctgacttcctttggcacccctcttctgagattcctcagtatcctttgcatttttctgctatgacatgtatttgtttatatattttatatatttttaaattatatattttaatatatattgtgcctttctacattctagagacagaataaggacacatagatggtaaaggtaaggggttctagatccttttataatttataaagtacattttatatcaaaaataatttttcattatatttgtttctgtatttacagtttagtacagattttcacatacattatctcatttatcccccacaacaatcttgaatttggagaatcttatactgataataatgaggcatggataatttaaattactttaccagggtcaagttaatcaatagcaaaggcagggattaagctcaggtcttttgattccaagttcctctctactacatcaagactataccatattgatttcctatcctttcaatttacattagagattctagttgattttatgtcttcaaccctctcgtggtagattgtttgaaaaaattgttccctcctggtttccatgccacttcggaaggactcccatcaagtgggggcatttatctacccaacctttgggtgtgcgctgattttgtgacttgttttaatcagtagaacatggtagaggtgatgatgtaccagagttaaaccaaggcttgaaggggcctggtgcttttctgcttactctcttgaaatcctaccaagacgacaagccagcataggttcctgaaggatgacagaccacatgacacacagacaagccatccagctgaggctgacctagattagccagtccctagcccacctggaacttgaccacagatggcataagaccaagtgaggccagaagaaccatgcagcatagcccagttaagcaaattgctaacatcctgaatcaagaactaaattaataattgtttcaatcccaaatttgaggtattttgttatataggaaaagctaactgatgccacttttactaagtaccacaataagaactattacatgctgtgtacttgcatatgctgagtactatgtttagaatttcacatgacttatctctaatccttagaacatcatagcatagaagttattagccccactttacagacaggaaaaaaaaaacttcaagaagttaaataactactcacagttgcatggctaataagagtagatacaaagcttgatctgtttgactataatatttatactttgaatgatttttttgtgctccttatacaacctttatagaaaatgtgttggtttacttttatagatggttaattttattcaatgtgtgtcagttttttattatattcattctcagaggctaaccttatttatatgatcttcgccagtgagttatttcactacagctctgcataccatctaagctagaccagcagatggaactgcctaagaaataataaaattagaggaaagaatgagtgagcaggaaccaatgggatgattcacagcttcctgaccattactgcatgttaagggctgatgatagggtagtattggccctttataatctggctccaaatcaccttgctgctccttatcttgacatatcaaactgaacctcttatatatactgcctaccgcatgccacatgtacttttagatgtccattcttttcctcatattggtccttcttgtagtgccatcctagacgtctgactgtacagctcctacctacttctcaaggtctaactcagagctaacctcaactgtatcatcctcaatgatctcagagacagaatcactgctttctcttaatattcaagtgtgctacaccaaccactactcagttcctgttggactgtgtcagatagatgtttatttatatacttctcttctcttgtcccacttctcttacctcactcaatgtgagaacatgctaattattatccacctttagtttcttatcatttggtgcaggattgcctagcacctaatgtaatttagtaaatgttggtggaaagaaagatggcttattattaataaattttttaaaccttccgtttcatccctatgaagattgtaatacttgctacaagcaaaagtgcatgcaggaaactaccatgactaatatatacgcatgtataaaagatcatgactactactgtgtagactgtagtagttatgtagtcatgtagtagtagtagcagctgtcacatatgtatgacagatatatatatggtatgtcttatatgtatatgaacctatattgacacagcatcatcatacaaatccacagtttacatcagagttcactcttgctgttacacattctatgggtttggacaatgtataatgacacgtatccattgttttagtatcatacagagtattttcactttcctaaaaattttctgtgctccacctattcattcttcctcaccccacccaaccctcctgcctatcactgatttctttactgtcaccatagttttgtcttttccagaatgtcatataattggaatcacacagtatatagctttttcattatggcttctttcagttagtaacatgcattcaagcttcctccatgttttcatggcttgatatttataccattttagcactaaataatatatcactgtctgtatgtaccaaagtttataattcacctactgaaggatattttggttacttcccagtttgggcaattatgaataaagctgctgtaaacatccatgtgcaggtttttgtggaaatataagttttcaactcctttgggttaataccaaggagtagagttgttggatcctatggtaagagtatttgtagttttacaagaaactgccacatgctgtctttttttttttaaattatactttaagttttaggatacatgtgcacaatgtgcaggtttgttacatatgtatacatgtgtccatgttggtgtgttgcacccattaaatcatcatttacattaggtatatctcctaatgctattcctccccactcccccaaccccacaacaggccccggtgtgtgatgttccacaccctgtgtccaagtgttctcattgttcaattcccacctatgagtgagaacatgcggtgtttggatttctgtccttgcgatagtgtgctgagaatgatggtttccagcttcatccatgtccctaaaaatgacaggaactcattattttttatggctgcatagtattgcatggtgtatatgttccatattttcttaatccagtctatcattgttggacatttgggttggttccaagtctttgctattgtgaatagtgccacattaaacatatgtgtgcatgtgtctttatagcagcatgatttatagtcctttgggtatatactcagtaatgggatcactaggtcaaatggtatttctagttctagatccctgaggaatcaccacactgacttcacaatggttgaactagtttacagtcccaccaacagtgtaatagtgttcctgtttctccacatcctctccagcacctgttgtttcctgactttttaatgatggccattctaactggtgtgagatggtatctcattgtggttttgatttgcatttctctgatggccagtgatgatgagcattttttcatttgtctgatggctgcataaatgtcttcttttgagaagtgtctattcatttgctgtgccctctttttgatggggttgtttgtatttttcttgtgaatttgtttgagttctttgtagattctggatattagccctttgtcagatgagtagattgcaaaacttttctcccattctgtaggttgcctgttcactctgatggtagtttcttttgctgtgcagaagctctttagtttaattagatcccatttgtcaattttgtcttttgttgccattgcttttggtgttttagacatgaagtccttgtccatgcctatgtcctgaatggtattgcctaggtttttgtctagggtttttatggttttaggtctaacatgtaagtctttaatcggtcttgaattaatttttgtataaggtgtaaggaaggggtccagtttcagctttctacatatggctagccagttttcccagcaccatgtattaaatagggaatcctttccccattgcttgtttttgtcaggtttgtcaaagatcagatagttgtagatgtgtggcattatttctgagggctctgttctgttccattggtctatatctcttttgtggtaccagtaccatgttgttttggttactgtagcctagtagtatagtttgaagtcaggtagcatgatgcctccagcttcgttcttttggcttaggattgacttggcaatgtgggctcttttttggttccatatgaactttaaagtagtttttttccaattctgtgaagaaagtcattggtagcttgatggggatggcattgaatctataaattaccttgggcagtatggccattttcacgatatttattcttcctgtccatgagcatggaatgttcttccatttgtttgtatcctcttttattatgttgagcagtggtttgtagttctccttgaagaggtccttcacatcccttgtaagttggattcctaggtattttattctctttgaagcaattgtgaatgggagttcactcatgatttggctctctgtttgtctgttattggtgtttaagaatgcttgtgatttttgtacattgattttgtatcctgagactttgttgaagttgcttatcagcttaaggagattttgggctgagatgatggcattttctagatacacgatcatgtcatctgcaaacaaggacaatttgacttactcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttttcataagtagctcttattattttgagatatatcccatcaatacctaatttattgagagtttttagcatgaagggctgttgaattttgtcaaaggccttttctgcatctattgagataatcatgtggtttttgtcattggttctgtttatatgctggattacgtttattcatttgcgtatgttgaaccagccttgcatcccagggatgaagctcacttgatcatggtggataagctttttgatgtgttgctggattcagtttgccagtattttattgaggatttttgcatcgatgttcatcacggatattggtctaaaattatctttttctgttgtgtctctgccagactttggtatcaggatgatgctggcctcattaaatgagttagggaggattccctttttttctgttgattggaatagtttcagaaggaatagtaccagctccttcttgcacctctggtagaattcagctgcgaatccgtctggtcctggactttttttggttggtaagctattaattattgcctcaatttcagagcctgttaatggtctattcagagattcaacttcttcctggtttagtcttgggagggtgtatgtgatgaggaatttatccatttcttctagattttctagtttatttgtgtagaggtgtttatagtattctctgatggtagtttgtatttctgtgggatgggtggtgatacccctttatcattttgtattgtgtctatttgattcttctctcttttcttctttattagtcttgctagtgctctatcaattttgttgagatcacatgctgtcttctaacgtgatcaaatcattttgcattcccaccagcaacgaatgagagctcctttgctccagatcctcatcagaatttggtgttgtcagtgttatgaattttggctattctaatagatgtgtagtggtacctcattgttgttttaatttgcatttccctcctgacatgatgtagagtaccttttcatatgcttatctgctatctgtttatcttctttgatgaggtgtccgttaaagtctttagctcattttttaaaatctggttcgttgttttcttattgttgagttttaagtgttctttgtgtattttggataaccgtactttctccaatgcatcttttacaaatattttctcccagtcggtggcttgtcttctcattctcttgacattatctttcactgagcggaagtttttttttgtttgtttgtttgtttgagacggagtcttgctctgtctcccaggatggagtgcagtggcacaatctctgctcactgcaacctccgcctcccagattcaagcgattctcctgtctcagcctcctgagtagctgggattccaggaggctaccatcatgtccagctaatttttgtatttttagtagagatggggttttgccatgttggccaggctggtttcaaactcctgacctcaggtgatctatctgccttggcctcccaaattgctgggattacaggtgtgagccactgcgcccagccagagttttttattttaatgaaacccagcgtatcaataatttctttcatgaatattgcctttggagttgtatttaaaaacacatgtgtcatcaacatattcaagatcatctaggttttcttctgtgttatcttgtaggaattttatatttttgtgctttacatttagatgtatgatccatttagagttaattttggtgaagggtgtgtctagattaattttttgttgcatgtgaacatgcagttgttccagcaccatttggtaaattactatgtattctccactgaagtgtcttactgctttgtcaaaaatcagttgatttaattatgtgggtctatttctgggatgtcttttttgttcaattgatctatttgtctattctttaaccaatattacactgtcagattactgtagctttatagtaagtcttgaggttaggtagtgtcagtcctctaactttgttcttctccttcaatattgtgttagctattctgggtcttctagcatgcctttaaactttagaatcagtttgttaatgcccacaacacaacttgcggggatttctactgtgattacattgcatctatagatcaagctgggaagaactcacatcttgacagtactgtcttcctatacatgaacatggaatatctctccatttatttagttcttgtttgattttgtccatcagagttttgtagctctcctcacacagatcttgtcatattttgatagacttacacctaagtatttcatttgttttgattctaatgtaaataatattatgtttcttttaacttctactttttcattgttggtacagaagaaatcaaatgacttttgtatattaacctttaatcttgccacattgctataatcacttgttagttacaggatattttttggtcaattctttctgattttctatgtacacaataatgtcatctgcaaaaacagtttagtttttccttgataacttgtataccctgttcccacctttattttgtcttattagctagaagttccagtataattatgaaaagaaatggtgaaaggggaaatccttgccttgttcttgatcttagtgtgaaaacttctaatttctcaccattaaatgtgatattagctgaaggtattttatagatattctttatcaaactcaggaagtttctctgtattgttagtttactgagagatttgatcatgaatgggtgttgaattttgtcaaatgctttatctgcatctgttgataaaatcatgtgatttttcttttttagtctgttgatgtgatgaattacattacctgattttttgaatgttgaaccagccttgaatgtctgagataaatcccacttcactgtggtgtataattctttttatacattgttgcgttgaatttgctaatattttgttgagcatttttgcatcttaagagatactggtctatagtttctagcatgtctttgtctggtttgctgtcagtgcaattattaggtattagggcctcatataatcagttaaaaagtacagaggctccttgacttacgatggggttaagtcctgataaggctgtaataaactgaaaatattgttaagtcaaaagtgtgtgcttcaacttctgagattttcaacttacaatgagtggagttatctagacatatcccattgtaagtcgaggagtgtagtgaatgtatgttgcttttgcatcatcttgaagttgaaaaattctaagtttgagactatcggtattccctctgttcctgaaagatattgagagaattggtaggaatttttcttaaatgctcagtagaattaaatagtgaacccatctgggtcttttgctttgttttggaaggttgttaattattgatttgatttctttaatagatataagctgattaagattgtctatttttcctgtgtgagttttggcagtttcaaggaattggttcatttaatccaggtcatcaaatctgtgggcatggagttgttcatagcactctttattttccttttagtgtccctgggacccgtagtgatgtccaccctttcatttctgatattattaacttatgtcctctctttttattcattagcctggctagaggcttatcaattttgttgacttttttcaaataatcagattttgttgattttctatattgattttttttatttcattgatttttgctaattcttattattcattttgttctgcttattttagactaaatttgcttttcattttctgtttcctaaggtagaaacttaggtcattaattttaaatctttcttcttttttaatatatgcactcaatgatataaattgccctttaagtactacttttgtagcacctcacaaattttgataagttttcttttaattttcatttagttcaaaatatttttaatgctttttgacatttcgtttttggcccatgtgttatttagaggtgtgttgtttaatctctgtatattttgggattttccagatatattttgttagcggtgtctaatttaattccattgtgttctcagatcagagactttatgatttctgtccttttaaaatttaaggtatgttttatggtccagaatgtggtctatcttggtgaatgctccatgtaaacttgagaaaaatgtgtattctgttattgaatgttgttgtctatagatgtcaaattatatccagttgactaatagtgttgttgagtttaactatgtgcttactgattttctacctgctggatctgtccatttctgacagagaagtgttgtagtctccaactatgctaatagatgcactacttgtctttgctgttctattggtttttccttggcatagtttgatgctctgttattagatggatacacgttaaagattcttatgtcttcctggataattgatcattttatcattatgtaatacccttcttttgtccctgataactttccttgctttgaagtctgctttgcctgaaattaatatggctactcctgctatctttagattagtgttagcatgatacattttcttcatccatttacttataatctatgtgtttttgtattgaaagtgactttcttatacgcaatacataggtgggtttttaaatccacttaaacaatctttgtcttttaattggcgtatttagatcattgatattcaaaataagtattgatatacctggattaatatctactatattgattaatgttttctatttttttctctgttcctattttgtcttctatactgtttccgtcttttgtggttgtatttcattattttatgtgattcaatttttttctacttctttttagcatatcacttgtactttttttttttttttactttttgtagtggttgccctagagtttacaatatacatctatagctaatccaagtccatcagataaccccgtaccacttcacagatgatatgagcatcttataataaaaaaatcatatcctccctcctgtccattgtgtcactgctgtcattcattggacttatatataggtatacataagcacatatattatacgtaagtatacacaatcaaatatattgttactatgattattttgaacaaattgttattagatcaattaggagtaagaaaaataaacatttttattttaccttaaattattccttctttgatgttcttcctttctttatgtaggtccaagtttctggcctatatagttttccttctcttgaaaaacttccattaacatttcttgcaaggaggtttattctgaatacattctttcaatgtttgtttgtctgagaaagtgtttatttctccttcacttttgaagaataattttgcagagtatataattctacattggtgagtttttttctctgaatactttatttatttatttatttattcttttgtttgtttttttgagacagagtctcactctgttacctaggctggagtgcagttctgtgatcttggctcatggcaacctctgcctcccaggttcaaacaattctcctgcctcagcctcccaagtagctgggattacaggcatgcaccaccatgcccagctaatttttgtatttttagtagagacagggtttcaccatttggccaggctggtctcttaaactcttgacctcaagtgatccacccatcttggcctcccaaagctttgggattacaggcgtgagccactgtgcctggccctcttaatacttcaaatatttaactccagtctattcttgctctttaggtcttgttaagaaaaacagaatgctctgccatattatgaaatggttcttcttctcttccccctgccagaagcagcgggggaattttctctaatactcactttgagaagtttgtcaagcttctctagataaatctcacaatatccttggtgtcccctatgcctgggccctcctggagtttttaactctcagacttgtctgcactgatcctccagaaattcatcaattatagttcaggttttcctacgctggtcctggatcctgatgtggtttccgctagtgagtctctgcttcagtaagccatagttccctatatttgcctgtctatctctctaaccttggcgtagcagttttgccctaagtcctcccatctcttacaatctaagaagagctgttggtttttagtctctttagctttttttttttttaaaattattaatttattttttatttttaagtatatcttatttattttattatagaataaaacctattttaaaatattctttttcttcagacatcaggaatttttatttatttatttatttatttttattatactttaagttctggggtatatgtgcagaatgtgcaggtttgttacataggtatacacatgccatggtggtttactgcacccatcaatccttcatctacattaggtatttctcctaatgctatccctcccctagccccccaccccccgacaggccccagtgtgtgatgttcccctccctgtgtccatgagttctcaataggaacgcttttacactgttggtggggtgtaaattagctctttagcgttttacttgttaagatggagtggcaacttccaagtaccttacatgtgtaaccggaaacaagctatcatatatttttatgcctataagtcattcactgttttcatagcatgtctggtattgatattaatctacaatatccatttgagttgttctatcacttttgagctctcattgaggctgtagtaagtcaactaaagtcataagatttgaatgcactatacacaaacaaaaaggtgtgttttccacataaaatctgtgcatgatattttctttgcttttatttaaaaggtcatgatatagtacctgcaaggttatggttcatttaggaatagagcttttcaatggcacataaagagcttgatttaaaatgtgttattatgcatttatattccaattataaacttcctttcagaggctttaacaaatattcatttaataaactacctttctaaattaaaaaggttaataattaatgtagtattaaaatgtaacataggaataaaaaagaggttaataataaaataatgaaaactcttaaaataattacatggaatgatgcacaacatcaaatagtctgggtacattttccaaaaccatacatttaagcacatgggtgttgtaaagattattaaaacattttctttaaagattttacattcccaaaataaaattctatgtcaatacttattttaataattttatgagatttagctctttgctctcattaactatgattgcatgtttaatgcatgttcaattagataatcctggcgtgtacattagtggtactgtgtcttaggcaacggatggcaaactcctagaggacatgggctatgtcttctagctcatcatgtccctgtggccagaaactcatcagcctgaagcagctggattaatagaatggtggaatggccttttgaagtcacaattataatgccaactaggtgacaaagctttacagggctggggcaaagttctccagaaggctgtgtatgctctgaatcagcatccaatacacggtactcttcctcccatagtcaagatacatgggtccaggaatcaaggggtgtaagtagaagtgacaccactcaccatcacccttagtgacccactagcaaaagttttccttcctgttcccacaacattatgttcagctggtctagaggccttacttccagaggaaataatgctgcaaccaggagacacaacaacgattccattaaactgcaagttaagattgccacctggccattttgggctacctctcagtcaacagtctaagaaaggagttatagtgttggctggggtgattgacccagcctatcaagatgaaatcagtctactactccacaacggagataaggaagattatgcatggaatacaggagatcccttagggcatctcttactattaccatgccctatgattaacgtcaatgggaaactacaacaacccaatccaggctggactataaatggcccagactctttaggaatgaagatttgggtcactcaaccaggcaaaaaaccatgacctgctgaggtgcttgctgaaggcaaagggaataaagaatgggtagtagaagaaggcagtcatcaataccacctacgaccacgtgaccagctacagaaatgaggactgtaattgtcatgagtatttccttcttattttgttaagaacatgtttgtgcatgtatacacttttactaggaaaatatcttcattttatttccttttttcctttatcatgtgatgtaagatttattgacttcatataagaatttaagtgttaactttatgtaatagcaattagggtaaggattaatgcacttctggttgtgcaaagaatagctgtgtaattatgaccttattattgtctttatttggagattatgtatgatttcaggagatgtgtatgggttcatgttgacaaggggtggacttgtgatagttaaaattgagtgtcaactggattggattgcaacgtattgttcctaattgtgtctgtgaggatgttgccaaaggagattaacatttgattcagtggactggtagaggcagagccaccctcaatctgggtaggcaccatctgatcagcttccagcatgactagaataaagcaggcagaagaaggtggaaagagcagacttgctgagtcttccggccttcagtctcatgctggacacttcctgccctccaacatcagactccaaattcttcagcttttggactcttggacttacactattcatttgtcaggggctcttgggccttcatccacagactgaaggctgcactgtcagcttccctacttttgaggttttgggacttggactggttcccttgcttctcagcttgcagacggcctatcatgggacttcaccttatgatcatgtgagtcaataatcctttataaattccccttcatatttacatcagatatacatctatcctattagttctgtcctctagagaacgctgactaatacaatacatataagcacatgggttttgtaaagattattaaacattttccgtaaagattttaaattccccaaatatgattttatgtaaataatattattataattattttatgagacgtagctctttgctctcattaactatgattgaaagtttaatgcatgttcaattagataatcctggtgggtacaagagtggtactgtgtcttaggcaatgtatggtaagctcctagagaacatgggctatgtcttctatctcatcatgtccctgtgggtggtaatttgctggtcctttttatcaaggtacctgatacatagtaggaactgagataatatttgttgaatcaagaacaaatgaaagaatcattgagatgtaattaatgcttgttaaatgcaatgctttaaaaagtcaaggacttgtaaaaacacacaacttactcttttccaactatgtctatcctattacctcacagaaattctaagtgaaagcttagattcattcactgtgaaacatgttgcataccctcccacttgagagactctaccttggctgcctgctcaaccttatatattcttccccagacatacacatggtgttcttccacatcttctttaagcctctgctcaaatgtcactgtctcagtggcactctttaaaactacagggccaggcacaatggctcacacctttttgctgaggcaagcggatcacctgaagtcaggagtttgagaccagcctggccaaaatggtgaaaccctatctctactaaaaatacaaaaattagctgggtatggtggtgctcacctgtaatcccagctaaggcagaagaattgcttgaaccggggaggtgaaggttgcagtgagctgagatggctccactgcactccagcctgggtggtagagcaacaatctgtctcaaaaaagaaaaagaaagaagaagaagaagaaaaaaaaaaactacaaacgacctcctcccagctctattttattttccatagaactttctattatatcattttcttatttaatatatttattgtctttctctctgcagctgaaatgtaagctccaataaagtgagaatctttgttttggatacagaatactgctgacatagagtagatgccctgtaaatacttgtggaatgaataattagacactaacatatcatttgaaagtctttttgcatcagctacccgatatataaaatgaaaataatttggttgccatacttatttcataggactgttcttagaattatattgtatatttgacattaaatagttttcaataaattcaacgattattttgataactgaaagaataatgtcatattcagatttgccttttttctacaatttagctagagtgcaaacaatgacattttgaaatagcagaatactttggttttaaacatccggagataagactttaaaaaatatgccatcggaaagggtaaaaagcatcatctttatatgctcctttgatctttctgtagtgtcacattgtgagcatattatatttgtgaattaatgcagtttaaaaaagaagtagagctatagaaccaaagtttatagatagatttatattttataaatattttaaaattatttttagatttaaccaaaatgctagaaaattcaccaatatgtaacatcactttttagcaaattatgtttcctagtttacattgcttgagcagaattgatattaaaaatttttgtcctacttacacagaaaaagttcctagaactgtgagccccagacatgtgtgcctctctgatttgaaggacccatagagggccactattgcaaacagatactacgtcaaagatagaatagtgagctgggaatggctacaatgttgggtgaggaaagaatggacggtggggtcaaaactaggaatcatgttctttacctgaatggtctaaagggcatgcattctgatcacgcagctggatgattcttttccaatccaggctctacatgagacataaagattttcattgcacttatctgtctcctatgcacttcaataatactcatcctctttttccccgtgagatcatctccttcagtactgcatcttcaatgcccatctctgagctggcacaataatgaagctcagtgtaaatagtgaatgaataagctaatgatcctgtgtactattcctgcacaaatcaagtcaacttcactttttttctgctctccttcctcccactttatcatattccatcctcactacaatttccctcatctctataagatctttctgtacaagaaggtatttccacgtttgaattcacgagcttccacctccattttgagctgtcaatcctgctaacaatgagcaccccagtaaacaacaatagaaaaaaaaaagtaaaaacaacctctaacatgtctcactacttaggataatgattaatgatactaaaataataaaatattcatttatcattgaatactcataaatcattcctttgccttaatatgcagttgatgcttagggatcaaccaaaaatgtttcccacatttttaaaacatcatagggtttaatcttcattacaaatttcagttcaaaatgtttcttctcagaagcatgacaaagtgatttagagtagaagtagtgaaaggacctttttcaaagtgattggaacctttctggtatagacgttaaacagcataatgaatgtgttggcatttgtttcttatttgcatactataaaaataaaacagagtgtacaacaagttcctgttaaattcatattacctgtttaaataaggatattcaaaaggcaatgtgatctaattaaaatcaagaaatggtattcaagccatatttatatacttctatgataatacacatgcactaatatttacaatgcatgcaaagggtatacacctcattaagcataccgggaggaaaattccccaatttcttcaattcaactagtcatttcataatttttttctaatgtgaatgttagctatttcaagtgctgaactaaagtcacatttaactataatcaatgcatttgcagttgtagtccaaagcaaactctgaaggacgttctcatagtctaaaacttgacgcattttgaagataatacactgaaggcttgaaaacaaactatttactcccttaaatgtgcctttttctcattgttcatactttccagcttgctcacaaatgcccaaatgttgatatcaatgctgtttctaagaaactacaataaggggtttgttttgcaatcttttttctcccttctcccacacataatcacatgatctttgaaacttacaaaacgaataggagaaacgtatcctttcaaaatgaagtaactttatggggttatagtcctctaagagcagattatgcattttttataccataaaaatttgtcaatttggaagtctgtttaaaatataaatgtataagcatacctttgtcttagaaattattatatgaaagtatggacaattaagttttaggaaaaaagtgtacgactacagttttgggtcattaaatgcatcctgttttgagagttgctatgtattttcaaagagcattataaaatctatagcactgattgttttcattaattagaataaagcaagaacagcctctagaatcacttgatttaaaagacaaattctggttcagaaccttctgaattatttacaaccaactccacttggtctatcatttaatgaaagaacagaaaggtgtccttcccccacaccaccctaaacgagtcatcatagtagaatgccataaaagcctgtgatgaggattttagtctcagatgcagcctatgtccccacatgtctcataaattcttctaatgcattttcacatccatgatcatgaatgcctattcaatgaaagggtttatcatatgctacacttttcaactaccaagaacaaagagtaaatggtccctggccccatatttggaacaaaaagtatgaaagcaaaacaaaaacctcttacatttttactaaataaaagaatgaatgcagactgtaaaggctgagtggaaacttcttttggcaccatgatgttctttcttgagaccatgctgcgttttctctgctcagtgagggacagatagaaaaaaatggagatacaaatgtagtcaacctcatgtgtcacccaatccatcttctccctactaaagaactattcactacattatagcattaaatgtttccatcagtatgctttaagagtaatgcggatttttgctatctatttaggaggaattcacaatatagtagaggtagctactgtcaagagtttttcgttgtttttttgtttgtttgtttgtggactggttctggctctgtcacccaggctggagtgcagtggcttgatctcggctcactgcaacttctgcctccctggctcaagggatcctcccacttcagcctcccaagtagctgggactacggacactacaggcccatgccaccacacctgcctaattttttgtgttgtttttgtagagacagggtttcaccacgttgcccaggctggtcttgaactcgagctcaaacaatcctcccacctcagcctcccaaagtgctgggattacaagctagtttttgtctttcaatttctccctcaagctactcgtaattatacccctagatcaggctaagcaatttcctatcctctttttttttcaacatattttcatgacttggagtattatttctcattaggtaactatcagccaagccagagagatttatgcatttcttaagtgcacaacatactcacaccaaattatatataaataatacatacatatgtatacatagaagttatatgtagattataatatatacaagtacatatgcacttttccttcaaccaactgccccagtgacttcactcagaaatagccacctatgagacaaaactactcaacaaaaagaaataaaacaaaacaaaaaaactaaaagaacagtaaaaaaacaaaaaacacacacacacatattaaaaattctacaacttggaaggagacataccaatatacacatttgatggcaaatttttgtctagtctaggaaaatgccttcttttcaaattataatttattacaattagtctatcagttggttatcagccttggttgagtagacaatttccattcaaggactcactgtatcaaaatactatttaaggcaaatatacagtagatgctgtgaagctcagtaatatgggatattatccctatcttatggtcttgaagaaatctcataaaaataattcaaaattaattagtggctacatttcatgtattataggacttgtacagtttcggtcaagcagtggtttcatggtgccatttttctgatgtgcatcagagggggctcagaatagaaaattcatttgggtttttaactataaatgtaggaagctcaccttctaaatacactcttgccttaacagtgtttattcttatatagaattactctgtcccacttcatttcttactggactcttatttatttgtagaagagattgtattcttcactgaatatgctgtagctagaaaatgtcttagttaagtctttctaggtgcgaaatagggtcacagcctatatcttactaggcgtcctagcagtaagcagtactgaagcaataatattgcctggcattgtgtttggcttttagtttggctggcagggccagcttcttccatctattcatcctaaataacattgtcagcaaatcttttttttaggcaactgcaaataatcttcattagactatctcattctttttttaaaaaactcattaacttatttcacttttagctaatattttctttatcaaatgagtttctgtgtaagtagcatggctgtttttacttcctatgaagctacccttcctaaagctataaaagaagaaggagaaaactttcattacgggaaaaacaaacaaacaaaaccagaacaaaagcaaacaaaactctacaaaaccagaataaaggcaaacaaaactctaggacattggtagaatgaaaagctgggaaaattactatcaacacacatagttttcagactttcttaatttaagcaactgttgtagcacagtcattgatcctatctaaatgaatcaggatctttttcacaatctccagcctcaatgaaataacacttcatctacaattatattattattattagagactcacactgtcacccaggctggagtgcagtggtgcagtctcggctcactgcagcctccgccaccagggctcaagcgattttcctgcctctgcctcccgagtagctgggattacaggccaccgtgcccagctagtttttgtatttttgggtagaggtggggtttcacatgttggccaggttggtctcaaactcctgaccccaagtgatctgctcaccttggtctcccaaagtgctgggactacaggcgtgagccaccatgcctggccttcatttacaattattaaaaaatactatgcttcctgagttgtccatatttgaatgagatacttatgaggaatgtggcattttccatgctttattactgataaattttttggacatttctgctgcatcatccattctctgtgataaagattgtggtacactaacaggtatgtttactcctatagcatgtgcagcttgtacagggtatggcttttaggaagtaatatcattttaaaattaattgttaatttctatgtgtttgtcctgtcttcccaagaagtttatactcctttgatggtggggtctctttcttataagttttattttctcgtatataatgtcttatacatttatgagtcgtactcctgattagtagataaggtaactattcaataatacctgtcttacaataaaaaagatgaaggagatgacatatctagcaagagaaatccaataatattaatgcttaagaaccattgatgtttcagttctcatttgtcagaatttgatattaaattgctttttgtcaagaatctggaaaaaacatgtcataatatagaatcctttataaaaagggcaatctaattccttatagctcggaaaggacttcaaactgtgtcattccatttgccaacaaggaataaattcacataaattaatctctcattcatgtaatgtagtacagaaatttatagtcttgtcaatagttcatgtggagctataatttgggataggtaaaggaaatgtatccagtgactgtgtatggtgctatatccttccagaatcaatgactgagaaaatgttttactctctgattttctttatccattagatatcaaatgtttggacttctctcatttttaactttgaaaatgctattctgttttagttccaaggtatacagtgacatgcttccatcagaaatggatcctagaatactttgaagccactgatatatcacttctcttgaagtatttctgtggtagtcagcagttggcattgcctgtggtagaaagcttcacattattcttggtgaaacagaaaagaattctgtctggaaatcattagggatccatgacctataaagctctttgcaaacacaacacaattttaaacaaatgcaaaagtcttgctccactcatcactggaatggcaggattaattaatatcctcctgagatatccttaacccagaggtgctcatcgaacccccttttaggtagaccttcgcttcatgtgcagccttaaggattagttgtcagcatttaccctcaaataaaatatagccacacaaatattaattaaacaatttcaattttcaaaagagtgtctggaaagatctggagccagatatagtgaagtctgactactatttcccctgcttgctagctggagaaatatgttcctttttaaaattattactaattaaggcacattattaattatttaaaaatgaacatatttccctaaaccctacaagagaggccatataatctagtaaaagagcatgggctttcacatttactagctgtggatcttgggtaagcttcataatgtcttggataagttaagtaacctctgtgaccctcagtctcttcagctgtaacatgaggttaataagagttgtcttagtgaattgttgagttggtttttaaagcatttctatttgtttatttgtctatttatatctctgtctctattgctatctctatctccattgcttcttttatatctgtattttaaagtgaaaacttaaaagcactcaaccaatattagctacttcctctgcccctgtaattatctaaaattattatatatgtcttgcattcaaataatcaaccaaatatgtaaatttcaatttcaacaaataacatactctaatatatgctttttactgtttagtaaaattgagctgaaagattgaaggaaatgttcatttcttttcaacaaagctacacatagtaagcaaaaattctttaaatagccatattgtgttgcctgatatatttgattttgaatttattttacgatgttgttttcactttaatttttttcaatattgaaatacaaatgagcttcttattaaaaactacctagaacattgagtcccatacaataagagtgttaaccattgtaaaccctgtcatgtctctgggaagcagaggaattatcttgttatcagtttaataatggaacattgaagtaaatgatgccatccactgacaccagtaacactgtctctctggggaaattcatgtctgtgagaactgtcaatctagatggatacagacatattaaacatactcccttcaatccataaatccaccctttctgggttgccttaataaaaagatcccttattttgataaagacaagctatgcagaatatcttgacattactgatctataatccctttattttaaaaaagtattttgtggaaggatttagtaaataagttaacaaattttcatctacttcctttttgtgctttagcataacttacatgtaaacatgttcctgaggttttaaattaataaagtattaataactacatagagatgtgggaaatacatataatgtatttatttccactacttgctttggcaagctttcttcaaaacacagcttacttttgttgttttgcattaaaattgcctctagttctaattgagatagatataagatgattttttttttttttttgagatggagtctctgtcacccaggctggagtgcaatggtgcgaccttggctcactgcaacctctacctctcaggttcaagtgattctcctgcgtcagcctcccgagtaactaggattacaggtgcctgccaccacacccagctaatttttgtattttagtagagacggggtttcaccatgttagtcagactggtttcgaactcctgacctcaggtgatccaccctcctcagactcccaaactgctgggattaaaggcgtgagtcactgcacccagcctaagatgatttcttatattaaaagtatcacacgttttcccatgagaaaatatgacaagaaaaagtaaaaattatcaacataaatatatcaatgaaatatacaacagtagaacataatgaaaaccttctcagtgcaaaaatacactgtattacagaacaagcaagaaccaagaaacaagttgaattgcattgttagttaccaaaatgtgttggtatatcttagtttgccagagtagactaaattgcattaatggacacaggtttcagccaaagcctagaagcaatgacacttaccctaaagactgaaaaaggaaaaataagtatactgaaaaaaggaaaagaaatccaaggtggcagcagggattctaagaaaaggctcttataacctctaactgattttgaattcttactcccagacaatgatgtttcagggtagagagggcctacttgccatgagatcatttgactttttcttatctaagtgcttcctagacaacccaatggatatcccacaggcaccagaaactccattatgcaaaaccaaattcttcatctcccttcccaaatctctacctcctggtgcattttacctttagtgaatggagccatccaacatacagttgcttaagtgataactgaaaatcactgtataatactttcttcttcatatgcaatatatgccctactcttgctacttgaataatcaccatctctggtaattccaactcctataccactcaaaaactcatcacctcttccacttccattagtctgctgtagttccggttatccccacttattaccaggtcctctagacctggtacgtaatcactattataatacattatgatttttgttattcacaacaacgctgtaaaataggcaccgatattccaattttaatgacatctttgaaaattaaaaacaatttttgttaaaagttaattgaaacagtttagaagaattgaatacgatgagacaaaatctacctataaccccaccctctgcctccaggccttttccacatatgtgaacactattaatgttgtgtatctttataaaaatatattttttataccaaaaagataatattaagcatacagttctgcaacttggactacattaaaaaataccacagtaaacatgggtttatacctatgttggcaattttatccactgagtgaaattttaattgagaaatttctaggtcaaagagtgcatgtattcaaaaattttattgctatgttcaaattgttctgtagaaagaatgtacaaatttataatcctactaacagattctgacaatgcctattttcctttattctcgcatagtcttcagaatcctagcaggaaatagaaaggacagtcaattgtggataaaatgaataaatgttatgtaaccacttacaaagatatagccttgtgcaggaaaaccacaagggacagtagaggacactgggagtggcagtaaggacccaggaccatcttaagaccagagcctggcaaaaagggccaccagacatgagctgagatttcagtggcatccacaggtacttcacagtgaccctgcaggaggcctccccctcctcagtctctctgatctgtcctgactgagtccagctggaacctagagggcaaggtggccaactgaagtaggtccgtcttccagatgcagatactgcgtcgaagggaggcgagtggatctgagcagcaaattgaagacatggagaacacttcgtaattttctggggttgaagatgaaagagtctgtgtttaatgtgaaaacttgtagatttttttaccttgccatgttcatttctgaactcttattttttccttggctaactggttttgttgtctctatccttgctttcccttccatcaagtttctgcagagccactcaaggatctttccaaaatgcaagcaggatcatataatttctctgcataaaatctctcactagttctccacctctccagggtaaagctgaaactcctaggcaagcataaacggcctttcgtaactgggctcctgcggtctagggatctctttccaaccatcatgtctgctattctcccatctgtattcagcactcaggcagtacagagccatttgtagttcccggttgtgaaatattttctcaaacttcaaaggtactgcatcactctgctggtaatgccagtgccttctctgcccacacgctgaacttctagtcattcttcaagatgccaatcaagagtcactttctctggaaggtcctaatcaacttgctcttgtggtagagttaggtaattaatactctgaactactatgtgacattgtgtgtttctcatctgcacatagttttctgaaactatttagttgctgccttcccccttgagattgtgagcactgtgacagcaggggtttgttccttgttcactttattcatttctctcttcagtatttagcacagactctgatgtcttacggcctatatattatcttagtatcttcactaacttgccatgtgtacttggtaaagccccttaatttctccaagtttcctagctataaaatggatgcaatattagtgctaagggtctggcaaatattaactcttttaactctcacaacaaccttaagagttaattttagttaagctcttggcagtatgtctggcacacaagtggtcaagaaatgttaaatcttcatgtattgtatcaaatcaccaaggatcttacttccagagattaactatttgcatgaaaaaccattagatttcccaagagaaacgtgaaaagttttggggcctcacactaagactcgtgaggttatcaagcttaaaatttctgagcaaaaaacaaaacaaaacaacaacaacaacaacaaaagtgattgcctagaaactttgggtgtttgagaaacgtaaggatgggtttttggtcagtttttatttattgcctaatccagagaatacaagagtgcctatcccataacaggtgacaataaatatttgttggaagaatgtattgtatgtgctttagtttgggacacagctgcttatcaatatggatcagtactgtggcccaaggtgagacacaggcaccctgtctccatgtcagggggatattactgcaactcctcagggaggtggaaacacaccattcaaagagtaaagcaacactctgagcatcttaaagactattatctctggtggaaaattctcagcttcaaagactccatggcaagagcattaggaagaatgtttccaaaaactgatatggggggattttctggcagaggtgagtttctgaaatggtacgagtgaaatagtcaggcatataaagcgctagcccctgaggatgggagcacagaaatacagaataggggcagtggggattggagttctgtattacaatacccctgaaattgttgtttattcctacaccttgtgttttacctcaggaaagcaagagatatggaattgttctcaccaatagttgaaagtgatattaggaattaacttttttaaaaaagcaaagacctaacaatcttttagttatcagcattggttttgggaagtatttttaacattattatattaaaatattaatataggtagcaatatttgaatatggaattatttacgttttagaaaatgtgcatttcaaataaaataatgcacttattagcgagagttttacaattaaagggaagacagcttgcacaatttaattgtttagtctttaacaagggaccatggaaatgactggagaagccttcagaggacaaatgactttgaattagaaagctaaggtcacatttacagacttactctgataacatgtttgctgctaactagagattgtagtagactgacctaggagaagaccaagaatgtaccaaacaaaggagaggtaaagtagagtaaccttttttagaatgtatttttctggtctggatttcagatgtctcatttcctacctccacgggctactgggtcactagtattacttcacattgtacaggtcacaacaaggaccctgagcacatgacagggtggtggattctgggagttcattccctgagcacctactatggaccaggaattggactagattctgagaatacagtattcaagaaaacatatatgacacttgcatacttcaagcttgtgatccagtggagaagagaaacattcaaggaacattaacacaatggtatacattacaaaatgtggtaagtgctacaaacaagatgctatccaaaataaatgaatgagtaaataaataagtggcctgtaatacagttcaccctttcaggcaatgtctccatgtagaagtgacatgaaaatggaaatttcacagatgagctggaatctgttttgggtgaacaatgactcaattcaagtaaggggaatatcatacatcaaggtccacatgcaccgagaactaggcatgtttaaacacacagaaaaagccagtattgctggatgttaatgactgagcagggaatggagtgaaatgctgtcatggaagcagacagtagccacataaaaatgttggtcctagcaagagaaatcatattgtaatgattttactagggatgaggtagaaaatgctccagctctcctatgctgcccatatgcccattttctttgacttgaagatggagctgaacagcactgaattcttgattttattcaagtctttgagtaaccacacaacctctaagctcattttctgtctggttcatagtctggccaagtggaaagaggggtgtgattatggctaagtggggtaggtggaaggaaagcagcaacttcctttgttccttccctttcagacctgatattatcctaaagaagagagtacaaaatgacattgcttccctcctgctggggagagtgcagaattggtcatgggcaattgtgagcactgagctgacatagtaccctggtgacccgaatgagttaatgcattgtcctaaagctctaatttacaaccaggaagaatttggggcattgagaggcagattgaataggtccatttttacccattgtgatttcagtgacaggaccagtttgctctcgtctaaactggcccaccaaatcatgcattcagacaattgaatcaccaaccccctgacatactgcagaatctctgcaatgtaacacagcactgtcacttcaggttccagcttaatgtaccctttactttctagtcctcttctctctttggacattttgcactgaaaagcttctctgacactgattacaaaataagaaattaatattgtcattcatctttccactagcctgtgagtgcaaaatctttccaataaacccactataaaaccaaatatgcagccaaaaatagacctagtcctcctgattctcagatttgcacctctttaacacaccgacactatgacacatctgtttgtctttttatgtagaactttcttagtatataatggtatttatttttatctactaatgataacaagagacaattccaataacatctaaagccagacaattaaacaaactacattaaaagctgttcataagtttaataaaaatgattatcttgaaagctcttaatattcttcagatcaaaggatatgtggaaaggatatgtgaaaacccattacacctatagtaatgggtgtttcgtggttacatggtgaggctctagaacttttgataggatagtttatgcagaaataaccataatgctgcaggatggaaacagggtagaaatttctctttcacctcctgaatagaaaagacaactgagagtggtggtcagaatactactgggaaaggaaacatagacacactgttcaggcaagacacagaagcacagtgtgaaaacaagacctgctagaatatgaaagaagcatcctttactcccataggttaaagaatgtcaccagaatcacagtaaggagaaaatgaacactgattatagttgctatgtgtctttatcatttcttatgcaaatattcatagtgaatttctctataacactcattatatagtttgggctcactaattcttataggataccttttgtcaccttcgtaagatcgatgtttctccagaaaccgatactagcatctgagctagtatgaaccctttaaatattatattttggattcttctgcccacagtgaactgaaaaaaatccttttctgaatgctgtcttattgaaggttaattttttctcagagttttccacaacatataaacccaagcaattaaaagttcttaaactgaccattgtcagcttctcacattacctttattttagtatgttctgaattagttaagcacagacttaatcaattcagtttttcagatctgaaaatttttttgtgttaaaaatatatgaagttataacaataatatcacatcaatttcatataaatttcacagactctgccctagaaaacctagggtatatgatgactatgcttagggtatcgcattataaaatactgataaactttttttagaaaggattaattaatttgaaatctccagatgataaatatgtgtgcttctgcatcaatactattttttaagcctataagaaaatcagcagtataaatagatgttaccacatttcaactaaagaaaaacaaataaaaaatatctgccataggtctccctcttacaacaatataatataacagattatgaaagtgatctccaatgatttgcctatttagaatctttcggtagaaaacaattaagcaaatcgagatatttcagcataacattataaaggcaaaaaccatcaaagtagaccaaacaattattatcctattaaatattaaccaagaatattgttactaaaactgtaaaaatgaagaaagaagggaaacttagagatttcggctttcctgttatgactataacttttcaaaatgttagtctcctttactgacccagcacttcattactccagagggaaatttagaaaaggtcttttatagaaacagatgtctacgaaggcatctataatgattcatatatggttgggatcctacatctatagttgaacttcaatagccagaaaagtacatctgacattttgcaaacagactttgtccaatcatgctatggcttcacctaaatcccccaactctggtcaattcccctgcataggattgtaaacaagttcacatttgaaccctgacagcattcttttcattaatgcctttttcagaaatttcacttgtttgcattttagctgtacaatttcatacatattatacatttcagcttcagtttaccaaaaaaaaagtctgcatcttaactctttaaaactataatcaaagaagaaagtaaagcaaacattaaaaaaaaaaaacaacatttgtcagttctgagtggttctatgcaaaggtgttattacattattattctatgaaaataatttcattatttttcattttttcaaaattaaaagaaaggcattagttgacattagtgttcattaaatataggctggaaaaggagggtagcagaatcagaaattggcttagaattagagcagaaaggaggtacgaggcaagaggtcatgaaattgttaaaagtacacgtggtgggagatatagagataaggacttcggttcagatgacaggaacacagctttcaaaactgcagaggtggcaaaattctttgggaaaagaagggcaggagctgtctatggaagaaagtcagtgacatgatggcaaaagtaactagaggatgatacgtggtagcaaagaccataaatgctgacagcagacaaagattaaaagtaatataccaaaggtctcatgaatatttgggggtaaggaggaagaagagaaagaaatgcagagcaaggacccatgaggctgaaggatagaaagagtgtggcttagtctaatagaatatggtttggtgacatagaatgctgactcaacctctctccaaatggcactgcgaagcaggaagagtactggatgcaactattggcttaaaaatagaggagtggctctatagtggggtgggatgaagggtaggcagagacaatggaaactagtgacttctatttgagagatttttaaggaatactcctctttttcagggttaatagatattttagtaaaggcaaagaggtagatactaggatctagaaaaaaatttaggttatcaagagatgttaagaggatatgtttcaaagagcagagtcaaaagggaggtgctctagaaaagaggagagttaattcttgttgggtggtaactgattagagaatattaaccttaagcaatgatgcatgatttttataatgtctttaactttttaggccaaactagaatttcattttatctgatgtctctgcaaatttctatggcataagagatttaagattcagagttggtagaagaaggactttatttttatgcagtatataatatgtgaattaagttgttatgaacctatagtatttcttagttaatcttcaaataagtcctttaagaaaattcatatctacaactactacctcgggatactatgacccaaaaggagggctatatatccaaagatttatcttttattgtttgtttttgagattaattatctgtttatgaagttaaatatttgttggtactatccatcaaaaggtaagttttctgatattggaagtcttaaagatcagacaaaaatgaccttcacttttttttttctgattgttatctcaagagccaacataaacctactcttatttctgcctggccaaatgactgacatttgtgtttacctaaagatctataccttcagcacatacaggcgataatataaaactcctgtgtgtctgttgtaggaaattactaagaaaacataaccccaatccttcactctatactaggtaccaaaataatttcacaggtgatttaaaactcttaccctaatcttcatgccccaagtgcaatgtgacctgtctagccaggaaactaacagagcattctctcccttcctctttcggtcttgtgttccccagctcccagcagtggtctgttcccatagttaacctcacagaacaagataaagctttcttgcccaatgaagcaagaaaaaaaaaaaaatctctccctgaaaatgcacctccgtctcaaacattttttccagaaatagatattaatcctgcccctttgcccactcagccaacagtcaaagaacctcagaatataaaaattctcagtaattttctatgttgctcccatcaaaccatttcattacatatgactaaaatggagtagggaatagaaaatagtatgtattcacctctggaatgatctcatatattttccaagcatgagatcccactggtttctcttatgtgcaattcaaagatgcctaaaaaatggctaagtatttatggttcagttaaaatataaaagctttttcttctactattcaatacacactgtaacaatacaataaaagttatacattacgaaagtgatttctgagcctcagtgagaggtccatttaatcaaatcattgtcagaagtgtagtatctctaggagagtgaccttgcccaacctctttgtttatagatgagctatgacttgcccaagttcatatagttggtgacacagccatgaaaggctctagttcttcaagatcatggtacagtatttaaccatttattttaatgtgctccatgattttcccccataacatcaacaatcccacaaattacagatttcctaatacataagtcagttttttaaatctatttttggaaagaaaggcagttcttcaaattctgaacatgaaaaagaattttttaaaaatttagtgcccagtgagtacttatgtaaatgaatacaatgaatcagatactataggacaaattagtaagatggaagcaatagaggcaggaaagcagtaggttttgttcctggaagtttcagagtttgagctcattatttagaagtaaccgggagatcctatgctagtaggcagctaagactaagaaattcaatcagccagccaagaaacaacaaccactaaaagcaaaataacaacaacaaaatctacttcagatttttaaaaattaaacttcataacatctcttacagacacaagtgattcagataaattgaaaatgaacatgttgtccaaaattcagcaagtccttaagttttcttttttttttgagcatgtgtaggtgtttttatgtttgctcatgtgagtgacagtaagaaagatttcaaaatgtgaatatgattatgattaaactgtagtgttaatttagcctgagaaagtgggctttttgttaatagattattaggtaaatagggtattaaattttttaaatcatttaaaaagttttataaggattcaaataaaatcaaaatatcagttcaggaaaatttaagagcttaagtagtaaaatagtgtgggcatttttagaaatgaacattagacatgaatttgtatttggggagtattataaattacaacacaaattattatgtagtcttaataatcatacagagataatgttaaacattcatctcaaactattaaccagggtaacctgatatacatcttggtaaatctgagttaatgaagaattatcatttgttttactaaataggataatataattgtaccatatgtaggagtagaaatattggtatgctttctaagttgttttattttgcaaaatttgattttctattttacctaaaaaagtggtatgcttcttaaatttaaatcaatagtgtatctgtaaataaatttttacttaagaaataacttcagcatacattcatctgccttaatcataaacagaaagaagtatcttattttctctttattctttttttggaggtcaggaaatatgattaggtatatggtacatttaaccgttgtgtatataggagagattgaaaactctgaggttcaattcctgggtttgccactttctagtctttttatcttgagtaagatacttcttattttttatgattagtttccacatttgtaaagtaaggataatgatacctcctgtctaaaattgtgctgagaattagtgataaagtatgtctactactcagtctagtaactggcacaaaaacaagtagcttctactaacgaatttagtcatcattaattatgataccctgactaatcaatattggcaacacataattctaaaagatgtgcatctgaaatttaatgctatactcttgtgttttctctggatttaagaggaatagggatgtggagaagagggttgtggagaagggggggtaatcaataatcaaaatcatatttaagaaaagaagtatgatatgcttaataaatgtggacaaactgaacactagtttgcacaagtttggaaccaatctctttaacccttagtttttcccttggtaaacaaacagactaagtcatataatgcttgataattaattattcaaagtttctctggcattcagtgtctctatgattaataattcagttacgtttattgagaatgctaaataatggcaactcacatttttcctactatcattaagactgtcctgttccagtgatggctgggagtaaatctgaacataaatcagaaaatcgcaggagatgtgtagtagttccttagttacaactatgagaatgaagtcgtacccttggagaattctagtgtgtgacttgaaatatacttagtaatccagtcactgaaagactgacagatttgctcattggtttctcagattccgcctaacaaggcctacgggacatggattctaaatgagaagaataatttctaaaaagtattttgacagttgcctttaaaaaaacagaaacattttatggcatatgtcctttatttataagactgatttttatagattatttagcatgcttgaacccaggaggtggaggtggcagtgagctgaaatcgcgtcactgcactccagcctgggcagcagagtgaaactcagtcttgggaaaaaaaaaaatgtcctctttcacgtgaattttaataaaatactatgatgcacataaaagagaagcagttgaactgtgctaagcatggggcttggccctaggaacactgcgagactgctgtctggttagtaagcagagtcttatatgcacataattacaagatgcatggattcatgcattaatagaagtatgattatccttccccaacatctgattcctcttactgaaatacaattttacatctatatactttttatatctatctatatcaatttgtaaacattgcctatatgtgaaccaatcctactgagaatttagtagaagtggagcctgagttcagaaggaaaaaaaaaataacagatagcagaacaggcttagcagttttttccagacaatcctggaggaggaaattaaaaaatagggttttagaattgacctgcaggacaattaattaatttattttttcttaagaaatatttattgcgctccccttatgcaccagccattcttcaaggaggtacagattcaggggtaaatgagaaaacaaagaaaaaagattcttacacatagagaaaaaatgttttgtgagaaaacagactccatctgtcttgttcaatactaggttctaaaataatgtctggcatttagcatacattcaataaatattggtagaataaaaagaaaaaaaatgaacaatttatacagaaatgaatattattgaggcactaaaacctagcaatgtgattgagaatgactggagtctggcataggggcctgcttttaaaatgatggccaaggaaggccactgggagatggtaccaagcgagttgatgatttctgctccaatctctatcttatctctttataacattcaattatatgaatgttagaacttctgatattgttccacaggtattggacactgtggcatattttttctctttgatttgtcagtttggggaatttctttcaataatttttatggttatataataattgtacatttttatggagtacctatgatattttgatacaagcatacaatgtgtaatgatcaaatcagggtaattaggatatccatcacctcaaacatttatcatttctttgtattagaaacattccaattccactcctcagttattttgaaatatgcaattaattattgttaactatattagccctattatattactgaacactagttcttattccttctatctaactatatttttgtaaccattaaccaatctctctttacccttccccttcccctcccactacacttcccagcctctggtaatcgccattctacactctatctccatgagatcagttttttatctctcatatgtaagtgagaacatgaaatgtttgtctttctgtgcctagcttatttcacttgacacaatgttctccggttccatctatgttgttgcaaatgatagaatttcattctttctacggctgaaaaatattccattgtgtatctataccactttttttagtccattcatccattgatggacacttaggttgaatccatatattggctattgtgaatagtgctgcaaaaaacatgagggtgcagatatctctttgatatagtgatttcttttggatatattcccagcagcaggactgctgggtcatacggtagttctatttttagcttttttagagccctctcccacacccatactgctttccatagtgcctatgctaatttactatgtcttcaacttcactgattccttcctccatcttgtctagtctcccttaagcctggtcaatgaattcttcatttctcataatgtattcttcacttcttttatttctctttggatctgttaaaatatttattttacaactctctaataaaattccacatcttttcatgactgtttttccacctctcccactagattttttttttccacatttatcatggttattttacgtctctatctgataattccaattctatgtgtgggtctgcttctatggaccactctcaagaatattctgttgatcttgggccacactttttttccctcatgtcttataattttttattgagtgccagatggtttctgtaaaagagcagtagaaatttacagaaataatagtcatccccagaaaagggcacaccacttctcttattaggctgctaattaggagactgagtggattaagtctacagttaagcagagtctgggttgtgccgctgctttagttagattcggttcttcattgccttcaaatgtgtcgagagcagaaccttctcttcagcaggacttgggacttgagtcccagaaagactctagaatctctttacttattgttaatccagtaaccaactttctgaaccaagggatatctcttgctgctttacaggccagctcctaggtttttaggttgctcgggagttctctctgctctctagtttcaccatggttttttgtgcttcaggatatctttctactgatcttcccttcctctagtcttccaaagagccactgcagtacaactagtgaaggcctagaatgcactggggggatttctctcaaggctttttccctgccttagccttcagcagacctcttttaactggaggaggccctgcttgccttaggggggatatctctcagcttggctgccttggctttacatttggttgacaattcagtgaagtcccatgagacggttggttgatgagtgcagagatggtccgtgcctgggcttcttggggttctcacacatcacacaactctaaaaacattcattaaaagttctttacaattttaactggtgtctctacagtgacatcttcctttcaccatttctccagggagcaaagcagtcatgagtttctgctctccttgtcactttctgaaatttagttcatttaagtttatttgcattttcagattttaggtaagttttttaaaagtctaattttgtggcttatatcttttgttatggttattagggtaggagtaataatctcttatagctttctacatccttactagaagcagaagtcctgcctgaatttcaaagtcataagctaaccatatggtatctattatcctagcagtctgagtttgaattggaaaggccttggaaggttttaagcagagattaggcaacaactgtgagtcataaaacatttcatacaactctgcagttgaatagtatgtatgaaaatatatgaaatgtaaagcatttgaggaataattatagtcgaggtaacaataataattactgttatatggtgttatatgtcatttctcatattgattgctacacagtttccagtaattcatttaaaaacttattgtacacgtagccattccagcctttaattgtgttcatttcctatattaagacatctccccacccatactttgtaacccaagagccataactaaatttacaatttaaactaaatcaggcacaaaacagtcactgatcattttaatattgaaggttttaaaggacacattatgaaaaaattaaaatgcaaaaagcagcacaaagttaaattaaattatttattatggaaagattagtcaatctggttacttccctaaattttgcatgactaaaatattacagaaaatttccttttggctgatcagtatatagatcagaaactccccaaagaagatgtattaataaagttaactcattccttattaatgctctaggcattttaacaaatgcaaagtgaaatatctacctcaaaaatgactttaatgataagttatttctttgcttcatgtacacaatggataattagttcaggaaaagaatctcagagggagaaaaaatagccaactgtgaaattcacaaatactttccttggattgggtacaaatgctattcaggctaataccagggatgcataaattctttctatcctatttacaatccagtcttgattagttaggagctcattttccagtttgtgaattatctaggtctttgattcttctcttccctctggctgattacctttcccatttctctgctcattagcacctccaccaaaggaaatgaaaatccaggtgaaaaggaaaagtaaatcattcatagataattctaaataatctgatgtttggctttaaaaaacaatctttttattgtgcgtaagtatatatgcatagttttatttaagaaaatacagtttcttagcagaacagtggggactgtgtggtcagatgttctgtgttcaatttgaaattctatcacttactatttaaaaactatccataggaaagtccttaccttcatccagatatcagtcttatcatgcaatcaggatgatattcatatcttttttgtgaggttattgtgaaatcgattcagagaaatacacatctgtatcctataaatggctatacaaaactaagaaactgttatgttttcaatttgtaaaacccctttgtcaattcttgtttcttctactttccttaagaatcagtttgttttggggaaaaggctcattgccaaagtatatctctttttttcttcttccttgctcctttttaaaaaattgtaccttttctctctaacatggttatgaaatacactggtagaaaggttgaagaaactggtagaaatatggttacatctttaccaacaaatttcattgactgattcttccctgcctcctattaaaatggataactactagttacctgtattagtatatattcttaccaaaatggccctcattctaatttgtacttttataaattttggttattaaaatgaagacatatcccacatagtaaaattttcagtaaattaaagaattcattatacacatttaactgttatatcaaagtatacttcatttgtcttattttaaggatgtctggtttgcctggtgattaagctagtagtcctgtgtctctcatgaacagtctctttttaattgatttacaattaattggatcatatttgtggatcacagatatagtttaaactgaatcaattatctaatcaaaaataacaattaaaaaagaaaagcagtcattaaaatacagtatataaacccttaaaaaataatgtgttaagtattgttttttataagctattttaaacaataaagaggatgctttcaagtaaatatcttagaagacctcagggggaaaatgtgaaattagttctttgtgaaaaataaatatctaaagagtattccctgtagggtacaatgtaaaagaataaactagctactggcaaaaaaggaagctgggggagaaaaaaaatatatagttatcaataagcccaaaaaagagtaaaatgaaatgaatagtttgtaacagagctaatgaaacacatatacttgtagcatattctgctaaataaaaactttatattgcctcctacatttaagcctctcataaaacagttgtgcatttttctaaaattgcttacaaattagcagattaaatgggccctttgcacattttaaaggcttgaggggataagtaggaggaaaacaattgttacagttttcacattatcctttctttctccttctttccccagccctttaagagaagattgcattagagttgagttctcaacactgattgttatgaaatagtaccaaattgatactaagtaagattacattggagttgagatcgcaacacgaattgttatgaaatattactaaattgatattatgtaagcgagcctactgaacaaagcttttcagctctttgaatatgaattttattttcattttttgacatgaactgggtatgtgacaaacataagcaatttataaattgtttccattgcctctctcatgagctagtttataccatgaaagactccacattcactgcatcattgccatccccagggtctctttcacatggttcagtgtgttagatgctatacttccaatgtggaaagacaatattctcaccccaaaggcagcctgacaaattacaaaatgaaggggtatttgagaaagagtatgttgtagccagtaatgcttgtaaaatgactcttttaaaaggtttgatggattttctcaagattcttcttttactgaatgacatgaaccaccagcattttaatcttcagcaaagccaaagcttaacaatccaaccaatatttctttcatttcttaatactatctaaggtcatttttaacttcatgttaattcccatgactcagtatcaaagtgagaatgatcaaaatgctagagggtgttaattgactggtaacttgaagagttgggtagggactgaagagctaggtagccgggtgttagcgattcaactcaacctaaaagtaattcccaagatgcattccaggaaaagggctataataattttaagttaaaccaattttttaaacagatttatggaagtatacttctatatatgttatataaagaataaaataataatttattaaagtatacaataaattatacatacttaaagtatacaattttataaattttgacatatgtaatactttaagaccattatcacaatcaagataatgaacatatctattttgccaaaaagtttccatgtgactctttataactcctctctcccactcataacccctctgtccataagacaaccattgatttactttgtgtcactacagatcagttcacattttctagttttaggatgacataataatatatgtacttttgtgaggtgtttttttttttgaatctggattccttcacttgaaataattattttgagattaatccattttgttgtgtgtataatagttcattctttttattgctaagtgatatttcatagtatgaatataccacaatttgtttatcttttcagttgttgatgaaaatatgagttagtcccaggttttttgttgttgttgttgttacaaataaaacttctatgaacattcccgtacaagtctttgtatagatatatgttttgttttctcttgggtagatatctaaaagtaaaatatctgggtcatatgatgggtatatgtttaaatttctaaaataaacccaccaaagtactgtatcagatatatgatttgcaactattttctttcagtctgtcatctgtattttcatatttctttataaacgagtttgaagaggaaatgtttttaatttgtatcaaatcacatatatcctttttctctctttcaaaggcagtaattttggtaggtatctgacaaatatttacctaacaaaggtcaaaagttttcttcaaaaagttttatagttttaggtttctcatttaggtctatgagtattttaagttaacttctatatatcatgtgagatctgaatcaaggcttactttcttgttgcataagaacacccaatttttccagcatatttgctgaaagactatattttgtccactgaattgcctttttgcatctttgtcaaaaatcagttgttcatataaataatttgtgggttgtttgtaggacttactattctgccacattaatctatttgcctatctttatgccaacaccagactatctcattactgtaattttaacatagctcggtatcagaaagttttagacttccaactttgttctttatcaattgttttgtaagtcctttgcacttccatatgaatttcaagatcagcttgtcaaactccacaaaaaaggtttgctaatattttgattgggattgcactttatccatagataaaaatgggaagacttggcatcttaacaatagtggctcctctgatctatgaatacagtatattcttccatttattaggttgtctttaatttctctcagaaatggattgttgttttcagtgttcttatctttcacatcttttgtcagatttatctgtatttcatgatttgctgctactgtaaatgatatatttattttaatttccagttgtttattgcttgcatataaaaatacaattaatttttacaagccaatcttatatccttcaaccttgtcaaactcactgattacctaaagtattctgacagggccaaatctaggataggcaagttaggtatttatctcagctgcaaaaattaagggaatggcaaaagtctcagtaatgaagagaaggtgttttactgtaattaaaaaaaaaatacaatctaaaaacaacagcctgtgggctatctgactgttcctgtaaattaagtgatttttttggttggttgtttctttggtatattccatggattttctacacagataatcaaattgtatataaagacagttttacttcttcctttgcagtcttttatttttttcttctaattggacagggcagaatctctagcataatgtggaatggaagttggtgaaagcagatatccttatttcacttaggaggaaagcatacagtctttcactatttagtatgatattagttgtaggctttgttgtacatacccttcatcaagttaaggaattttcctactattaatttgctgagatttttcccattttaactagaaatagatttttaatttcttcaaatttttttttctattgggtttattgagataatatattttgtgtgattatcactatttagtttataacatatgaactatgctactttcaaatattaaccctatctggagttcctatctggagttccttgtactctttctctaattgtggtatcagggtgttggccccatagaatgtgttgagaagtattccctctattttacatttctgaaaggtatgtatagaactggcactattcttttctaagtagtttagcgaatctacttgtgaagcaatctgggcctgaagttttattttctctaatgttatctattgtctcttgaataagcttttatagtttgtgtccttcaaggaaattgtccagttcacttaagttgattaattcatttacataatgttgttcataatatgatgtcattttccttttaatatctgtagaatctgcagtgatgttatctctctccttttctatattggtaatctgtgtttcttctttttgtttcctgatcagtctggctaaagtttggtcaatttttttcgtctccgcaaggaaccagctttaccttcattgatgttctctattttttttctttttccaatttcatttcttttccactctgatctttattatatcatttattttatttactttgggttcaatctgctctttttttagtttttaaaggtaaaaatgtaggtcattaacttgagactttttttcattttgatacatgcatttggtactataaatttccccatgaataatgttttatggcacaccacaaatattgacattctgtattttcatttccattcagttcaaggtactttctaatttctttatgattttttctttgatccaagggttatttagaagtctattttcggccgggcgcggtggctcacgcctgtaatcccagcactttgggaggccgaggcggggggatcacctgaggtcgggagttcgagaccagcctgaccaacatggagaaaccctgtctatactaaaactacaaaattagccaggcatggtgacgcatgcctgtaatcccaactactcgggaggctgaggccttgaaccgggaggcaaaagttgtggtgagccaatatcacaccattgcactccagtctgggcaacaaaagcaaaactccctctcaaaaaaaaaaaaaaaaatccaatgtgaaaatctctgccctttaattgcggtgcttagaccatttacatttttcatgagattatttaatggttaggtttaactcttatcatctatatactatatggattctatttgtctcatctcttttttactcctctttcttcttctttcttttggattaagtactttttattattccattatatattgattgttggttttttggctataactctttgaggctttattttagtgattgttttagagtatctttaaggtactcttagagcatctttgaattataaaagcctacctccaagtaatagaaaaatttacaaaaggtgttagaaccctagagcagtatacttccatctctttcctcccaactttcgtactatagttgtacatttagctttatgtatgctataacccccatattatcttattttttgtttaaacaacctattttcttctaaaatgagttaattaatgggaaaacatcatatatttacccatgtagttacaattctggtggtctttattccattgtgtagaaccacagtttgacctggcatcatattccatctgcctaaaacagtttaacattacgcagtgtagacctccttttattgtgcttgaaaaattatttatttcacttatatttttaaaaggtatgtggctggattttgaaatctaggttaatattcgtccttttctttcagtacttttaagatgttgcccctctgtctcatagcttagattgtttctgacaattaatcacactagtaactgttacatgtgtttttctgtacagaacatgtctttattctctggctgcttttaagatttttctctttatcactggtttgattaatctgattacattactgcctggtatagttttcttaatgtttcttatgcttggagttgatgaagtttcttgggggtttttttggggaggggtgttttgggaggtttgtagttttaggcaaaactggaagctttgcactattatttcttgaaatttttttctgtatttccacaacttccttcagggactctaattacacatatattaggccacttattgtcaccagctccctgatggtatgtttacttctctctctttctctgtttgcgtgtgtgtgtgcgtttcattttggatagcttttattgttatatttttaaggttactaatcatttcttatgcaatgcctaaagtgctgttcatagcttccagttacctttcatcttattcattgtagttttaatttctggaagttttatttagctcttttatctatcttccatgtcttagctttttgaacataaggaatataattataacagctttattgtacttgtctgctaatgctaatcttgtcacttctaggatggttttaatctataaattttcctcctataatggcttatgtttttctacttatttacataacaggtaattttttattgaatgctggatattgtgaatcctaccttttttggtgctaggtatttttgtattcctataaatattcttcagctttgatctgggttgcagttaagttatatggaaacacgttgatcctttcagatctcacctttaacatttgctgggcatgaccaaagcagtgctcagcctggggctaattatttcccaatacttaattaagagtcttatttatattctattcaatgcttgtggtcatagagttttccagtttggctggcaagaacagtcactattcccagatatatgtaagaaccaaggagtagtccatgtcattcctccttttttccagtctctttgtttactcacatgcatgagctgatctgtactcagtgctgcatactcaagagaacacctgcaggtctctggaattctctttatgtagctctctgctttctgtactttatcttgtgaattctagcctcctcaactcagggcctggggcaagtcctttgttttctatctctcagtgaccactctcctttattgcctgatgttccaggtcttaaaagctgttgtttcatgtatattctaagatttttgttgttgtttccattgggaggttaaatccagtctccatttccatctaggatgcactaacattttattttaaagaactacgaatgtcctatgtcaagaaaatacttggctacatggagccgtaaactaatcacagaactgtgagccatattacatattctgattcattttttgctacccttgttttgtgaaattaaatatattttatttttttctttgcttctatgctgataccaagaaaagaactcactatttaagtgttttaatgagaagctgtgaagtaaaatgaatgaatgatattaaagcaggggagtataataaataaaacattaaacaaggagtccaaaaacttacatgatataggacatataatgaactcaaattgaaggaatcactgaaaaacatatttagtgagttagtgtttaatttttaaattggtaactatttctgaaatgaagtattttgtataaaaccactagttcaccaagttttgaaaatcaattgggcaatatactttaaaagctatacacatgctgttacctttgacttgccaaatctccctttcacaacatacaaaaatattattttaaaagtagggataaaaaccaaatgcataaatattctatgcaatctaatttatggtagtgaataattaccgtgtgtcaaaatgttatatgtaatctttcaaaatgtttaaactatctctgagggtcacacagatgaggaattgaggctgagagtgtcataaaaagcaagtcagaggagatgttgagattcaaatctgttctgactctaagccctctgcctttagctcctagactacaactctagaaaaacagaattttgttaggataagtgggcatggatgtttttactcttaaccactcatattttaaatttccactactattatgatatattctctttttttgtaaattagaagaatatttttaaatgtccacaaaataatgtcactagataatctgagttaaaatttgtcccgaattttggcaaagaaaggaggatgggatgtaagtatatattgactctagaattcatgaatatcagaaaatcactacgtaagctctagcacaaaaaaactgaacggtttcctggggatacactagtcttcccttcaatagttgcttcagcagtttcctaatttatttaaaataaatcagcatgggactgtgtagaaatcaacagaaacaaggacttgacaagctcaaaaaatttcagagggaacaaaggagaagtcccttcagtacagagacttacatttctctttgtgaatatcctctttggggtacaaggcaaaagaactaaggtgatgttcatgctctcgacgttctttgataagtaacaaaagtaattatcttgcactagccattgctggcctgacaacagatatagtttcacctgttacaaaattttatttttttaaacgagttgtctgagtgacaaaaatccccctatttctaataagtgaaacttaattataaaaacttcaaagaaatagaagcctacttttgcagaggtagtcttcgtggagatggcaagaagactgtacaagggctctggactaacgtacgcccatcaagtaagcaataagcatcctcctcgcttgcaggacacctaaatttgactcagttccctgattccgccattttggaatacagaatttcagatgaggccaggtaacagctcaaatccaagtccaaatggagtcccactgacactattttcaatagacagctacatccttgcaaagcattaagagctgggcataaaatatccttagctgggattaacagcaaaacaatgcttggctgataacatatcttctttccttgtcagatcatttgttttcttttttgaaaatttatatttaagattgcccacttaagagagttggaataacacatattcttaatttctcaggctacttagggccaaatgaaatatttcttcaaggtgtaatggaaagccttcctggcctagtgctttcactcactagctgtgttacccaagacagtcaatgcaatatctctaaatgtcagtttcatcatatgttaaaatgggaaaaaaaatctctgcttcacagatacataaagcccttagcacagtgcctgaaacatatgaaatgctcttaataaactgttctgatataggagttttaaaaatatttaataatataggtcaagagccataaataacactggctgtgtatgtagtagaatcaattgatgaactttacaaaaaatacacacacatatgtatatacacatatacatatatatacatatatacacacacaaacatacatatatattcattgtatccacaggagatttctgaaatgattgaacagaatagggcctaaccataagtatcttttttaaagcttcttataaggagattccaatatccaaacagaatagagagctactggacataggttcttaaccggcggtccagaaactctttatagaatacagaaatccataaacttgggtgagaaaacatttagacttttatttttaccaatcttccaaactttggcatttttcaatcatgaatgtataaattaaaaataagggcccttggtccccaggtgagacagaatggactctttgtgttcaataagataccaaattataaaggagacctaacggcatgccaggcaaaggtaaaaacaagcacctctgcacttgaataaactgttctcagtgccacaaggatccttttttctttttctctggcagttaaacaagcactggcctcaagataagcaatataaaaacaattatagctcactgatcaccagatgctgaccgacttcccctcttccacagtcataactacagatttgattggacaagagatggattttagcaactttctcctaataagggactacaaaccatcgactggttctgcccagtttacagaggctgtgcactgagtgccttcatgtctctgcttcaccttttgatgtacacagcccaactgtaatacattcaaatgttaagtctccactgcaaagtgaacattgcatgtatataacatgcatgtttgttcagcacacatgcattaagaccccttcatgcatattcatagcttctcctataacctaatatgtaacttaaatgttaaggccccttcatgaatattcatagcttctcccataacctaatatgtaacttagatgttaaggtcccttcatgaatattcatagcttctcctataacctagtatgtatacttagccaaccccttcaccataaattcctgtctcacctttcttcccttgaagtttctgtctctggttttggccagaaacctgcttcctagcccacaggtagtaatattttctaagtattactcctttctaaatgtataaattgtctgattttttttttttttttggagattgagtttcactcctgtggcccaggctggagtgcagtggcataatctcggctcactgcaacctctgcctcctgggttcaagcagttctcctgcctcagcctcttgagtagctgggattacaggcacctgccaccatgcctgactaattttttgtatttttagtagagacggggtttcaccatgttggtcaggctggtcacaaactcctgacctcaagtgatctgcctgctttggcctcccaaagtgctgggattacaggcatgagccaccacacccagccaattgtctgatgtttttaagatgacaaatgcaataaaccatagtggcactattgatatctgtcactttggaccaaaagaaatcacagaaaatcacagtagagttgctgcagaaatctgaagtacttatactcaccacgacatcaaaatttgagtagttattagacccatcactagattgttacttagtgccttaataaaaaaaatacattactatatcgtatattttaagtgagatagtgagaatcctttgtaaccctatgaattttgttttatgccttcaaaaatattctggaaagaggctcccaagcttcgccagagtgcctaaggagtccctggtacacataaaatgttaagaactcaatatttagaggctatttgtcagtaaagcaccttcaggagtgctgatgtagatcaacttctttggaatcactttgaacccaatgtgtacaatgctgatctctcagtaattaaccgaggaagtgttttttacagaaatgaggtgtattgtaatagatgtatatttacatatcaattgttcttccttattaatttctctaacaaagccatcatttccttttctatcttcactacctgattcactgctgaagccctaccttctgcttcctactttaactgccacaaatgataaaaaatttcagtctttgcttcctaattcagtgcattcaaagtgcagcatgtattttttgttaaaaaaaattttccccggcccaaaatacatgattcataaggcgtttgcattgagaataaaaggattcactttaaactgacttctgcaagccctagttattctgcacatttaataataagcattacaaaatctcagcttaggaacaaaaagctcttagtcagtaataaattgtcactacaatgatcaatgtgccaaatttaattcacagataaataaaaggaaaccttgaaagccaagcagaagtctagtgtgaatgtaggctttggtataactgtgacaattcagagatgagccctcacaatatatttcagaggtctctctgcctttacattcaagaagttcatcagccatctcctctggttcatggtcaactggtgctcaccctctctggaaacagagacattagctactgatattagctgacctatgtccacacccagcacaattctttttatcagaaaagttagcttttgcttagaagctgccacagtgggttgaattgtccagtccctgtcattaaaggtggcagccatgcactcgagaatgatgtgaaaaaactccagcaagagtgataattaaacttggaaaatgaagggtcaccttctttcattcagctcattgggcaaacccatcagaataattccaaaacagcgggggactgtctactctcagcatggcaatatcgaggtgcacacacattatttctatgggttcaaatgggaatgccattttaatggtatttaaaacgttatcttcgatatgaggagtaaaaatgttagaaattagttctaggaatacagaaaaagaatgatgtgtataatctaaatagggaaagaatcagaaacaagaaaagtatgcatttttttctcaagaaaaagcattctaagagaagaaaattatctccagggaaactgaaaagaatattaactatgtctcttctttctactcaactgtagaatcacaaggcaagggtttcatctcagctttcttgtccacttactgtcatttcttggtggtcattattacaacaacttactcctacccaaaaaagagaaaaagtgtcacatgaagttaagacaatccattggtaggagttattttccaggaaaattttttttttcagacacattagcttatctagatactattgaatcagtatttgggaatttatatttcataccattctcatgttgcattaaaatgtaatactagaacagtggcttacacctgtaatcccagcactttgggaggctgaggtaggaggactgcttgagttcaggagttcaagaccagcctgggcaacatagcgagacatcatctctacaaaaaattaaacaattagccgggcatggtggcatgcacctgtaggccttaggaggcttaggcaggaggatcacttgaacctagaagctggaggctgcagcgagccatgatggcgccaatgtactctggcctgggcggggggacccatctctagttaaaaaaaaatgtaatactgaatatttaaggacaacataggcaaatgcactggatcagaacagaagcatggatggtaaaagcaaatttcaagttcaaattctagcttcaccatatattaggtgtgtaacgattgatatggtatttaatcgctgtgtgcctcagtttcctcatcagttaaatagagaaaataatactacctatcttataaagttgttcaaaaagatcaaatgagcttaaaataaataaaacttttgtaactgtgcctagcacagagtgagtgttatatcagtgctcataatatattataaccattattattatgttgcatgttcagtacctggcagagtatttaatactgtagatcaggtttacaaacatattatttctttttatagttgatcttttttttttttttagtccttatcattctgagaaaggcttcccaaaagatgtgggtcctttaataaacaaatagctcagcataattctcatatagagttaattatataatatgaaaacagggataattttcacatcaagctcaggaagagaaaaatttctaataagcagaaactatagattttagacgggtcacgatagttcccttcacatccaaacgactatcttgaggaagataaattatatttgtcctatgtgcatgtattttatttcaagttagtattttattttatttcacgtattttatttcaaatgcatgtattttatgtcaagttctatgtgcatgtattttatttcaagtttattttatttctatgtgcatgtattttatttcaaaattatcaagagataattttgaaataattagagctgtctaaaacagaaaaaaaacttgatgggcaaggcaatcatgtgatttctatattcctttgtaagaatttgcaatttatcagtttgtagacaaacatccaccaatttcaatagatttaaaaatatttatcattagtatatttaagtgttgtcttttgtctttgaaagacatatgtaggtaaaaaaatattttcgatgacataaacccacacattgcctcaaacctcaacctccattcactaacaattcattgaaagaaagaatgaaagaaagagaaataagttgtgtatatttgaaagagacagagaattgaggaggagggaggggaaaagagaggaaggatgagagagagaaagaggaagaaggagtaggaaaaaaataggaagtgggagagggaggtgggagggatagggacaataaatgaatgacattaaggatcaccctaatcagactattgaagagaaaatattatctattatattcaagcctgattttactgcaatatttaggcatggttctttaagagaaaaaaaagattttataaaagatagttgactaatttagtataggagtgttaaaattatttaataaattatttcccactgaaaaaatatagacttcataggaagatatgctgcttctgcctcaggtttatatttaaaatgatttatagtttacaatttcttcctaaggtcatcaccttcataaataccagccacatacagtgaaaaccaactcaataaaatgagtatttcatttctcttccttctgcttatgtagatacttcttccatcttacatggcacccatttataacaaagcttcacattgtgtgggtttttatgagttcttgagcttttctttcttttttatctttctatgcatcagcaaagcaactggcagattctttaataaaatatacacattaatatttataagcctatgaattggatgtttaaataaacattcaccaacttatgccaattctcttgttttagatgttaaatcacacttacgttgtctggaaagtcagcctttagttcagtgacactttgacaccaatatgcagccgttttctcactgatgagctcaatattcagaaaggagctttgtccagggccatacatggggccagaggtggttccccggatgattctgggggaaacatttgtcacaatgtcctgatgaaagagtaaagatattgagtctccttttgacaaagaaaagctataatctttattatctgctcatttccatatgacaatattttatgaggtcccttctcacatttttgcagaggaatttttaatatacattaaattagaattgaacataaactacttgcaaataaaaaggtaaaataaagtatttgttagctttagctaaattacttcttgtaattctaggtttagaatagcgcaaaaataaaaatatttatattcattaacactcatttagggcatactcattttaatttgtttgcaattaaataataaaaatatgataggtaaaatgcaaaagtttatcatttctgtctatttaatctaggtatctccaatcatagtttaactccaataagaattaatgttagtaaaaagtttatattttttttttctgaaaaaagtaactccgatgtaaatcagtgaaggaataatattagtattactggctcatcaaccattaacacacattctaataaactggttatgtgaaattacttataggattataactatatattcactttaaatgagaagaaagtcactttctccaagactgaaatgagtatatcaataacttcctgatacctataaacagtaaacagtaaaattaacttgcttgttaagtgtaattaacaatccacaactgcttctaaagctgtattaacgaagaagaataacattcttccattacttaaaactaaaaagaaacaaagaaggaaaatgtttcttttgccaacttccaattaaaattaattttgaggaaaggtcatttagttaaggatttatcagaattagtcatttaagtacccctcctcaccatcttgtcacttttagtaagataacatgaacccccattagtatatagcaattaaggtcaatttacatattttaattaagaaccaccccatataaaacaattagcgtaataggcatactaactggatttcataacatttggacgtttttccaactagatagacaggaaaccttaattagcattaattagtgctgatctgcatatgtttgataaggcatacccttgccacaaaagattatttattcctgaatctgccaaatgctacagttgcagaggataaaaggacttttcttcacattgcatgttaatttctggtaatttacattcacttttacatgcgaattagtatattataaaataaatggtataaatgttacaataagcctccttaaatatgtacattttaacttataggaatcatgccagttaattttttactaattaagccattccatttctattgtaattgtgtgcaacatcaccagccttgctttgatttgctattgtgaaaccatgtttcacaatcctaatgggtaaaatgacaaatagagttactccacgaagctcaagccttgtgggtcaatttccatcttggcaaacgcttaaatgtatgttctacgtccctacaggtggctctgtgaagctcatccagtgggtactccggtgttttcatggtctgagaaggcaattcttgaaatatttcactcagatgaggctggttttcttctgtgttccaattttcaagagccataccctttaaaccttgagatcctcctttcctctgctttactccctactctaaatgctcttcacctaagtaagtccaacctaggccacaagttgttctctacacaggatttcttagccaaggaggagtgaagtctgtatttagttcaccaagtcaagtgccctggtactgtgttggtgagcaaataatggggcatctggttttgatgaccattttttaattcattggtctggaaacaggtgcttcctgcttattcaacaaaactgattcacgttagcagcatccctactcccgcccattctccatatcttcacttagacttcagttcctttgagaagtttttcttttctctccaactccattgagtcttagtaacatgctctgactcatgccaccataacaatatataccttcctcaattggcattcttactaccatttattgtggttgtctatattcctgactgtaccttccactacagcataagacttgtaaagaaagaaactatattttgtttactattacatgcccagcttccagcctggcctttagtggtgctaaaataaagtactgtatcttcaatgagtctagactaaaaccataggcactagaataagtcttgtcctgaggtatgagaaccaaagacatttattgctggctgcattctgctgctgaacagaccagtggtttgggctttgatatagtttggatgtataccccacccaaatctcatgttgaaatgtaatcctctgtgttggaggtggggcctggtggaaatgattgattgcatcatgggggagaatttctcataaatggtttagtatcatcctcttggtactgtcctcatgataatgagtgagttcttgtaagatgtggccctttaaaagtgtgtagcatctctcccctctttctcttgctcctgatttgtcatatgatgtgactgctcccccttccccttctgccttgattggaagctttctgaggcctccacattagcagatgctgctatgcttcctatagagcctgcagaaccataagccaattaaacttatttttcttcataaatttcccaggctcaggtatgtctttatagcaaaaacgggcctttattcaaagttcaggatttattactatgcttagatcttttcctgctagtccatttgtctagaattgggttcttgcttgcttcttctgatccttcagggacccctttttctagaactcagtacaccccctcccttggatagatccctgaaccaaatgctgtgatacaaagcacccactgctataggccttctcacgcagcctactgtgatgactccctgacagaaagcatgcttgaacttcatctcactgcagcttctaagaccttcctggttgctagttcttaactgctgggtatcgctgatctctaggatttaaatagaatgcccccattcagatacaatacaactaccagtcttttttggttcatgtggatgtgtattcttaacctgatccatgaccacctagggtatttcctagctaatgagcctgtccaactacagttgtcttttatgtttgtcctgtatgctaagaacacatcttaacagtatacataggaatttttaaaatatcatagaatataaaagacacagaatggaaatttcacctataactaataaggaaaaaaatcttcatggttcaggaattctaagctatatgctatatgctatttacagtaacctactaataaccacaaagccaacatctcacattagccaaaaggatcaataagctgacaatatttaattggaagactgtcaagaaaatgcttctttcttaagcatttccctcatcagtaatacctcaaagcctacaattctacctttaagaattttttctttgtgtattatgagttaagtttcttgttaatgttggagctggtttatttttctcttctacgatgtggtgttaaactgtaaatatagcataggaaagttatgaatgatctccttaatcaagataatgaacaggaagtacaaaccaaatcaaaggaaaatttatttgctttatgatagagaatgcttattcctttgtgttgatttataatagagaatgtttatttaaacaggtcaattttctcattccttaattcaaccaaagataaaaggtcctttataacttctcaaattacagatgcctactgttgtagaatgggttaactatctgaaaggaatttgttagcatcatagaaattcaacattttccaaattcaactaaagtgcaaaattccaatgtattcatccagtaataaatcggtaataaaaattttattctagattttctttcccaaattgtcatgtttgctattgttttgccaaaaacattctccactgaattgagacttttagaatttttaaattaagtgaaagatgaatgaaaacacatatataaccaattatctttggttatataactagagttagagtttaaataattggacaataacttactaaagcttttgacctgggaagactagaatttgagcatgatttcataagagaatattttgctttaatatttaatggctaagtcttattagcattgcttaaaggagttaatataacaaaataaacatattcaagaatagttagagtagagaagagttcattctctataataaaaaagacaaactgccatagctctcatcttcagtgcattaacgatattcagatattttaaaaacagatgtttatagaaaaggaagtgttaggtaatatctttgctttatgtaatattataactaccattataacatcaagtattagtgaccttttaacatttgaagtgatgataatgattttttctctatcagaaaagagatttaaatggtaagcggactgattatatttgtttaggttcatttacttgacctctcttattataaaaacttatgatgtttctatggttactactgaattaaaacagtcacaatggccacaatgaacacaaaaagaaaactttgcagaaatgtctgagtaagaggctagaaaaagaatggggtcaaacaaagttggatgaaaacaagaaataaaatttgcaaagtgaatcatggctacatataccatagtggatgaattttataaacatcttgttgaatgaaaagggcaagttctagaaaaatatatagaatatgacacacaacacaaagcaatatattatttagtgaaacatactgacaggataaaactataaatataagtaaggtaacaactaaaaataattcaagatagaagttacctcttggagtaggtagatgctggaggagaaattggaaatggtagagcaaggagggctttctgaaagtactagtgatatataattataaagaagctttactcttgaactgcagaaatgtggcagaatgagaaatctgttcaatgagttatgcagtagtatagtgtatatcgctatgagttgttgataaggttttatcagtttacttgaaaacctgtaactgaaatcgaagaaacatttgttttgttttcttaacttccaagattctgctgtaaatattttgtcaaaaatgttttaattatttggttttacaaactaggagttcaaaaattaaatgtacttcatgaccaactgtttcctaaaatatatcactttcctaataaaatcctactgagataagtacaacataaccatacattatttcacaaaagaggaaaatcactctacaaacaagtctaacaacaaatatcttgttacagagtcagattccatcattataaatctaacatactgataccctgtgaatagctaaaagtgaaataaaattcaagagtggcccagtttctagaacaattgcgctactatgaaagaactcactaacattttattttcttcatgaactaagtatattaatatttgattcctccacaaaataaactttataatggtcagaatactctctacttggttttcttggaggtgcaaagtgggcaagataagtatttgttcccaataaatcatatttttctcttgtagtagcttatataacgacagtactcaatatctgaattagtgacagaatttgcccttttgtcatcaggaacttcagacctatctacatggaaaacacaataagcaaaaatagcactattatcctagaaataaaagataaattatcagagaagttgtagcactgacattgtagaaataataatattttagatatgtatagcacaaatctgtcacatatatcagtcttttcaaattatcatgacctatatccatggttgcatatctagtaagcattcgagatgagactagaactcaggtgtgcttatgtgatatggataataataatgttgttagtgacctcttaacatttaatatatgtaataataattagaactcatttcagttgcaagaaaaacaaatcaacttgaataagttaaatttttaaaaaatggggtgttgtctatttattttaaggaaaaggagtatttcacataacacacacaaatatgcaactatacctcagctaggaatcattctgtgtctcctctctgcttctgttggcttatctcttcatttttctttctgtctctccacagagggctttctctgtctcagttcatatgatagaatatagctctctgacaagtcccaagtctacaagttgtagggaaagacactcctccaaacttgtaatctcttaggccagattttaacccctggtgacagaggccctaacgggcttaagctgcattagttagtcatcccttgtttaatgaactatgtctggcaggataaaattaattaggattcacacagatgctcaggtaaacaatgatggcgtaattgagagctgggcaactagtattataggaatctgtgacaccaggaccagtagatttaaattcaccttagaaactttagaagaaaatatacaggcatgataaaggataattatctaggaaaatggggtaagacaggcaaaataattatcatttagtgaaataaaaactctccatagtcttgaatcaaacatgatggtccatttcctattcctgtggcccaaaaccttgcaagatcaaaattctaagaatgctttgacattctccagtgttttagactacactgggactctctcattatcatgtgttagtgtgttgaagactgtcaacacaacatggcacggtgtgtacttaatctcagtcttggcctaggctgaactgatggaatggatagatactctacgtaagcagggaagacagtggaagaagtaggtaaggaagaacaaagaagagcacattgttctaaaatgaataagaaaaaatgtacgacctgattaggcttaaaagacgggaataataaatgaaaactgaccagactgaatgtctgctatatgccaaggaaggagttttactcacatattctccagtgctcacccaacaccaaatgttcctcacctcttggatagtgtgtcacatatataaagcatgtggtgtcttataccacagaaatatggagattaattttctgaattttatttatgtctgactgataaaaatactggctcacataatcatgtagccttttgtttttcctcttgccctttttcaaagagcttatgattttgtaaactagacactaaaagtggtttgttttgttttttgaccttctcatctgccgatccggataaccatcactctgtcacagagaagttgtaggatagtaaatgaagcaatacagcacatgactggcatgtggtatttgataaataaatgtttattcattcaccaactcactaggcttcagaaacagtcaaaacaaaagttgtgggagttcaggtgactggctttaactagttcacggctaaagctgggaaataaaccggaaatgaggatgggaggattaaatagagttgggtcagattgcagagtcctgaatgactgttttaaggagttcaaactttttctgcaggctttgagaatccattgtgttctgtctcctattcaagttattaataccaatagctcacagcagctgtgcattcacggagataagttttacaagaaacagatgaagggcttttttagtgctgatatcagatggattagaacgtgattaatcaacagacagactgattaaattattgggttcactgttcagataagaggttttggatacactctgccaaacggtaattaacttagaaatttctgctggcctgcttataagatgatcatgtgatatgctttgaagaaatcttttaaggcccagaatagcagctgtgaaggtgtaagcatgagtcagttttaacaattattaattatcttcaagtattagagcagaattttcattggaagtgataaatattttttaaaatctttacttttaagaaaacttgtgtaaatctctggctctactctacagtcgactgcaaatgaaatgactactatttaaaggagtatctaaaagagtcaagagaggagttttccatttctacaacatggttaacaagatattgaaaggaatcccttgcaatataacacatataaacctactggacaggatatgattttttctaaaagatgcatagctgtactggtatcaaaataaggaaatttctgagagatcagaaataagcacgaagcagagattcacaagggcaaactaactattgggtggtgtttaccctcaaggttttcgcccatccctggtggcctataaactgagttacaaacatctgagacagcagacaaagtctgggactgagcacgttgttaggtagagtagaaatcgccacataaatataggaccaagaaagagtgatgctctcactagaaaataactagagagcaatggcgggtcatgcgtcagtttcagctttagcaatcaaggaggtaagtctcttctaagaatcttaacctgtgtgagccccaaaatttaaactgcgaggttaaaaatttggtttaaaagtggttcctagtcatggtgtccttagataactagtaaaagcaatctcagaccctctctgaaagaatttactttacctcaaatatttataaattcccataaatacattttcaaggaatgtgagcccacaagagaagaaaatcactaatgacatgagaaaaaagatatcataggtgggagccagtgcaaagaaaaagctacaaaatcagatctaccaaaaaatgtatataatgggattatcagatgtaaaatataaaaaaattaatatgcttaaaaatacgagagacttgaatgtataaataatgagaaactcaaagtttatcatgaagatataacatatgagcaaatagaatttctagaaataaaaaaaataatatggaaaattaaaacctaatggtttggggatgatatgatgatatatctgggcaagttacctgaaagcaaacaaatgtgatgcaaaacatgatctagaggttaagagacatggagaatagcttaacaaggtaaaggaaaaatcaaattgcagttcacaagaagcaaatggagagaactaggagaggcaccatttccaaagatattgtcaggggtttaatagaattgatgaaggacaccaattcttagattccagacaacaacaaactgaggaaaatacgttttttaaagaattgatatctagatacattgtagtatacaagaaagggaagaattaaaaaataaccagaggaaaaaaagactactcacaaaaataaaaagcagattgagagctcacttcttggcagtaccaatgaaagccagaagagattagaatattttatatgaataagaaatgttaactgagaattgcataccttgtagacttataactcaaggataaagaaaaaatgaagacatttccaacaaaaggaattgtgagcaaatagtatatggtagagaaaattaatgaactaatgctaattctgcaactaggattgatgtgaaaaaacaaaatattgaacaataacaagaaaaaagcaagctgtgtaaaaatataaaggtgtgattatgtttatatgaggcaaaaaaataaacaaaactaaatagtacactgtttagaaatacattatgtgaaaaacatacgcaaaagcaagaaaatgattatcataaaatctaaaatagtcacctttcgagggaggagaaaggaatataattgaggaggcacaaacagaatcaaaggtacaggaatatcttatgttctcttcttctgtgaaatgagaaaaaggtattcatttttactatatcttaaactatataatttttgtagtatgcaatttttatagtaaaaaatgaaaacaaacttattaagcagaaaaaaagcaggtgcaaatctgaagataacagtgtttgataactctaagattgtatgttttgcctcagtattactgcctctgttgtcatatggttctgaatgatgttttagaaagaatattgattctagtcattccactaacaaaatgatgagcttgagcttgtattacatgatcctttgggattacagatcccttggtggatccctaatctaccactgatgaggatttcagtcatttatctatacaactacaaaacatacaacatgggaacatttcagattggagatactgctatctgaaacccttggcacaaatttatgatttagaggcattggggctcaaaaaaacgacaccctgaagtatggtgcgttgatatgctgagtactttgaactaaaggaatagcctcagaaccaaggtctctctggccttctcccagcccccatctcttgttctttctttcctgaagtgcagggagaggccttctcagaagtttcttttatctgactaaaggaaattcttcctgaagaaatgtcattgtcctgaactccttccctggaatctacattaaccagtcaagattaactccttgcaaaagaagagacacggccaggcacggtggctcatgcctgtaatcccagcactttgggagaccaaggtgggcggatcacccgaggtcgggagttcaagaccagcctgaccaacagggagaaaccctgtctctactaaagtacaaaatcagccaggcatggtggcaggcccctgtaatcccagctactcgggaggctgaggcaggagaatcacttgaacccggggggtggaggttgcagtgagctaagatcgcgccattgcactctagcctgggcaacaaaagtgaaactccatctgaaaaaaaaaaaaaaagaaagaagcgatcacacttacacttttcacctattcttaaggctactacctgggacactttatctgcatataaggcaacctttgttttcagttcagttccttctttcacccttctattgcttgtgctgccacctcccctcagaagccccaatcccctacttcattctgtagctcaaaatattatttatgcttccacaatttggcactccttagagtctcatattttgtgggacttccgtatatatgaagttgataaatttgtatgccctttctcctgttaaatctgtctactttcaactttattctagagattccaatcataaaaactttggaaaacagagggaaagcataaaacttccctatagaggtaatttcaaactcatattaaagtcatttcgggcaacacacacctctgttttggctaccttagggaaccttcctcaccaatatcctactgactaaaatggaaagaaaaaaatgaggaggataaaaagtttgtttctgccaagaatctatgaaactattcagctaatgaaaaatcatttatttgagcatacatacaaagtcaaactaccctaaatataagataagcagctatgcgatataataattaaaataataaaatttgaagtctgttttctcatcattctactcaatagcattctttcatatattaggccataaagatgcttgtattataattacaaaacaccattaaaaaatgtattatgtcctacagcacttagccttaacaaacaattactggatctcacattcaactgaatacaaaaagcaatctttatcacaaggttaaaattagccttggaacaataaatgctttcaaagctattctaaactccaaactgctttgcaccagtctgttttgaggaactgaaaacaagtaaactgaaggacatttgaaaaacttcctgtctgtgtcctctcaattttttttttgtttgtttcataggagacaatcatgttatacctgaaaggtgatccatatggccctcacagggtaaggtttcagaagttaaaatcaaaaccaaacaaaaataattaaccaagtaaacaaagaaaccctgagaattctagatttcacaatgtgttattcataatagcactctaattatcagcactacttttcagccattactacagaaaaaaatgaataaatttgattcacggaggagggacctgaaagcaaatggatttgttagttagttcaaacccagaattctgagataatacacttctcagttcatccttcagaagacaatatgatatgtagaatttcatcatttaaattacttaacaaattaatcagagtagcttctccttctgtaaaaggtgttgtaaactaaaaataaaattctaagccccccaatcatatgaataggccccctcctctcagtcaagggcattgcaaagttaacctgaaaaactagttcagaccatgatgggaaggtggggctggacatgcctcattctaccctcctccttttgaaattcaggcataactgtaggtattaacattaaaacagagatcttaagactgatgaaacaaactttttgtgcaataagacaccaaattccagcctcactctagtacagcatcacataacaggctctgaaaggaattgaagtattttaccctaaactatatttctttaacatattttgaaatggtcctgcaaagttgtctcttgtggggaaaatctactttctgtagagaatccccttccttttccaggtcttttccctgatctaggagagaattaactaagagtctggcatatttttaagtctgacaaggaacatttacaatctattctctctgtagcctgctacctggaggcttcatctgcataataagaatcttggtctccataatcccttatcttaacccagaaactcccttctattgattccaagtcttcagataaactctttcaaccaacttccaattggaaaatctctgaatctatgacttggaaccctcccctgcttcaagttgtcctgcctttctggaccaaaccaatgtatatcttgcatgtaatgattgatgtcttatgtctccctaaaatgtgttgatataatttggctgtgtcttcacccaaatctcatcttgaattctcgaatgttgagggagggacccggtgggagataacagaatcatggggcaagtctttcctgtgatgttctcatgatagtgaataagtctcaagagatctgatggttttataaagaggagtttccctgcactctctctttgcctgctgccatccatgtaagatgtgactttgtcctccttgccttctgccatgattgtgaggcctctctagccatgtgaaactgtaagtacattaaacctcattattttgtaaattgcccagtcttgggtgtgtatttattagcagcatgtaatggactaatacagtaaattggtaccagtagagtggggtgctgctgaaaagacacctaaaaatgtggaagtgactatgaaactggatagcaggcagaggctggaacagtttggagagctcagaaaaaggaaaatgtaggaaagtttggaactccctagtgacttgttgaatagctttgacaaaaatgctgataatgataagggcaatgaaattcaggctgagatggtctcagatggagatgaggaacttgttgggaactacaggaaaggtgacttttgttgttttagcaaagagactggcagcattttgcccctgccctagagatctgtggaactctgaacttgagagagatgatttagggtatctggcagaagaaagttctaagcagcaaagcattcaagaggtgacttgggtggtgttaaaggcactcagttttaaaagaaaaacagagcataaaagcttagaaaattttcaacctagctgggcatggtggctcatgcctgtaacaccagcactttgggaggctgtggtgggcagatcacttgaggtcaggagttcaagaccagcctggtcaacatggtgacaccctgtctctactaaaaatacaaaaaatagctggatgtagtggtaggtgcctgtaatcacagctactcaggaggctgaggcaggagaatcacttgaacctgggaggcggaggttgcagtgagctgagattgcaccactgcactccagcctgggcaacagagcaagactctgtctcaaaataaaataaaataaaataaaataaaataaaataaaataaaataaagaaaagaaaattttcaacctggcaatgagataaaaaagaaaatcccgttttctgaggagaaattcaagctgactgcagaaatttgcataagtaacgaggagccaaatgctaatcccaaagacaactgaaaaaatgcctccagggcatgtcagagacctatgtggcagcctctcctatcacaggctcagaggtttaggaggaaaaaatggtttcatgggccaggtccagggtccctctgctgtgtgcagtctagggacttggtgtcgtgtcctgtgccccagcaaccccagccatgactaaaatgggccaaggaacagctcaggctgttgcttcagagcgtggaagcctcaggccttggcagcttccacataatgttgagcctgcaggtgcacagaaatcaaaaatcgaggtttgggaaactttgcctagatttcagaggatgtatggaaatgcttggatgcccagggcagcaaaagtttgctgcagggacgggaccctcatggagaacctctactagggcagtgcagaagggaaatgtgacatcagtgccctagagtccctactagggcactgcctagtggagctgtgagaagagggccaccatcctccagaccccagaatggtagatcctccgacagcttgcaccatgcacctggaaaagctgcagacactcaacaccagaccatgaacacagccaggaggagggctataccctgcaaagccacaggatggagctggtgaaggccatgaaagcccacctcttgcatcagcatgacctggatgtcggacatgcagtcaaaggagatcattttggaactttttaagatttgactgccctgctggatttcagacttgcttggagtctgtagtccctttgttttggtcaatttcttccatttggaatggctgtatttacccagtgtctctaccctcattttatctaggaagtaactaactttcttttgattttacagcctcataggtggaagtaacttgccttgtattggatgagactttggactgtggaagtttgagttaatgctgaaatgagttaagattctgggggactgttgggaaggtatgattggttttgaaatgtgaggacatgaaatttgggaggggcaagggctggaatgatatggtttggctgtgtctccacccaaatctcatcttgaattcccatgtgttgtgggagggaccctgtgggaggtaaatgaatcacgggggtaagtctttcctgtggtgttctcatgacagtgaataaatctcatgagatctgatggttttataaaaggagtttttctgcacaagctctctctttctttgcctgctgtcatccacgtaagtaagacgtgacttgctcctccttgccttctgctatgattgtgaagcctccccagatatatggaattgtaagtccattaaacttctttcttttgtaaatggcctagtcccgggtatgtctttattagcagcataaaaatggactaatacatgtgtaaaaccaagctgtagctcgattatcttgggcacaagtcgtcaagccctactgaggctgtgtcatgggcaggctcttaacctcaccaaaataaacttctaaattcattgagctcaggagttcaagaccagcctggacaatgtggggaaaccttgtctctacaaaaattagctgagcatggtgatacatgcctgcagtcccagctacttgggcggctgaggtggcaggatggcttgagcctgggaggaagaggccgcagtaagctatgattgcaccactgcactccagcctggatgacatggagagaccctgtttttaaataaatacataaattgattgagacatgtctcacatacactctggtttacagtgtaatcaaaattataacaaaaaaagttggcaaatagaaaatctggatatatacgcaaaatattcttatttgttgacctaaaaataaattgattcctgcagaaggttctacaatcaaaatcttcctatcactttggttaaaatactgattgagaccctatcactagcttgctgaagtagctttgcaaatcattagatggttataaggaacatcatcatggtggcagttttcttttcggctgtaatcacagtctgacttcacgtgtatattcaaaattaattaagtagcaacagtaacaacgacaacaaatacattttaagtaacaatcgagtcagtcacttagatgcctgtctcggtgtcaagattgataaaagcatctccaaatgatagctgatatttttatagtgctctataattatcatttgtgcttttaaacatgcaataaaatttaacattctgaaacatcctatgaaatgagagaacctttttcaaaaatgttctttgaaatatttggggctaaatgggaagttatgtgaccacgctattttggggaaacaccaaagagacctccttctggtgattcacaaggcatctaagcatattaaaggccaccaggcatccagtactaaacctacctgcctaattttctataatccattatctttcaaaccttttggattctaaaagtttttcatatattacccataaatataccaaagaactctaacattttacagaaaacaggttattgagatagagaaagaaccccctttaggggcctgcagtggggggtggagggtgggagcccaagcatggaaataaaggaaaaacttgagatcctacaagaaaaattccaggcacctagctagccttgagaagtaaataagcaaattgataagcaagaaggtaacagtagcttaaaacaatagccaaggaagctataatcacaggatgtttcgttctctcatagaaactaacgataaaatatgtctctaagttgtttttcggaaatctgtacctccaccgaatggatctgcctgcaagcaggcctcagataagggagaactaagggctgaactttgaccaaagttctttgttctgcatttctttctgaggtacctagagaaagtcaaacccaagagccagagctaacattctttttgctcaccacaaatttcaaaacaaagcttctcttccttaactgattgcaaatcagaaaacatctgaatctacctatgaactgtaagccccctgcttcatgatatcctgcccttttaggccaaaaccaatgtgaaacctccatgtattgatttacaattttgcctgtaacttctgctttcctgaaatttacccctgctttaaaaaatcctcatctgtaagccatcagggaggtcaggatttaaatgtgagttgcctgatcttctttgcttggtgccctgcaataaatgcttcactctctctcgctgctatcaggttgtcagtgtttgtccttgctgagccaggtgagcaggcttctgatgtatttacgtaggtcaatggtctctaaaattatttgatcatgtactccatcaacaaagcaaacttttgacctgcatctccaatagaacatttagaaaaatagaaatcagaataaaagagacaaataatataaatattttcaaactttcttgccatatcccaatgctttagggatatctgaacccacaatgggcactgaacaagatttttctggagtgcaaaagaagggaacagatctagaaaagaagctatttagtttggtgcaacctcataaaaatctgccctgacaagagaagactgtccagagcaggggttgacaaactcctatggtaaagagtcagatgataaatattttagagtttacaggcactataatctctgtcacaactattcagctctgctattgtcacaggaaggtagtcatagacaacattactgagtgagtgtgtctatgttccaataaaaaattatttatggacactaaaatttgacttccatatgtatatatgtattaatcagttgttgctttcttactgctacttacattaatttcatactattttcaaatgtaacaaatcttctaatttatttccagccatttatactatggtctgaatgtttttgtcccttcaaaattcatattttaaaatttaattatcaatgtgatagttttagaaggtgggcattttagaggtaattaggtcatgagggtggggtcctcatggatcagattagtgcccttatagaagagacccctagagagaccccttgtcctttccatcatgtgaggacacaggtagagggcatcatctatgttaacagaaagtgtgccttcaccagacaccaaatttgccagtgcgttaaacttagacttctcaacctccagaactgtgagaaacaaatctgttgtttagaatctaacccatctatgacattttgttatagcagcccaaatggactaaggcaatttacaaatgtaaaaatcattcttaactcataggcagtacagaaacaggtgggaggctggatttgacccacggggctatcatttgcagactccttgtcctaagaatgaaggagtagattaaagaggaagaccaaagatgactacagagggtgagctgaaacaccgttttgattttcctgctaagttttaaggatgaaggatgaatgattcagtttcttaaggttaggagggcataagtcttgaatttatttataataagtagcagtaagaaatcagcagctagccaatgcataataatggattccaaaaaaattagtttccttgaaagagttcaaaacattatttaaaacatgattgcacttttgacaagtttttaggaaactccaaaattatcagagctggctctgtgatcctaatggccctctgtagatagtcaccactaatgtttatcagcaggaattatttctgcaaaaatggtatgaaaggaacagccatttaatatatccagctcattaggaacaaatatagtcctaatatctgtaatgtttgatagcactagatataattattttcaaatttaggtgagggttacacaaacatcataggtctccagaagccttttatctgataaatctaagtgcaataaaacctcatggctctgataaccaaaggctaaagaatgagtgatttatatacactgcagccttccagaattccaacttgttagctaaaatagctctaagggaagctaaaattgcaaaaaaaaaaaaaaaaaaaaaaaaaaaaaaagacaaataaataaaatgccagtatttcctcagaaacctttttggttgtagttgattttttaaaaaacagttctaatattactgaattttctggtagtgaaaatagaacaataggtataagcatcactgtttcatattagctatacagaagagtatgttgaaattcattcattagcatattgataagtttctgcttctctgataaaattaaactatactaaaggttcacaacttagaatgtagatactaaccataacaccatattatgatcttataattgggttacgatgtcttggatcaattttgtaatggaagtaatttcaaagtaatcttatttttttaaattgctacaaatctaatatacagagaaatgtgaaagattccaggtatctgaacaactggaagcaaagtatctgattgtttacttagataacatggaggatacaggctagagaaaaatacttaaatgattgtgtattcacatggaaaagtgttcctaatatataaaagccctcagccaggtcattttcatcgttcttgcaaataacaaatggatagctaaatagacttgaatatagacataagcagatcatatttgctaaatgtgttgatgttattgagaggaattaggaggtgctccaatggactgagggaccagattaagagatacaggtatatattgattctcataaacttcatacattccccctgcatttttcgaatcatttttttgatatgatggggcagtatggtgtattgtttaaaagagaatgaagtcaaattagctgtttcacatactgattcttttattttactatctgtgccacccagacaagtaaacagcctctttctatttcactttcctcattagtaaaatgaagatagtcagagataacatctcaaaaattaattgacacagccattaaataaggtaaaataaaaaagtgtatttagtttggataaggtaaaataaaggatgtttaaagtgcttaaaataatgtgtggcacaatacaaatgattattatgatttcgtggtcttccatgaattaacatttttaccctctctatggaagtaatatgtgcaatataatactgatgtatactttatctttggtgaatggatgctgggtgtttcagaggttgtatatagctgtaagcagtataactgcacgaggatactgggagaactttgatctttaggagggcttccaaatgctaacttgctgaagctgcccatgttagtgatacagttagacctacaaaagaattataagatttctgaactagggccaggcacagtggctcatgcctataatcccaacactttgggaggccaagacaggcagatcacctgaggtcaggagttcgagaccagcttggccaacatagcgaaaccccatcaagtacaaaaattagcagggcgtggtggtgggaacctgtaatcccagctactcagggggctgaggcaggagaatagcttgaacccaggaggcggagattgtagtgagctgagatcgcatcactgcactccagcctgggcaacaagagcaagacttcatctcaaaaaaaaaaaggtttctgaattagttatccacactgcttgatctggtaatgggaaaggatttgagctggagattgtgagtgcagaatgcagaacaacaatgcagaacaggtctaggccatacatcttttctgaaaacgtaatgtaagaacagagccttatatgcctacttcactgatgccattatgtataatgagatcaaacaagtttccctctaagtttcatatttcattgtctttaacttcaatatgttttaaaggggtcaatagggaaattataaaaacaaagatgggggtcccaggacagggaataaaaaaaacccgaaaaacaaaaacaaagagtccgggaaggagaccaaatatcttggatacagaatcaagatccaaaaagatgttgtgatggaccagagcaatggacttactttaacaaattaacatgtaacttggggtctaaaactgcaaccacacaactacaagatagagacagtagagtttatcagctgaaaacattaataaaacaccatggagcttatatttcaatatagtcaagacagaaatgagtattttcacagtaaattagtatgggatgtgatcgtcccactttccttttttttttttttgagacagttttgctctgtcgcccaggctggagagcagtggcacaatcttggctcactgtaacctcagcctgccgggtccaagcgattctcctgccacagcctcccgaggtagctgggattacaggcgcccaccaccatgcccagctaatttttgtatttttagtagggactgggtttcaccatgttggccaccctggtctcaaactcctgggctcaggtgatctgcacatctcggcctcccaaagtgctgggattacaggcgtgagccaccacgcccatcccgtccccctctttttcagagatgtttgaagtagtgccttcagtttttggcaaactagaaaactttaagtggaaaatgtaaaaaaagagacaggtttagagacttaaagacaggtcatatgagaaacagttaaaagaaacaagcatatttagcttggataaggaaaagagtcatacaaaaaatctatttttacttatctgaagaacagtcatagagagggagtttaaatttttctgaatcaccttaagatgggataatgtgcacaataattagaaactactcgaaagcatttcaattgtactttcaaacatccaaagctatttaaagaggcaattgccagtctctgaagagttcctcttaactaaagggtttgaggatagtgtagtagacacctactggattaactacccagcactccttttctgagaattgcctgttctctccttcacccacctggttgcagcctctgtcacaccttcatctcccctatgcacatcacttttgataggttcagaggcaacaacctgagaaagagtccatacatggttccaatttttagtacactttcttccttaggcaagttgctttactgttatttggatgtgagggacacctccgtatatttttcacttggatttcagttgtgcaaccaaaacaaaacttatatacatattagccagggcactaattgacagcaaattggggaatacagtaagcagatgatggccagtaagcctgtaagttcacttccaactgatactttgtatttgtgtgactactcacttttagtaaacatctatctttaaggacaagctttgggaatttgattataaaaccataaccttttctcaaattatattaacctaaatagccataatgagagaaaaatataggataaaatgttcccctaattatttactgaatttttaattgattttccagctttattgaggaataactggcaaaacttgtatatatttaagatatgcaatgtgatgacttcatatatcaaacattgtgaaatgattactataatcaacctaactgacacagccatcacctcacatagttgcctttgtttttttgtggtgagaatatttatgatctactccttttacaaatttcaaaaatacaatatatgccattatagtcaccatcctgtatattagatccccagaacatattcatcttaaaattgtaagtgtgtaccctttaatcaacatcttccaatttccaacctgcttcccaaaatctcctggcaactaccatcttactctctgcttctacaagttcaattcttttaaattccacaaagaagtcagatcatacaatacagtagtacttgtctttctatgtctggcttatttcacttagcataatgtcttctaggttcatccatgttgccccaaatgtcaggatttccttcttttatggcagaataatattccatgtgtaggcatacataccacattttctttttttattcattcatcaatggacacttaggttgtttttctatattggctattgtgaataatactgcagtcaacatgggagtgcaggtatctctttaaaaatggtcaaatgactcgaatagagattcttccaaagaagattcacaaagagccaaaaagtatatgaagaggtgctcaatagttccaatcaccaggggaatgcaatcaaagtcacaatgagctatcaccccacaccaatttggatggctagtatcaaaaagtcaagggacaacaagtattggtgaaggtgtggagaaaagggaatcctcatacactattggcagtaatataaactggtatagctattattgaaaacagtatgtgccaggcacagtggctcacacttgtaatcccaacaatttgagaggccagggtgggcggattgcttgagcccagtagtttgagaccagcctgggcaacatggcaaaaccccatctctacaaaaaacatagaaaaaaacttagctgggcatggtggaatatgcctgtagtcccagctacttgggaggctgaggtgggaggatcacttgagcccaggaagttgaggcttcagcgagccatgatcatgccactcactgcactcctgcctgggcaacagagtgagaaactgtctttaaaaaaaaaaaaaaaaggaaagaaaatgaaaaagaaaacacagtataaaagtttctcaaaaaattaaaaataggttaccgtatgatccagcaattttatttctgggtgtatatcaaaagagaatgaaatcatttactgaatttaaaaaagaagttaaatacttatgcaaggtaatcaaaatgacacaaagtctacaataaaatattctaacgatgaacaatgttgtttaccagaaatgcaattaatttgtattctaaatgtaaatataaatattaacacaatgaaatgtaaatgccaatatagcccattatacatactctgagtgtctaactaaacatatgaaaacataccaaagatatatttacaattagatacagatcaggtgttctgtcagacatatttcacatttaaaatttctggggaatgtctttaataatgtttaaatatttaaaatcctttgaaaagagagtttaggtattaaatcaacttaatacagacttacagattaatattactcctagtaattatatattagatgttctgaatatacttattaataattcatttaataacaacttaaggttcagtttttctgtcacagtttaagattaataaagaaacaaaaaataaatgataaacacagaagctatgtgttatttctatttaagaacaaacttgtggtggcatataatgtagaaaatgcatgtagatatttaattttggcattttgaatattcttcccaattttatttaatctgaatgagatatatgttataattatagcaaatgtttgatctaacttttatatagaattctataattaataaaatgcaattcagacataaactcctatcattgacttttggaattatgaaaaaataattccaacttttatctataaaaattatatcttatatctatgaaagttgctagaaaagttaagaaaatgtaaaaagaagaacacaggtcaataatatatgagaaaatgtaataaaggttaataatatgtattagcacacgtaataaaaatcagtaatttaaacagtatggttatgttacaagaagaaactgtaagaccaatggagcaaaacagcagggcaatgattgcggcatcatttttgtgggcattcattcatgtttgaatctgatatatagttaggctataatattaaattaatggggaaatatgagttattcatcaattgacataggataattgataatttagtgaaaaacaaagttaaatcatgatgatttgctatataccaaaataaactctagatatattaaaaacatatagataaaacagaagaagtagaagaaaacatatgttaacacatgcctcaactttaaatgttggaaaacttttaagtataaaaacagtgacaataaatgaataaataaatgacttaataaataagtaaaggaacaaattaatgagtaaaagaaaaatagactaaataaaaattcaaaatagagctagcatggattaatgttcttgatatattgggagaaaaggattaacggctgagttgtggcctttcctctagccctggggtagccaaattttatttgtaaagagccatttagcaaatacttactctttgtggatctgtctgtcacatctactctgcaactgtaacatgaaatctgccatagacaatataaaccaatgggtatggctatgttccagtaaggctttattttcaaaactaggctggtggccaaatttggcctgtgcaccttggtttgctgacccctgctctagcctcagagatgtgaaagacttgacttttggcctaatcctccttggcctaatcctccttgcaacaataactcaaaaagttaatacctgatccaagataaatcagagtcctgctgaggttacactctactcactggatacctatacattgttgagtttgattattaagtaatctataactaaggagatacagttacatcagaaaattaaagctagattcctaaccctgaggggagtcatgggctagcaaggtaacaaagagtaaatagatcccagagccgatggtttccctaaactgacagactacatcaatcagtccctttcctagtgaccatggaagtctatggtgcagaatcatctggggacactgaaagtggtgccagagccacatcactttcactttattaatactgtacctgctgtaacagattcatctcagatcctttttaaagacaaataaacttgatgctacatttctgggttggactatcaatcaaaatccaaaaataactgctgctgggaagagtaaaatatatgtgtgattataaaatgtgttcaaaaccaatgagaaaaagatgacccctttagtagaaaatgataaaaaatatgaacaattcacaaagtataaatttatatgaaaaaacaaagcaatgaaaaatgtttttaccttgttagtaatcagagataaaatgatccaattttatacttatcaagtcagaatttaatgataaaactatgcactggtagcagcataaagaaataagaatctttgtgaactgttagtagaatttacactggaaaacttgaaagtaattaggcaataggaagtaccacaaaatgtactttttgaactacaatcccagttctaggaatttatttcataaataagtcatagaacgtataaagatatgtgcacacagataccatgtttagcattatcgcaacaaaaatactaaaaaaaaaacagcttatatgtcaactacaggcacacctaggagatgctgcaggttcagttccagaccatcacaatcaagtgaatattgcaataaagtgaatcacacaattattttttgtttcccagtgtataaaatatatacactatgctgtattaagtgtgtaatagcattaggtctaaaaaatgtacattctttaatttaaacattctttattgctaaaaactgctaatgatcatctgagccttctgagagtcaaaacctttctgctggtggaaagtctggctttgatgttgctggctgcttactgatcaggatggtggttgctgaaggttagggtgcctggcaatttctgtaaacaagacaacaatgaaatttgctgtatcacttggctctttatttcacaaaagatttctgtgtaacatgcaatgctatttggatagcattttacccacagtagaacttcagtcaatattggagtcaacatttcaacaatgttcacagcatcttcactaggagctgattctatctcaataaactactttctttgctcatccataagaagcaattcctcatccatccatgttttatcatgagattgcaggaattaagtcacatctttaggcttcacttctaattctagttatcttgctatttctaacatatcttcagttactccctccaccaaagttttgaacttcacttgaactcagtgagagatatgcaactctgcctttcccttgaatacttagaggctactgtagggttattaattggcctaatttcaaagtcatcaatgattattggaatcaaattctttgaaactcctgttaatatgaagattctgacctccttccatgactgttcttctttttttttttttttttttttttttttaagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattcatgactgttcttaatgaaacctagaatggtaaatacttcccattcaccactaaatgttttcaactgactatgctcagattcattagaggtatcactatagcagttatagccttaatgcatttcttaaataataagacttgaaagtcaaaattactccatgatccattgggtgcagaatggatatgtgttagaagacatcaccacattaatctccttgtacatctccttcagagttgaataaccaggttgattgtcaagaaggagtcagtaggtctcaaccttaggcttaaaatgttcagtaaaccatgctgtaaatagatgtgctgtcatccaaacttcattcttccagttaaagagtacaggtagagtagatttagcgtaattcttttctttccttttcttttttttctttgagatggagtcttactctgttgccaggctggagtgcagtggcatgaccttagctcactgcaacctccacctcctgggttcaagcaattctcctgcctcagcctcccaagtagctgggactatagccatgcatcaccatgcccagctattttttgtatttttagtagagacgggttttcaccatgttggccaggatggtctcgatctcttgacctcgtgatgcacctgccttggcctcccaaagtaatgagattacaggcatgagccaccacgctcagccaatttagcataattcttaagggccctaggaccttccaaatggtacatgagcattggcttcaacttagagtcatcagctgcaatttgcccattacacgagagttagcatgtcttttgaagtcattcattcactcctcttgtttagctgtaaaagtcctagatggcatcttcttccaatataaggctgttttgtctacatcgaaaatctgttatctaatgtagttaccttcatcagttctcttagctggatcgggatagctcactgcagcttctacatcagcacttgctgcttcgccttgtaattttatgttatggagatctcttctttccttaaatttcataagccaacttctgttggcttcaaacttctcttctgcagctcccttacctctcagcctttacagaattggagcacgtcaaggccttgttccagatcagcctttgacttaagagagtgttgtgctgatttggtctatccagacaactaaaactttccctatagcagcaatcaggctgttttgatgtcttatcatttatgtgttcagaggagtggcacttttaatttccttcaagaacatttcctttgtattaacaacttggctaactgtttggtgcaagaggcctagatttcagcccatatcggttttcgaaatgccacctccactaagcttaatcatttctagcttttgatttaaagtgagatgagttagtcttcctctcacttgaacacttagagaacactgttgtattattaattggtctaatttctatgttgttatgtctcagggaataaggaggcccttggagagggagacagacagaggaacagccggttggtagagcaaccagaagacacacaacacgtattggttaagtttgctgtcttatatgggcatggtttgtggtgctccaaagcaattacaataacatcaaagatcattggtgtaacagatgaccctaacagacataatagtactaaaaaagtttgaaacattgcaagaattatcaaaatgtggcacagagacagaaagtgagcacatgctattaaaaagaatgacatcaacagacttgctcgaagaaaggttgccacaaaccttcaatttgtaaaagaagaaaaaatacatgtgaagtgcaacaaagcaaagcacaatgaaacaaggtatgtttgtgaggtatgtttggaataaggtattagtcatataaattatggtgaaaccaaattcaacagttacttttcattgcctatccaacatccattcctatatttgttcttactaatgggatcctgatattatttagggggcaatgtgtccaatttaaaacttgctttaaattcccttgcagctgggagagaccatttgacttacatctggctagtgagaaataatctgagaatttctgggaaactttttttccctaatatagaacttgtatcttcctgcttttcttctatttctttctgcctgaaaaatatatttctcagtagcagcattaaatgctagaaagcaaggtgtaatgtgttgaaactttttaagaaaaataatttttttttactctagaaattttaaatctataaggatactaaaaatatacctactatacatcccttttgaacaatctctggatgactggttttaggaaaataaaatatcaaactgagaaaaaaaagaaatatgccacatggagagtggcataaagtaatttgagtactcagaaatgaagtacacttctggaatacgaaagacttgtctccagatgaccgatggaaactgacagaatctttggaattatgtgtaaaaaacatatacactcataacaaatcaggtaaaatatagaaaaaactaatgatagttatgtataacaggaagtcaatagaaaatgtttaaattggaaaaaagtgtagtgtagtcatactcttcggaagcatgaatttacaaatctaaacatagtaattgcaagtatagcttaacaagatcaaggaagaagaatgtgaaaagacgaggcagggaattgctgaatttcatcaaaatatttttggcattatttaatgtttaaccttgtgtacattttacttttctagaagtgaagtttttagttttaaaatattataaaaaggctgggcacggtggctcacgcctgtaatcccagcactttgggaggccgaggcatgcagatcacctgaggtcaggagttcaagaccagcctggccaacatggtgaaaccccgtctctactaataatacaaaattagccgagcatggtggcatgcacctgtaatcccagctgcttgagaagctgaggtaggagaattgcttgaacccaggaggcggaggttgcagtgagccgagatcatgccactgcactccagtctggggcgacaagagtaaaactccatctcaaaaaacaaaaagaaaaaaaattataaaaagctgaaagacaatgtaatatgaaaaactgatttgttaaagattactatcttctatgtataaaagtactccttaaaatgataaaggcaaataattcaatagaaatgtagtcaaaggatgtgcacagtttcatagaagaagaaagaaaaatgtaagtaatgatttgagaggacgctcaaccttactaatagaaaaatgcacatgtgaacgaaccatgagatgccatttttttttgcacatattatttggccaatatgacaaaaattttaaaagactgataacatccagtgctagagatcggaggtagaggcagggagggatgctatcttatattatttagtgtgtgaactgttgttgagatacttttggaaatttatcttcagtttctatcaacattgaaaatatatatacttttaaatgagtaattccacttataggagtctattctagagaaattatagtataggaaacaaaatatgaacatttcacagtgacaaaaattgtaaaacccaagtgttcatcaaaaaagtaatggttaagcaaataatactgtatataatccatactctgagaattacacagctattgaaaaagtgagttaataataccaaagcgttttcctttatctgttttacattctattatgagataataaacagaaaaataaaaccaaatatattaatacaacttttaaattggaatactaaaaatgacaaaattcaagctattccttaaaagtcatgattcctttggttataatgtttcataattgatagctgcattggcatggatttttgcctaacataaatattttaaattaccagttcttcagaaaattataatctctactctctctctctctctgtatatgtgtgttcattcacacacacacatatttagacacacacatacaaacatttctagagaaggatataatgcactgatagtagattataaaccatcgttgcattgaaagtatctttttttagattacttttactaaagtagatgcattatcttctcctatgggagtggagaagaaaggtctattacattaaaagttataacaaagtatattatatgtcaacttgacaacaattgaacaagcgtagtgctggtattgaaagaggagtctaaggggtatatataacaaatcctagatataaagacttactgtcaatcagtgaactatacagttatttaatatgtggatgtatccagttcttcccattgcattaaactgtcttattcctcctttaaagtggtgttatccatctgaacacatattcaattacattttccactaaggatgaactgctaaaatcaatgtcacatcataaacacctgtatttttctttttccactagagtttaagattgctacaattctataagtattgactgacatcattagattattaagaatgaagaacttgaaggaaagataccgtttccatgtgagtgctaacacagaaaatgtatacttaaattctaccttttttcttcaagtaagggctgaatcagattcaggtacacatggctaaagaacttgtttggataaaatgatacatccaggccagtttcattagtgataataaggaagcacttttattattatattgggaatcaaagacagcaaatttagtttttgtaatacgagtagccattaaagagaacagttagcatttctgtgttgattgtggatactgagaataggccagttacttttgtacagagaaagcactcccaccccacctcaccccacctctgcctttgcccctaacttcctatgatggaagctaagatttcagctcttttatataacctctcaagcaaatttattctcctccaacttcctaaaatatttaacacattttcagttaaatctaaactcattatattttatgtttgtagctatataaatattggtcacaacagaaccaaatagcagtctgtaatctcatttcttgtaccgctctctcatttcactctcaccccaacttaaatgttctttcatttacttgacttttcccgaatcacaggctgtcttcccacataccatggtaacttcataaaatggctcataatctgactttccacaaagtcaaagctatcagataactgagcagtttgctctgtttccggagaaattccttctagctcttggttacctgatcccagactgccctgaaggtatactgcatacctcttagcctcaaatttcctttgcagtcctatcagaatttctttttggtgcagtccagtgttcactttcttcatttatttactcgtttcagatgagcacgctctccagttgcttcctgagaaagggctcatggaaggtaaatgtatttatctgcccttgctatggtttgaatgggtcctttccaaaattcaggtgttgccaatgtcatagtattacttataagtggaagctgaacaatgagaacacatggacacagggaggcgaacgacactgactcggtcctgttggggctggtggggagaacattagggaagatagttaacgcatgctgggcttaatacctaagtgatgggttgttaggtgcagcaaaccaccatggcacacgtttacctatgtaacaaacctggacatcctgcacatatattctggacctaaaaaaaaatttaaaaaaagagatgtggcttttaagaggtgattaggccaggagggctccttacccgtgaatgggattaaggctcttataaaaaaggctgaaagaggcttcaagcagcattgggctagctagcttgcctgcccttctctcttctgccatataaggacacagaaagaaggccctcaccagagcggatggtgattccttgattttggaattcctagctaacagaactgtgaaaaaaaaaaaattatcttctttatacattacccagtctcagatattctgttgtagaagcacaaagtgaatgaactaagacatgacatctgactgatattttggttggtatagaattcaaaactaaaaataatttccaactgggtcccatggctcacgtctgtaatcacagcactttgggaggacgaggtgggcagatcacctgaggtcaggagtttgagaccagcctggccaacatggcaaaaccccgtctctactaaaaatacaaaaattagctgggtgtggcggcttgtgccagtaatcccagctactcaggaggctaagtaggagaatcgtttgaagccgggaggtggaggttgcagtgagcggagatagcaccactgcattccagtctgggtgacagagcaagactccatctcaaaaacaaaaacaaaaacaaaaacaaaaaaattcccctaggttttcagaagtattgtgttctaacttccagtgttgcttttttgggtttttgctttctttatagatggcttgcttattttcactctagaattttctaggatcttcctaaatccatgtttagaaatctgaagatggtaaatattggtgcgggtctttcttatttcattgtgcctttgtggccaccatgttcttcatttctggggacatcttctcattttatattgttggaaattccctcctctttattcgctctgacttctccatgtagcacaactgttttaaaggtatggagctattagtcacagtctctatttttcctgtcttttctttcctgttttcagttctgtcattttgttcttctttctgaaagatgttcacaactttcccttccaactcttaaaatacatatttactttgtactgtcacagttttaacttccaatatttcttctttgatttgtcaattgtaatagcattatatttttattcatggagttagtatattgtactgtttctctgcactgattatttttccgctcactgtattcactcaggtaactatgaattcatctcttatgttagactattgtggtctctgtctttatgtcaaggaatttccttaagccatctcttttctttctgactacttttaagggcttttctttgtctccgattttctgttatttcactatgatgagtgtaatgaggagtttctgttcatttattctgtttgagattcattgagcttcctcaatgtatacattaggtctttcaacatttctggacagtctcagctaacttctttgtattggatcttccctattttgtttatttactagaactctgacatactctcgtttgtttttatttatttagacagagtctcgctctgtctctcaggctggagtgcagtggaacaatcaatcttggctcactgcaacctccacctcccgggttcaagcaattttcatgcctcagcctccagagtagctgggactacaggagtgcaccacgatgcctggttaatttttctatgtttagtagagatgaggttttgccatgttggccaggctggtctcgaactcctgagctcaggtgatccacccaccttagcctcccaaagtgctgggattacaggtgtgagccactgtgcccagcctgacatactcttttttagaacttctcattgtattttccatgtcatttaatattttattcatattttctatctcctttcttcagatcactatttttctcttcagctatttaatcaattcattgaatttttttattaattttgatttctagatttatttggttcattttaaaatacatgtggtcatttttcagtttcattttcaggaatataattgccgatcctctgcaaaattcttcagctaatattgacttgaagcaactacaaggctgcccccagatagtttcagatatctgcagttggctaagtaacttacaattagtacactcactttctgtcttctaatattttgttggtatcctttactatgttcaatctcctgatatgtttgtcattgtgagtttgcatatatactgtagttttaaaaaattgatattgcaatatttaaatgaatgatattgcaatattgacatggaatagagattgggagaataagtatgaagtatgataaaactactatgtttaacaggaagttaatacaatgtattagttaaaggattttactactaatgcacaaccccaaatacccagattatgtgacaattcataattttaaagaggcacatcataacattgttattgtctatccagtgactaattaaagtataatctttttaaatgcttgtttttgaaatttataaagttcatggataacagttcagttgtgatttacttgtaaaatatgtaaggatagaatctatttgagtacattaataaattattttggccttccattttgcagtttttaagggctgaagagaacactcaatttttcatttgtactatactccattacgtatgaaataacagatgcacatttttgttgttgttgaaagttggggcctccaaaactttatgacagatcgttcataagtttcatggttctaatgactggaaaaataatacagaacttaagccatggagattatgggtagagagtatagaatttatatcacataaatcagtataagatgttggtgttttaagagactgttactcatttcatatccattactcagatagatcactttaatttagaatccttcaactttaatgattctgtaaataatgggaaggtatatcactgttagtgctatccaaatcaaattttatacaaatttatgattaattcagaatttctaaaactccaaaggcattgggatattttcattaatacctttagttttgttcttatttattatatgggtttataactcagtttttaaaacactaggctactgaaaaatcctagaattgagtaaagttttcttttttatataagctatttctaaacataaatacagaatttctctccataagttatcaacttgtttatttttcaaagtcactaaatagcattattaaaatagcaagcattaattaatgagtaaaaaaagataaatcagaaatagccatgcaaatattaaaaataagatgttttggagattagtcatctttgaatcattttatctgtactcttaggtcatatttcacatactttttaagaaataaaatgctaaaacgattaattttcttaaacatggatatttatttattgacccatttgaaattaaagatgaccaatttcatacataattgattatagtattttggtatatccacacaatggagaattatacaccagtggaaacaaagacaaagaaatatctttatattctattaatgagtgacctccaggatatttatttaaattaaaaaaaatatggagaaagaggaattttactaaggaggatatataaatggcaaataagcatgtgaaaagacgttcaatgtcattgcacattagagaaattcatattaaaatgacaatgaggccaggcgcggtggctcacatctgtaatcccagcactttgggaggccaaggcgggcggatcacgaggtcaggagatcgacaccatcctggctaacacggtgaaaccccatctctactaaaaatacaaaaaattagccgggtgtggtggcgggcacctgtagtcccagctactcgggaggctgaggcaggagaatggcgtgaacctgggaggcggagcttgcagtgagctgagattgcaccactgcactccagcctgggcgacagagcgcgactctgtctcaaaaaacaaaacaaacaaacaagaaaaaacaatgagatatcataacatgcataagagaactgctaaaataatttttaaaaatagtgacaagtgaccatattaagtactggcaagaatgtggaaaaactagatcacttatacattgcttgtgggaatataaaatgttacagccattctgaaaaacagtttggcactttttaatcaaattaaacatatagttaccatatgacccatcaattgcactcccttgtatttatcatagagaaatgacaacttatgtccaaacaaaaggagtacacaaattttcatagcaactttatttgtagtaacaaaaatctgaaaataacccagatatccttcaacaggtgaatggctaagcaaattgtggttatatacatagcatggaatacaagtcagcaaaaaaaaaaggaactagctattgacataggcaaaatcttggatgcatctcaagggtatgatgcttattttttttaaaagccaatttcaaaagattacacttgtataaatctatttatacaatatttttgaaattagaaaattttagagatagaggacagattatggtttccaggcgttaggaatgcagagagtgaggggacagaagtaagtgtgactacaaaaggttatgtgagggttgcttgtgatgatagaactgttctttatcttggctgtggtggtaaatacatgaacctacacttgataaaactgcatataattatatatacacacacatacacaaaggaataaaagtaaaacagggaaatcttcataagattggcaaattatattaatccaatatttgtgctcttgtaagtttaatctgtacttcataagcttacctcaaattactgtgaacctacaagtgctaagtcagaagaatcatgcctataactaggtaacactgaggtaggaggcaggactcaactctggaggcagggttcagacaccagacccaattgagacctagctaaaacagggccagggcagaagcagctttccacaagacaagacatgtccaccagtgtgccatgtcagtttaccattgccatagtaacagccaaaggttaccgcccctttccatggcaacaacccaacaatccaggagttaccacccttttcttggaaatttcggcataatctgccacttaatttggatgtaatcaaaagtgggtataaatatgactgcagaactgcctctcagctgctgctctgggcacactctctatggggtagccctgctccacaacgagctgtacctctgctgctgtgtatgctgccgcttcagtaaaagttgctaacacctctggcttgcccttgaattcattcctaggcaaagccaagaaccctcccgggctgagccccaatttgggggcttgcctgacctgcatcatcaccactatttgagtacaaaaaatgtagttgaagagacaacccatagctttgttaaactatttacactcactgatatcaggaatcctgtttttaggagtaatcattgtgaggaaaaatatattttcacggaaccacagaatttttggtatgtgctacattaagcaagcgcaccaggtttaacacctgagctcatgttcctaccttgaagttaaggcaaaaagctcaaatctaaagaatggatgaatttagcacaataaaggtaggaaaatgttgaccagccatgctcatctatacacaatactcccagagggttccatccttattattactacatgtgataaaactgtctagacctaaatacacacacatacaaaggaataaaagtaatactggaaaattttcataagattggcaaattttatcaacatcaatatttgtggtagacaatacacatggtacacttacaccaggacacaccacagccttgacctatggttattgtcctggttactcctgtcctattaaaataaggatgaaaaactacattaacaatgatagcctttgttgagtacttactatgccctgagtacttgctaaagttttacttctgttacatgctacaagagtacttgacacatgcatgaactcagtaaattacaatattcctatttcattataataattttacaaataagaaaacaaacttagcattttaaataaaactggcacaaagtcccatagctaataaattgcagaggtgggattattcattagttattcattcaacaagtattaatactttattaatgctctagaaatagcctttaacattaatacctataatattttttgaggactcactagaggctaagaaatgtatttagtactttcatcattacaccaaataaacaacaatgtgttcctggttgcgcaagtcactaacccttttgtgactcagcttccttcctgtaaagtgttaataattatactacctctactccatagtgctattgtgaaaacttacacgaaatggtatatgaaagatgcttaaaatactgcctgccacataataaatgcaccataagctgtcattgtcatcatcaactcactgcatattgacaattccttatagtagaaatctcatctgctataccgcttactaacagttttatcaagaacaaccattctgtctcataccttcatcctttattattatactactactaatataatatagaatatactgataatatattatatattacatagtatattatattatcatatatattattaacatatatattacatatattacaattatatattagtataacacactaataattgtataagtattatataacgtactaattatatactataatagtatattgtgttataattactaataattatattaataatataatatgtattattcatatttagaggctgcagagagaaggcaaaaagaggatgcatctcagggaatgttggatgtttaatctctagaataaaagagaaagaaaagaaaaaatagaaacacaaattggtacatctgggcccccaccagaaggtgaacttaggtgtacagtttcaagaagcataacatgagtggacaagtctactgccaacaactggttaatatctgcaatcaggtggaattcctcaacttaatttcttctctgaataaattaagattcagactttgtaatactattgccctgaaatgtaatgctaaaaaaaaaaaccaaaaaactgattttcaagcttagaagatggctacacctttcactaaatacttattttactacatttgctcttctgcagtaagctactgatttgctatttttcttagtatttaaaagatgtaactaaatagtgaatatatacattgcatataaaattctgcatatacttctaagattaaaatttgcaattgtatttccatctctcataaaatgatctaatgacttaaaaatatttataatatataaatatgtaaaaatttgttaatatataatatattaacctaatgatatattatttcataatatagatactacataataaaatatacattattcgtagtatattatatataatataattagtatattattatatatttgtatattatataccactaataatataagatataataataatatgaatagaatatatattgcatagatttgttgcagaggttcagtgagttaattccttcatggtgcctgggatataagtgcacaggaatagttttaaatgagggaagcacctaatggaatgaggaagggggcagataggagtggcttcacccttgaaactgaaaaataactaatttttgtatatactacgtaaccatgagggctcactgcttttctgtgtcttcatttccttttttaagctgattttgaggccaattttcagtgacatctttaatgaaacagagttgtgtagcagaaaagcactggctctgcaattatacaaaccaaggaagaatgctggcttccttatttaacagctgaatgatgctgaatagtacacttaattctctgggcctcagttttattaactaaaatttcaacaaataacaatataaacaatatgaaaatatttaaaacttctatctctaaaggctgttaaagctattttaatcatattgtctattatataaagtttttagatgaaaagggggttgctatacaaaaagatttgatcttacggttttgcaccatcatattaaacatgtttttccccaatagtagcaaattcagcaattctccaaccaacttccggggtagcactgcctttggaaaggcatttacaagttggtttaaatgttacagggcttattatggatacatctcatgtattctgcggcaggtttcccttttatgtttcaatgcctcaaaaagatctcttctgatactgtatttttaattcatttccacttgtcaaagggggatatcaggttttatttcaaatttgtgtcatctcattgctatgtgatatttgacattacaaaatatagtgcaaatctccacatattaagctcgatatagtcataaatttgtactccaagccctcattgacttcaatagggcttggacttgtggaatgattgcagatcaaggcattttgatataatgtaattttttaagtagctttttttccataaggagaaacatgctgcgaatagcaaactacctgcacagcatacacacagcagtcagtaatcctggtccttgtcaaaatattttctgttcatatgtaagtattgactgtggtgagagacttaaaatgactttaaggaaaatctctgtggtcacactctactccctattcacataacacaatttgaggaacttcattaaaatccattcttatagaaccacccttgcatgctttattacagtaaactagctatcaattggactattgacgttccacgtatgcagatcatagtatcttttccattattttaaaatgcttttgtttctaaatgaagatttattttgccagttgatcacagaatgagcatgcacaataaatcatgaagagcacagtctgcaaatatatgtttcaagttcaagcagcaatgatctgctacttacaatcctgaagataataaacatttttatccaatcatccagagtctaaagaaattcaaaaaaatggaaactctttgaaatatacaggcttttgggtatcaaattacctttgaaaccccccacccagaagtatctctaacaaaatccatttgaaatactgcttcaatattctaaaaaatcaataatttaaaccacaggttgaacatttttactgcttccactgcagactgtcatttttcgaaatgaaaatgctaatgataccgaaggggaaagcactaagccgaagagatgcatgaatgaaacgttggattggctagacttgctggtttgatctctttctccctcactcatctgtgacaagatgtcttttaaaatcaacaactttcatttcagtgtttctaaaaaatgcacttctctgttgtacattacatccttctctacaggaagttaaggaatatgctctagcaagacattttatagtaaatatgaatacagaatgtaataccaagtaggctgtcttatttcagtgcaacctataatgttgggacacctttaaaatattgcagagagcactggagagaggataatcccctcgtactaacggttttcatattcataccactgtactaaaacacaagccatgaaggaagccatggaaatccagagcccagaggagttcaaatcagaaaaaactttttcattgcctttgaaatttatttttgtctttaaagatttaagaagtaaaggtgtgagatcagggtcattgccttctccatagggctcctggctttgaatttgctctacctaatacaggatcttgctagtaaacttggttaatgtcaggtggagcaattttcatccaagaactgggaattatgattcatgggatgtaaaacatcttactggagggaagactagggaggtggagaaaacaaaacaatgattgtcaatgaatagccaaacatggtcccatgagctatgggactcaaaagggagaaagctggtgccctaaaataatggaattaaaaagaggcccacagcaaaccttttaacaagtttctcatttctttcttaaaaacctacagaaacctaaattctacccgcagcaaaatgatagcacacaaatattattgatcgatttctataatgtgataaatcacatcatttccatctggaagcaaaaaactctaacaagatagaagagggcaactcagtctttgttgagtatctgctgtgttcaaggaactgagatatgactgtagggacagacagaagagaggaattcgaaattattaaagctcagtttatccatgcagtggagattatgacatctaccacagtgagttgctagtagtaaaagagaaaatgtaaattatatggctttcgaaatgcttgacaaataatatatacacaataactacccaatgctagtttcacagaggaaaatggacctggtatacagataactctaaaaaaatttaaaatgttttaatttttgtttgtttgttttaaagataaggtcttgctgttgcccaggttggagtgcagaggtgcgagcatagctcactgcatcctcaaactcctgggctcaagtgatctttccatcttagcctgctaattagctgggactacaggcatgtgccaccatgctcagcttaaaaaaaagaatttaaatttagcatgatagaactgaaaagagctgatagctggttcacctatctcattttaaaaggcttcatagtgtgttagtggcagatttgcaatttcattgcaatttctgtctttttcctcttaacacaggcggttctaggactcctacagtttataagaacacaactttaagcctgggcaacatggcaagaccccaaatctatgaaaaatacaaaaattagccaggcatagtgtcacactcctgtagtcccagctgctcaggaggctgaggcgggtggatctcttgagcccaggagatcaggctacagtgagctgtaatcatgcaactgcactccagcctggatgacagagtgaaagtttgtctcaaaaaagaaaacacacacacacacacacacacacacatacgcacacacacacataattttaagataaaagaaagcttccagggtgggtcacatctaagccggctcctgaggatgaattgtattctcaaaagtcaaaatactgggcagagctcttcagatacgagcacaatgcatgcacaagtgctggggcagaaaagcacaagccatcttcagagactgtgcatggcaccctcaggcagttttaccttgagtaatgagcggcctgcgcatccatgtgcacaatcatagtttgtggattgaataacaaaaacatcatgtgaagtctgagaaattttatcaggttccaaagggacaaatattttaaacatgttaaggcttctgttattgtgtctcctttatgggaagaggttggtgggaggaattaagactaagagaaagttaagatgagagagggcattgtaggcatgctaagatttatggcctttctcctgcagataagcaggagagagagagatgtcaaaacatactttggggagatacagttggatgaaaatatgtagattaatttctgtaatgtccagaaagaatacagaaatcagattttaagagtttcaggcagtgtcctttctttgtgctccctcttcccttcattgaaagttaaaagtcaaaatgtaaatacagacttaaaagggtaaatcattctgtttttcaactttattcatgtgaactcaatgttttaataaatttctcttcccaagccacatcaaaatggtttgttatattgttgattttattattattgattatattattattacattagcatttgaatctgtgaagtgctgtaagacagtttgttaacaatttgtcatgacacctctgctgggtgggaggatgacacacatcattatcattattattaagattttcttttacagctggtatcatgataaatgatttacagataaacatagcaatactcaagttatttatatcaagttaattaatcatattgatttaacatcctgttctgttatttaacttttcccctttctatgttagttttagatctaattttagaataattaaatagaatttgaaatttagaactctgcattagtacctatatcacatctgaaaaattattaacattttcagatcaattttaataactgcaggtcctttattaggttgaccttttctttccaaatatttgacatcattatagttggagaataaaagtacctattgacagttttcttttgatattgaaaggtcctgcttcagtaactgcacagaacatagtaaccatgtttttctcatcttatgttcacttcctttgcaaaacaacaataaacagctggcaagtcagagataccagagtttttcctaacttctctcttcccatatctagcctcatgcaatcagtcaccaggactgctactttactctcttttatacatgtcaaatacgttcactttgctctagatacaaccttgagccaatatcttttcttccttactgtattacactgtaagctccatgaatttagggccttatattcctctccactctatcctcaacatccaagcacattgcctagaaataatttgtcaatgaacatgttcatctgctctcactcttgtgactattttctacactattatcagataatcctctctaaaatgcacatccaagcctgtcttatccttctttgcatatagttcattatcctttaagataaagttcaaactctctttgatgatcaaacaagggcctttattatgtggttccattctaattcttattctcactacatcatccttccagtgaaagtaaacacccatttttacggggctttctttttctctctgactttgctcatgatattcatctataatgtattctctattctttggacaggcactatgcagggcaactgtttggtatcatcttttttccaatggcattccttgctctagcttggtttggtgcttcctctgtagttttatagctcttcgtttctaattctctcatagcatgttttctcacgcacatcacatctagattttaggttctctgagaaccaggattgtatcttattgttatacaatacatgatctataaaaatgaacaaacaaattacacagagtataaaatactataaaaatacaatgctaagggggccaagtatgtggtttaagagcactctattgccatccaaatgaatttgaacaaatcttttgattaaagaataattttcattatctgtaaatgaaagctcttagactcaagctagatctcaggcaagtctttttttaacactcacagtctgtgctattatatctagaatgataaaattaccaagcagggcagaagtgagcagggaacgacaattgattcagactcctagagtaatgatctttctccttgctatctacagtatattaaatgctttccttttggcttctaattctgtatgttttgctcaaaatttagctaggaatatttattcatttctttgaactatatataaacagtaagagactactcattgaatatagatgatcctgtaacactttcttccaacggcaaagaacctatataactagctattctttggaagttgcctgtaactccaaaactctatttttagatttgctattacaccatgtttctaacagaactgggtcaaattgcccctgatgaccacactttctgaataaggggaaaaaaatatggaaagtggaagctactttaactgtcaattatattaaccagttgccacaatgattgttaataagaatattaaggaaattattaggccttcatatttttactttttctacttatcaataacactaggagtcaatatcataatgggaaacaacttcatacccactatgaagtttataacaaaaaagatgaacaacaaacaacaatgttggcgagtatgtgaagaaactggaaatatcatacattgctggtgagaatgtaaattggggtagctgctttggaaaacagtttagcaattcccaaaaagttaaaaatagagttaccatattacccagaaactccactcctaactatattccaaagggaattgaatatatatgtatctcccctcaaaacttacatatgaatgaagaaatatttataataggtaaaagtagaaaaataccccatgaagggttatgaactaatgaatggataaacaagagtggtatatccacagaaagaaatgaagcattacattgataaatgctacaacacaggtaaaccctgaaatattatactaaatacataaaagaaaccagacattaaagtcatatattatatgattttgtttatatcaaatgtactcaataggtaaatccatagagatagaaaatacattactggattccagaggctgcgggatgtggggaatggggagtaactgctaatgggtatggagtttctttcttagggtgatagaaatgttttgaaattagatagtgatgatggatacacatttgtgaatatactaaaaaccatgaaaagttacactttaaagaatggattttatacgtaaattataaaaacaaataattctggagatgaagttgatggttaagaacactaaatattatattttcgtattctgaattttttaaattacagggataaagctttccaagtggttaaaagagaaactgtctttacactaaatatacacacacagtactttgcctctctctctctttctctgtgtgtgtgtgtgtgtgtgtgtgtgtacttatttaaaagccaaagtaaagtattacatgaagttctcaacagataattgcataaaatcatgatatacagaattcactcttgtgatggctatatattaatggaagccagctacattttaaaaattattttacattttttatatattgacaaattatagttgcatatatttatggtatacaaagtggtgtcatgacttttgaatacaatgtggaaagattaaattaaaccatttaacatatcacctcaaacatatccatcacctcaaatatttaacattttttgtgattagaacattagaaatttattcttagtgataatgaacatacaatgtattgaaatagattaaaatttaatagaaaacaacattgaaatttatttgtaaacataaagaaatattttttcttaaaagttatgatttataaagagttcttctctaagaccttaatttcactgatagatctacttggtatttcttttatgtaaacctttataacttataataaataactttaaaagttattttcatgaggactaagatgaaaagttgagtggatcaaaatatagatgggttggagttacagcactgacctctatctgatttttctccctcaggagatatatctttaaataaacaatttctgtttatttaaaacagaatatatctttaaataaaacaaatttctgtttgtttagccttgtattcctttggtaaatttggtaaattcatttttctgctatcttgaataatttgtttatgaagtcttccaagactttgtaacctatgcttcaaatggaatgaatataatttttctacattcttgaaataaatatttttattttacatccatttttatgtctgagaactagtattttagaacattgaaaaacaccttttgtgttaaaacagtaaatattttcatttactatgcatatatctccaagattaatgctaaggcaaagacatttcagagactgcatgatgtgtatttctctctatctaaaaacatatatagtatatatacaacttcaaattctccttggagaacagcgggaacaaaaaaacatccatatctatctaatcacatacagacttacttacaaaaattacttacaaaagaggtgaccctcaacacttttctcaaaacaaagggaaatttattttatttaataagaaagtcacaacaatttttgatactataatttaatttaggccttcttatctcattacaaatacaatttttatttagtaatctagtttggaaatactgaaaagtttttcaagttttatttacacaatagtgtaagtcaatccaagggtcactgtgaacttgtggttctttgttacaactgcaacctaatgttctattcaaagtcttattgcaaaatcctcaaaatatgatgaatctgggtggcaaatggtaatagaggcaatcatttacattcaggtctcttatgaagaggcaatgtgtatgtacctaacatcatctgtaaaggacctatattctccaatggattcatttaatttatttgcagggtgaatttttatgttagtatttcagccataggtgacttattgaaatgaaaagttaaacttcctcagctacaaagaacaataaaaacaacaaagcaaacttctagaacttttagttttaaaggcactcaaattttacaggtaattcatcaaacaccactcacatccacacagaaatcaaatacatttaattatgtattgaaatattttttcttacaaattaaactacaggcaaaatccagttgcatgacaaaactgcataaacagtaaaatgaaaatgctctcattacaaatacaatttttactcagttaaaatatcatccaaacttatatttgtatcatgtctaatatttttatgattcacagtgatatataaattaataattaaataatgaattcaaagctcttatttcaaatgtcttctaatcagtcattttgttatcttatattttcataaaagaggcattgttttagatgcatgggattatcgttttttattttttgccaaatatatatgttaaaaggaggaactgtagaatcatacaaggcgtagattaatataatgtgagatagtgtatcagaggtgatacatgccacgcaagcagcatattttacattctgacacacattttaagccttcttttactcacgtaatttaggcttcagatgcatttctcaattgctcactgcagaatagctgcagaactgaaacaaaaccttcagtacaaaaatgacaacccttttgtttccactaaatccgtattctgtcatccactggcagggagttttccagtcatgttctctgccagtccttaccagtttgccaattatacaagctgcttcccagacatcagacacaaattccacaagactgctgtgcaagcgtaccctaattaaccatcagcttaattagacaatttactgtgtaattagcaggcaattagtcaacacctctcagatcttattgactgctgtgacagcctttcagtctttgcacattccaacattccaatacacaacagcgaccatgtttctagcactctgaaaccctgtacgacatagttctggacggagaagtgggtaatattatataacaaaggaaaaaatcaatatggagcctgtccaattactgaactgtttataaacttgtcttttatttaataccagaagtctaacattaaaactactttaatatctgcttcaaaatggttatagagccaacttcttaatatgttctatttcatgttttaatgtaaaacactttaaatttactatgaattatacccccgattggctctgcctatagtaacttgagtaaattttcaatcagtgtatcagagatctactcaattaaatccaattaatgtggcctggtgcagtgacgcacacctataatcccagaactttggaaggccagcacaggaggatcacttgagcccagaagtttgagaccagcctgggcaacataacaacaccctgtctttaaaaacaaaaccaaacagaaacacattagccaggtgtggtagtgcacgcctatagtcctagctacttgggaggctgagacaggaggatcacttgagctcaggagttcaaggatacagtgaatctacactccagcctggatgacagtatgagaccctgtctcaaaaaaagaaatcttactcatgttaatagcagttgtagacacaaatcctacaaacactgataaaaagtgctctggggtagggaagcgttttttagttttctttgagtcagctacgaagaaatcacacctcagcattttaatgtttacattaacactttacatgagttacatgattttaacatttaaattaacacattaattttacatagaaaagcatgtttacaaatgtattcctctgaggtcatgtatatgtcatataatacccactgctctttgtaatgcaatttctgacctatataaaatattttccattatctcgagatttcatgacttgtaactaatgagatcccaacaactgtaacaaagaatgatcctttatcgcttttctttcagaaatattacagaagaggataaattttattgaatgatttaaaagtcataagatcttctgttaaccaaaaagaacaggaggaaagaatttgtgaccactccttcatagtttaattggttaactgccacatacattttctaacacctgataaacttccataagtataaaaccactatgacaacataattatttctgcattatctaaactttgccattagcagcaattttctttttcttctttttgaatgtaagggcctgaaaattaccagcaagaacagttattgaaaggccacaggttggaggaatctagagaagtccattgtggccttattggtaccaggtaaagtagaatgagatgaggaccgagagacaggcaggagctgtttgctgacatgatttgtacaaagattctggattttattttaagggctaagagaagccattgaaatgttttaagcaaacagccacgatctgatttaagatgtcaaagtccactctgacggtggtgtggaggccggaatttaggataagagtagaagcagcaagactcttttaggaagctggtatactattctgtgagaaatgatgggggctgtgatgtgggtggtaccagtggagatgggaagtgactttctaccctttaataactgatcacataactattaatgttttagtctggcatacagattatggtaataagaattataacttttattgacagggtattttacatgttacgaatcattttaatatatttatttaaaaaaaattcaatctaagcctcactagaatactgtaaaaaggcagagcaggtattatggtctattttgtaattcaacatgtggaagtttagataagttaactaatttattaacagtcaaattacttacagaagaggtaaccctcaacacttttctcaaaacaaagggagacaactgtaacgtttcaataataactagtatgattcactatgaaaaccataatttaaaacttaagagtatattgtgcctctctagccttctgcatgcaagcttgtttttctcttttcatattataatacttaataagataatatttgtatacattttatttacctgtggatctctgttgtctatacaatatttctctttatattgatcaacaggagatgtccaaaaatcacaccaatgtttgtttattccccccatttaaaagccatatactaagtggctgcctaccttatgctgagtattgtaaaagatccaaatatctttgtggcaatctcacgtaactccaactatcaggagtataactgagcaaggaccccagctgctgtgctgtgaatgaatccactcctggattttcactgcagccatgcttcctgtggcttagccaatgactgagcagggcagagatactaagcaggccccttcctgagagacatgaagactctagatggctttgtcgaagctttctcagtctgcaaggcactctatgatgctcctactcaacctttctttcttctctccccaatgtatggcttgacttctattgctgtcttatggctctcccagtcctcctcaacaccctccatattgtctcccacaattatttcacctaatcaaatccatgcatgtttaatcacatcttggcaacggtttcttggaagatctgaactaaaacctgctgccatattaaaaaaattaaatgttactgacaaaatccagaaaaaaaaatctctatatgcaaatagttgtatgaaatgtaagggtttttaaataatgcattttcatatactaaatgtccataagtaaaattcaatatggatattattaatgcaacagaatattaaaatatacattttggctgagaccttaaggggcattgagataaatcacaaaaataaatttttcccttacagaaatgttcaagtagataacaaaaatctgcttagggaactcttacacccttcactccaatatggaaacaaaatgttaacaaaaagttagggatggatgttggagattatgacatggtttctttggagcatgcttctgggattatatgagtcccactgtcatcccaaatcctgagagacagcttttaaaagggacccttcagagcactttatatgtgttccccgcagttttattttcttttttggaggttggtgcaccgtatacagtgtcccactctgcttgatatatcgaaaaggtgtgagttgtctgttgctaaaagatgagctaaaagagatgcaactgtacagcaactagcctatattcctagaatttgtcaggggaaaggaaatgtaagattttcctgtggaccaattaagggacccatatttaaataagtaatgtgaagtcaccttaagctctgttcaatatggtcccttggaaaggcaaatgtgttgcagcagagaaaagctaagttactcaatagcttcctaggagtttcctagagagcaagctatgaccaaagattcaaaagcaccatagggaagagttcccaagtgatgggaagtatttttgaagaatgcttggaggtacccattagataaacgttagtctaaacaaaagtatgtctcctaaagaggaatattatagctgtacaaaattatatttagccatgaaagtgaaaatactcttcaagaggtaataatatttatcaatttaaaattcattatattgctgaacaatgtattacattgcaaaataaaactggttgataagaggagggaggtagtcagtcagcaggttccctttgcagggcctggtggtcacgagatctgatctccaaaggcttccattcaggaaaggggccggggggtggggtggagtttaaaaggaatccattccctcttgtgtccattgagtaaaattctataagagctcagacaatggagagaagataaccattgattaatgtagctccaggggacttgggtggtcattggccttttaatatttgaagaacaataaatgtctccttaccgataaagaatggtaaaattaaggtatagacgatgcaaacataaacctggtgataaaaccagttttgtcagaaaagagagtttgtatgaggagagaagtgaaagttattgttgaaatgataaacagtagttgtattatgattaacagtctcttccaaattgaattatgtaatttctttgcttaaacctcttaacaacaggttccctgtttatacaacaacatttaaattcctaaccccacaggcctttctcactatctctacagctacttataacatttcatgagacattatgctgcatcttacatatgctcggttctctcatgaccgtgactatccgtgtgctatcccttctccctagaataaagacagttcaaatgtgaagaaaataaaaaaataaaatattgaaaataaaaaattattaaaaaattaaaattataaaataatttaaaaaataaaatattgcatattaagtaacattttagtattaagtaacattttagtctaagaattcctgtggccttaagtcatcttacatcttttggtgtatatattttctgaactacagtttaagttgtctaaagtgaataccatacattacacacatatacacacacacaaacacacactcgaaaaatagtatatataaaaggacattataagagctctcaaaatacatcaaatcttgcccagatacctaaaaatggtactttctttaatgacattttaagctaatttttcacataaatagagggtaaatttggcaggatagaagtgagaaactgtttcagacacatgagatattgtagaaaaacatgcaaatgaggaaagcagggcaggatgaaaagggcaatgggcttagctgaagtgaaagaagcagatgaggcagtggggtaagaaaaggtaattggtgtgtgatagggcagtttgagtgaatatttaactaacacaccagtaacttccttgagttagtgacactttatttctcatgacacctcatttcagaaatagtggtacttgaacattaagcacattgctagtcctttaggaaaaaggagcatacagcgaactgtaattttactaaaacagagtcagtcttgtaacaaaatagccaatgtaggtatgcctttaataaaaatctgacagtaaggtaatcatggtataaagtatttaaaatgagtataaagaatatcattacatagtagttactagaatcttattaaaaagcaataaagaaaatacaaaggcaaggagaatattatggaattcaatccaactaatttcaaccaaagattgtatcatctaaacatacccaaaatatggagatttttaactggttaaatttaaaattcacagaagaattatgtgagacagaataagggtaaaatcagtttctcaaacagcaggactgtactttaaggaaatttccattaaccataattatgagaattttccattaaccttgacaccacttgctttttttaaaaaaggaaactgaataagaggtactttccattacaagttagattcatctaccagctaacccagatcaaaattgtacacgtcaatttatattattaaaaagtctatttgagtttcactttgtccactctaccaaaatgattaactaattaacaggtgtgaaatcacagcctgaaatgggaaagtggtgaagatgtaattatattggaaaattgattagtctgcttcatggttaaaaatattactttggctataattaaaagatttttacttaatattcgaaatacatgcattaaattgtgtttgaaagcatcttaatctatattttttacttaacagactaagtctggcaaacatggtatgattgcgaacagagactgatttaaaactttaaggatagacagtggtgtattcattagattctaacttgcaagatttagcttcaatattgaatgtgtacacacgagtgtgcaagcacacatacaggttcttttgttgatgaagaaatgagggttacgtcatagaagagcttgctaaatagtcttgaagtgaacacttggatgaaatgtcccataggagtactatatgtgaactgtagccatttaataaactaattctttataattggaggatgagttgattttatgaatttcaataaaatacgtctaagttataagaacctagctaggtgataaactattagtatacagaagtcatctcagttttcagcatgttaaaagtctcccagataaaaagcttacattgaatttatttaaacaattataactcctagttaatgtatattatcaggaaaacaatactatgcaataaatagaaaataatcatatacaaaattggaagctagaactatagcagcaaaaataatgcactggactattgttaatttattgtttcatagactttcatgatgaggtaatagataaactcttaataataaataagtaaatcagttttatttaatctttttaaaaaatccagatctttatttctaacaaggtttccaaaatgagtttcaaaaataaattgtgatgttttgtattgtaatccatagagaattacccaggctctaaaatattattacatgacatgtttgtgaaattttcaactttaaatattatctttagcatttacagtcctgacaatgttattcctcagttctcatctcgttgataggtgctggcaatttgtgcaatttgtgcaaacgcaggagcaacttcctctcaattaagataatgtggattgaaacaagtttcttggaatccacatgggagaacagacaacctacatggtaaaaagtctgcaaaccttattatgaaaagaaaaacagaactatttagaaaggaaaaagaaaaggcttatggataggacatgagagctgtctccaagtaactgaagagctgtcatgtggaattgtggttcaaattagaatactataattattcattcatctaacaagtatgtattgcgtcctttctatctgccagacattgttcttggcactgggcatgctgtagtgagcaagaaagacaatatctctctacttacagagcttacttcaagtggctaaaacagaaatagatgtccaagagcatggcaatttcatatggtgataagtgcagtgaagaaaaaaacaaccaatgtaatgtgggatggagagcctgggttttgaatggttaacaagagcttctctgaggaggtaacttttgatctgagaactgattaagaaaaaagagccagtcatataaatatctgagagaagagcattccaggcagatcaaacaccaagcaaaatggtcctaagacagggaggaagttgccatgttggagaactagaaagggggccagtgtggctggcaaaaaattggcttctgatgacagcagattcacagaagctgttaaatcaaaatgctctcttgtattctctctgaaattgcacatagaaatataaaatttctgtgcaacttttatttctcaatagaaagacaagcataggtgccactctatacgaagcagtgggtagaaagtcctcagtgtaaatgctcaggctgaactctaagtctctgaagacatgagtgcagtcaaactgccttcattttagacataaagtaatatggtccagagaggatacattatgtaaaagcatgatatagtggaaattgcagggatttgtatcaaatagaccttggttcaaatcctgacgtggtggatttcagtgttttgatgggaggggccatttccatgctgttacaacctgatctggtcttgtgatgtgccctaaagaatggaacacaatgaaaattatattgtgcaacttccgagccttggcatcaagaggatttgcaacttctcctcctgccttttttgtagcactgacaacttgtgaacaagtccagtgtagtctctttgaagataagaccatacggagatacaggcctaatcacgtcagctgaggacccaggcatgtgaatgaaatcatccaggaccggccatcagccagccaccaaacagtctgtcaactgattgcaaatccatgagtgagaagaactaatatcatgtgaagcaaaggcaagtcaacccagctgagccttggccatactgccaaactgtcgaaacaagagcagaaaacgtgttgctgcttttggtaaggttgtctgatatgcagcaataggtacgtgatgctgaaataggttatgtttgctagcataacaaaatataaaacatgtggccctggctttggcattgtgaggcaggcagagccttgaaaaaccaagagtaagatcttagtaaaggctggaagaatggtgaacaaactgttgtagaggtttaaaatatggtatgaaaattgttattggagggttggaaaagtggcctgtattatgtggtgacagaacaattggcaagaatgtcagcagtgataatttggaaaacagaaagtgaacataatacatctctagaaagaacactgaacgtgttcagttgagtgtttctacccaagtgtgataaggtactaaaagagagaaaagagctaaataaggctatatttaaatttgccatgcaaaacagacagaatccaagggacctaggacacactgggtcagaaaataaactattctttatatttgttctctcctagatggaaaaaaggttctcaaaataaagtaccttaaagatcatctcaagaatattgcagtaagacagtttgttaagactttagaaagacctaaggcaggtcctagtagattctctcagggcttctaacattcctaaagacattgtaccacaacagcaaggcatatccaaaaataaaagaaatctgtttaaaaagaattatggatgtgactttgggcatcaatttagtccttaatagattcaaaattatgttaacagagttttatgatgatatcaccatgagttaggattaaaagaaacaattcaaaacaaagagaggaatagggtgctataactttatttgggcaggaacaggctgacaaaactactcagctgtcaacaggggccatcattagccatttacaaaacaaacaaacaaacaacaacaaaaaaaaaaaaactcagaggagaaaaccagtagcccagagataatcagtagcccagaaggcagagccaacagtagataggaaaaatgtattaggacatccttaccaaggagcataaatggaccctgattctccatccctggagcaagaggccctgaaaatatgtgccaaactgaatttcaaaattgctatggacaagtgattgctatgtgccttccatttctccagtttctaaaggagattttatctactgtggttctcttgactgtatcgttttgtgttgggtatatggaagatagaaaacatgtctttctatatcacagaatcctcagtaaaaagaaactaaaaccaaataatctcataggcatttggacttgatgaagatcataagataatgaaccttgagcctaatgccatgattagatgatattttgggtgtcttggaaaggagtggatgcagtttacatttgggagggatgtgaattgctctaatcagagggcaagttaggactgtttgcaaagatggctgcaataatccttccctacttctatgcatgtccctttgtaatgtggttttgcacttctttttatcaataagtggatggtatttacctacttcatgaacatacattgactttgtaacatgctttgaataaaatacggaagtaacactgtgtagactttggagtctttgtgtcaagagatctttcagcttccactcttgtcctcctagaacactactagccttgtgaagtagccttatcaaacctaaaccagccaccttgataagacattgtgaggcaagagagattatgaagagatagagagaaaagctcagccatctccgcaattatagcaatcccacatgattgctatatgccccacatgaggctccagacacattagtggaacatcttgatccccagggatccaaacaaccaactgtaaatgcatgattgaggccagctgacaccctgtgaagtaggagaactgatcatgcgtgctgagcccaaattgccaacccacatgactatagtcaaatagataactgttgtcttaagtcctggacaatttatttaactttctcagactattatttcatctgaaaacaatactatctatcttataaacagattgtgaggattaaatgaaataatttacaaaaacatttagtctatacatcctaagcactgaatatagggtatctaataatgtgaataatgataacaactataacaatgacctataatattacacatgtccaagacagtgatttagaagcagctttggattaagaccagggcctcccaggccaaagtacctttccccacactacactgcttctccatatttgttagatttttttctaacgtatttatttacttgtggaaaacaacaacaacaacattttattttaaataattcatttatattaatattactcttatttattccatgatgtatcagagggcagaactatatataaaacatggatgaaatttatgagaagggtgatatggggtcaataaaaggaacatatttctaaaacagatctttctacagtcatacaggttatattgccttaaagatgtagtatattccttgtcactaaaagcattcaagaacaggttacatttcttctctcaggactaccaatacatgcagttagaagttaggccagccgatttttacgtatcttcttaatattgtgtgatacttgccctgttttctcaaaaattctctgcattttaaaggcttatacaacaatctaagtcttaaaccacaatctatacattcagaaatttcactgacattttcatttttagacacgtatagatgcactatagaaaagcaacatagaatatgaaaattttttaattggccttttctccttcgattgagatcaatactcaaaacattcaattcttttatgtgttaactgtctgttcatatactgggaaaaaaataaactcgatatgctcttgccaaaaaaatctatgtattcatttatccagcgaatatttatgaaacatttatcaagcctctcctatacattaagctttgtgctatggggtataaggttgtgttttacagaaacagctacataaatactttgatgccaaaaaaagaggcttaaatattttcagtctttacttcttagcattttataagagagacctattacatggatacttatttacctaatttgatacttattaaaacaaaatctattcatttgagatattttcataattaaagttaatcacaagttaatctatgtatagaaagggcttacaagtgaagtgaactgttgcttgggtttagatttgatttaggatagaaataaatacttcttagtttatttatctgtgcagtaataaagctatgcaacttgcagtttcatgttacagatttgcagtatataatatgtagctctccaagagaacaaaatttatggacaaaattaatgaaaacaaaatgtttttatctacttcctatcaatataatgtgaacacaggtcaaggggttattttatgtgaagtccaaaccatttctaatattccctcttaaacagatcacttctctgttttgtcatgataatttagctttaatcaagcttgacagatcgatttctctcccacctttcaaaatttaaacttggagccgatatacatttgtatagaaaaatgatttcataactatattttaaatatgactttactatctttataaaacataaatagaatctcaagaaaagcaaccttgttattttgaaacattcttggaaagacagatttgaagaggaagaatatagttaataaaagccatttttgatgttatttaacacaaaagcaaacagatcttttcatatttgacattaaaaatatgatcatttgcctttctaaagaaagcacatacagcttttatatagactgcacagtaaagaataataatatttctgtttactgagatatcaactggcatttcactgtaagtcaatggtctatcggtgctacagcatattagacctcaatctggcatctacaaatgtcaagagtataaaatatatatatatatacaggatgaaaatcaaaagcatgttccaaactcccaaaaaaataaaaaaagggaaacaaagttcacgcaaacatatttgctgcagaaatcagtgcaatattcagctgtcaatccagaaaaacaacgagggagccacactgtcagtaggacaggataataaaatttctagcagatgttcagtcagggctctaattttcaccgaactcccttggtaagcatttaatttctttatcatatgcaagcttggcaaattgtacttcatcaaaattgtattgtgaaatattaatatttcatatgataacaaaaccccatagaataacctttgtcatattaagagcatccaaatttcaaatgtcaagattctgaattttaattcattttaaatagattcttcaattgccataataaattataataaggctaatctaaattggtatactataatgtcaccgaaatgtatagtacatgtaatattttaatagacgtctttagtaaaaggctgtggggaaataagtatgttcatactactgagttgtatactaccaacatttcatcaataggaaagcatagaaataagaaataagcacatacgatgtaattatatattcacaaatttaatcactaattaggaaccagataaggaaacaaaaaaagtagacctctatgaggcaaacggactactctgcaaaatcacgtatggaaaataatcttttttgaaaatggcattacataagcccaaggtggcttcattatttttgtcattgcaatttgcagaaatatgtttaaaatagtctgcacaatattttgttgtacccaccatcaaagtaagtaaaatagggtttccaaaaaaccccgcatggttacatttcatgtgccaaatttaatttccatttgttcataactccccttttgaaccagcatcacacacttctaaattgatagattaaattcaaattggaggtttagaaggaagttagcttccacatttatttctgctggtgatcctaataaaggcaagtgctcctaggttactgaaagacacagcatcacaaatcaatgcatgtcaccaacagtgtaaagactgatgtctctgattaatcagaattcaattattgcaagcgaagaaaacatcaaattcaaagcagcaaacacctctttttttcagctataattcttcacctgtgcccaattagccacctatttcggtttacatatatgttttttaatagcataactaatatagtcagtatatgctatctgagactcagttttctccaatagattaaacatttgattacagcttctcagtaattcttaacgaatcaattgaaacaaagacaaatatactatcaatattctacaaggttataaacaattgattcatggtattctaaagctgaatctagtatattctgttacgcttcacactttgtttaataaaatattcagttgatctatttgaaaaaataacttctctttaaatataaaaaatctttacgaaggatttttttcctgcactgtttttttttctgacttttgagaattctctagattttcctgaccacacttacacattgcatcttgtaaagctgtcagagtaagacagccttaatgttttagccataataatgccagctattgatcctagtaagaggaaaaagagagaatgtgcttaatggggcatgtttgttctctattattttctttgcctaaggataaagctgattcaaataatgatactcttttcttagtcactaaattcacacattcatatacattaattattactaactaccagttagtattaaatacattgagaggtttagcatttgtaatttatcaataaatggtctaaaaatgttaaagtctgttgttcttttctaattcaaaaccatataaggatgcaatcctcttgtataaagcatcttactttgaaaacatgcatttatatgctttgtgtactttaaagactcaatctcaactttaatacgtagtttatttcctactaagtataagatgtccacttctggttaagtacaaagtcataatgttaaatgaaactcagggtatttgtttttgagaaaggtttctgtattccaaatttataaagaatctatcttatcaccaataccaataagttacactgagattcttttcaacataaattgaattccagaattttgtgcaaaccaaatcaattgtgtccctatctttgagctgaggcatccaaaaataatgaaacaattaataatacaaaaataagagtttgagattattaaatgaaaaagtcactttcataatatttatatctttgttgcttcctagacaatactaaatgagcaatatatgcctgccccttcttccatgggacagaaaggaaggaaagaaactaaagattaatgtgtaatgataggtcttgtcaaatagtttaataagtagtatttcttagtaaaaaaaatccattataatgtttataccttaattaaaatatatgatagacatttctatatgacttcaataatattttcttaccttatcaagagagaaagttttggtgagggcaaaaccccatccagcttcaaaagctcttcgaatcattgatgtgctggtggctggagttgcgctagcaagaccaaaaggatttataaacttcaatccggccatttctacactaatgtccaccagatcaataggagtgtaaaagaggggtagttcaggcttggcagaaacggaagctccatattgtgactgcaaaatacaaaccaatacttggtttcatattacatctaaattgtccatataatattttaccaaaaaaatcacttcaacacagcatccgaattaatatagattacaacagtctgtttacaatgaaaaaaactggcaaaaagtcagtgagcagtgaactgaattcatataatatggccttttaatttcaaaggcagtatgaagagtactagcagaaataaaatcaattaaatcaacaaacaactgtatttaaaacatactgagattcaaatacaaaagggaataattttagaatttttctccctggtccaatccagtctctttgtacttaagttatgaaaatacctttagtgctcagagatatgggcaacggcaagtcaggaggcctaaattcaatttccagtaatttcactactgtttaggcgattttaggaaagggaactaataagtccctgtcttttcttctctatagttttcagtatagcagcaggaatgctgcttgcctaatttctacctcacaggaagactggaaaattcaggaaatcataagctgcagggagacatttaatttggaaagtgggtagtgttctcatgcattacgggggtttgttcttttttctgaaaccaaataggtcccaaatagtttacgtcaaaatcttcgactggcactcaaaactgtaaatttacctttgttaaatgatcatggtaataatgcttctttgcaggattattggaatgatttaataaaaacacttactcttagcacatggcacactgaaacatcatacataggtgcttgctaaatgttgtctctttttctgactggggaggttattaaagattgcatcaggccttttgtttgtaaagtgtctctctcactccattcctccctccccttctctctctctatctccaaaagacaaataacattggaaaatataaaaaggatgaattttctcagccaaagcagttactgaatggacagggctagttaattcaaaagtagaaatccattctcttgtgaatcatcactcaaaagaaaagttatttgagcagaactttaattttataggagtgtgtcttgtgtagataaagatttccatgacttgcatagaaattatttctggccctccaccacttacaatgcaaagcaaagttcacttaatatgtaaaaaggcatcaaacttgtcaattgaaacactaatgtgtctctggtacatgcaaagagatgcctgatgggatccaggcttcagctatggcaggcaccttctcccagggatgttctgggcttcaaggcacatttctgaatattggttagtctgggtgtgaacataatttttctgtcctcacacaggattgctatactattaaaaggattattagcaaatacaaaagctacaatgtaaaatataggaaattggaggttaatttgaggtgtgtgtatgtatatctgtccacgcatggatgttaacaatgacaaaaactggcaaaaagtcagttagcagtaaaccgaatatatacgatatcatcctttttaaatttcaaaggaagtatggaaagtattatcaattaaataaacaaacaaacaactttatttaaaacatactgaaattcaaacacaaaagggaataatttcagaatttttctcctggtcccactaaccagcctctttgtacttaatttatgaaaccttgcttgatggtattttcttagctttgtgtaatcataatgtaaattcaatcaagcaagttttagggttagactaaagaagaatttcctgacactacaggttgattaatatcagtaaaagtatagaagcaacttctctgtcttagaaacaatgttgagccaacttgcctttgatggcaatagcataactacatatggtcccatgtgtctgtactttacaaggtgaaataagtgaacttacaagtattcttctctttttatggctgtgtgttgaaatatctatttttttcaatcttacagatgaattttggtttgttcataattgtagctatatatggcattaggcaacagcccaaggaggcagatatatgtgtagttcaacttgcattgcttaatttatgtagttttaaataaataagtaattgctttgaaattcttacgaacattgctgccttaatacttagaaagaaaatgatttggacacattttgcaagattttccttaagcttcaaaacaaaacaaaaaccaaacacaacaaagcaaacaataataaaatacacacacacacacacagacacaattctttcaaatgagaaatacagcttcttatatattttttcttttattcacaaaagtgctactatgtatatgtgtttataatataatctaaaatcttcacttgtcataggcagtcttttttcatactgtgcaacacagggctatttttagctttgtctttgtcgtgctatagcaactcagtctgttcagcttcatcatatatccaagccctaatgtacacctccttttctgaattttaaaagcctgttccccctctgtacccttgctcagagaactcaagcatatctactttcagctcccatcacaaggttaattcctcccaaacctcaattgcaatctccaaactcagatttccaagagacatcaaggcctttggatgtagatgctttgctcttacactttaacctcaactcttttatctcatcatattccctcctaacaaatatgttatttagattttcaatttcagaaaatactatttttccattcatccagtagtgttagtaaataacagatataaggaaacaacctaggtgttgaacaatggggataggttccataatggctatattgtaaaaaggaatgctatgctagtatcagaaatgatacagaagaaaataatttattgacatgaaagagggtttattatgtacaaagtaaaactgtgagttaatattataatattatatgtaaattccaagtttttggtggaaaaacacatatatctattttgctgtacgtttctgtttatccatcaatcacaaaagataaacatcaacatgctaggagaattacatctcagaatcagggttttagatgacctttaatttttaaatttttgcttattataattttcatattttcaataataaatacaagttaattgagatagatttgaaggtaaactaaaacaatttttaaaagccatgtgtgttagttcatttttacactgctgttaaagacatgctcaaaactgggcaatttacaaaggaaagaggtttaactggacttacagttccacctggctggggaagcctcacaatcatggtgggaggcaaggaggagcaagtcacatcttacatggatgacagcaggcaaagagggagagcttatgcagtggaactcctctttttaaaaccattagatcttgtgagacttattcactatcaggagaacagcacaggaaagacctggccccatgattcaatttcctcccaacgggtccctcccacaacacatgggaatacaagatgagatttgagtggggacacagtcaaaccatatcatcctgatactctaaaacccattaagtgaagctcaaagtaaagagcctgccctttagtttcctccatagagtgtcctgaatcaactttttcagttctatgtattattatgtagagctagaacaatcaaagagactatctactttaaaagctttattttacaaagagaaaacaaaagccaaaggaggctaaatgaatatctgtaagttgctcagttactggtaaagccacaataaaatatatagtttgctgtcttgttggcttatgttcttaagccacccctcagaaataaaatgtttcaatcattgcttctccaaaatactttgtgcctccctacctctgcacttttcacattccatctttcttctccatctgctgaaaattacccattctaaagtccttcccttgtcattacagagaaattattttatctgagacacttatagatcataaaaaatataattattttaattaattacattgaaaatatttggttatatgtttaagtattaaaatgcattaacttccccatatttttcaggaaaccaacttaaaatttctttgcatggcatagtctgatttttttataacatagtgccaatatacctgttagactcagttattaatgttcatatagaactattttcattcatttacttattcagcaggtatttgttaagaacttggggttaaaaagatgaacaaaacagacaaggtctctgacatttatatgcaaaaaaatacaaataaatctaccacctaccaccaaataaacacaaaatttaaactaccaatagttcatcacactgttacatgtattttacctgcctaaaatacaaataaatctaagactttactcatgcgttaaactcttcataatccttccaaactcaactgattcattcaagcatatacttcttgggacatttccttactaccacctatacacttttctgaagtagttacctcttttttatttactattccacaattttactttagtattattctttgagttctgggatacatgtgcacaatgtgcaggtttgttacataggatgctatggtggtttgctacacctatcaaccagtcatctacattaggtatttctcctaatgctatccctcccctaaccccccactccccaacaggccccaatgtgtgatgttcccctccctgtgtccatgtgttctcattgttcaactaccacatataagtgataatatgtggtgtttggttctctgttcctgtgttagtttgctgagaatggtggtttccagcttcatccatgtccctgcaaagcacatgaactaatcccttttggaggctgcgtagtattccatggtatatatgagccacattttctttatctagtctatctctgatgggcatttgggttggtttcaagtctttgcaattgtgaatagtgcttcaataaacatgtgtgtgcatatctctttatagtagaatgatttataatcctttgggtatatacttagtaatgggattgctgggtcaaatggtatttctggttctagatccttgaggaatcaccacactgtcttccacaatggttgaactaatttacactcccaccaacagtgtaaaagtgttcttatttctccatatcctctccagcatgtgttgtttcctgacttttaagttatcgccatgctaactggcgtgagatggtatctcattgtggttttgatttgcatttctctaatgaccagtgatgatgacctttttttcacatgtttgttggctgcacaaatgtcttcaaacagagagccaagtcatgagtgaactcctattcacaattgctacaaagagaataaaataccaagaaatacaacttacaaggaatgtgaaggacttcttcaaggagaactacaaaccactgctcaaggaaataagagaggacacaaacaaatggaaaaacatttccacggataggaagaatcaatatcatgaaaatggccatactgcctaaagtaatttacagattcaatgctatcccaatcaagctaccagtgactttcttcagagaattagaaaaaagtactttaaatttcatatggaaccaaaaaagagcctgtataaccaacacaatcctaagcaaaaagaacaaagctggaggcatcactctatctaacttcaaactatactacaaggctacagtaaccaaaacagcatggtactggtaccaaaacagagacatagaccaatggaacagaacagaaccctcagaaataatatcacacatctacaaatatctgatctttgacaaacctgacaaaaacaagaaatggggaaaggattccctatttaataaatggtgttggtaaaactggctagccatatgccgaaaactgaaactggaccccttccttacaccttatacaaaaaataactcaagatggattaaagacttaaatgtaagacctaaaaccataaaaaccctagaagaaaacctagtcaaatacctcaggacataggcatgggcagacttcatgactaaaacaccaagagcaatggcaacaaaagccaaaattgacaaatgggatctaactaaactaaagagcttctgcacatcaaaagaaactatcatcagagtgaacaggcaacctacagaacaggagaagatttctgtagtctatccatctgacaaagggctaatatccagaatctacaaagaacttaaacaaacttacaagaaaacaaacaaacaaccccatcaaaaagtagatgaagggtatgaacagacacttctcaaaagaagatatttatgtggctattccacagtttaaaatatgctgctactcagctgtcatcatagtcggctgtacatgttaattttctcttcaaaaacaagctccttgaggacagtgaccaaacatatcttaaccaaattattatctccattgcaattaaaaatatgcatgtatgtcgggcgtggtggctcacacctgtaatcccagcactttgggaggctgaggtgcgtggatcatgaggtcagtagatcgagaccatcctggctatggtgaaaccccgtctctactaaaaatacaaaaaattagctgggcatagtggcgggcacctgtagtcccagctacttgggaggctgaggcaggagaatggcgtgaacccggaaggtggatcttgcattgtgccaagatcacgccactgctctccagcctgggcaacaagtgagactctgtctcaaaaaaaaaaaaaaatccatctatataaaatacttattcttgaaggcaattctttcctctgtagagatataaataaaatcaccttttcacatggcattcctcaagtatattttgcagaactaacatatacttcctacatctcctttttttctctaggctaaacatttttatctttaataattatttttaatacaaaatgcttttagtattctagttatcctttgtcagatatctcatttacctatatgctatgaaattgaggaatccgctaacatagttgaaaaggttaaaaatgagaactcgaatttttgccatttccctccctcccttcccattgtaaagcaagaatcattttataacctggacatcaccatgacctctttgattgttcaaaatacactcaatgaaaactaaagaaaactacaaaaggaaaagaagctgaagtcctaaagaactgagatgagaatggtaaaaatggagattaaggaaaagctaaatgtccaagttttagagtgtaaagataaagagcaacctttcctttttagaagtccttcctagacataagaaaaattgaaaataacaaggatgtttaaagactatttttttaaagtttgctttcttcacccttagaatttttggggggagactgagtaaaggttttattcacttacaataaaatttctaaaaattaactccatgacaagtatagaccatcaggagccccaaatatatatgcattacacttaatttttttcatttcattgtcatctgcaagttccttcaagcttctttactacatacagaataaagcagaacctcagcattatataatcccaattgtgatctgggcccttctccctccccgccctttctaatctcatctcctatccctccttcaaaatattttttgcttccacttattgaactagttataatttctcaaataaaacaatatcattaatgcatctttgcattttgcctttcgttttttgtttttgcttagaatgttctttcctgccggtgttaatgctttgaaaattccaactaagccttcaaaagtcagtcctgttgtcctctccactaaaaatcctccttatgtgtaaaaaagggagacagagggggaaatgataaactatcatttaatgcgtatagtgttttagttttgcaaggtaaaaaagttctggagaaacatgatgtatgtgcttaatgccactggaactgtacacttaaagatgtctaagatggtaaattttatattatgtatgttttatcacaatttaaccatgaataattattttaaactaaaaaaaaaaagtctagtaagcctcttgacagaagataccgcaaaggtgtcatgaaggccaagggttgaagttttaaaacctaaactgtgtaacaggctctgtaacggggagaaacccaagaaacttatggtcaagttgaaactcacaaactgcaggaatatagtcattggggtcccttagatgcagaaaagaaaattaactacagcgagttatgtttgtatttcacataagaaagaattttgaaatagagttgtccattaggggtagggtctgtcctgggagatgtgagctcatttccattggatatgactcagattatctattagtcatgccatgggtgtgaagttggagctagataaactttaggatattttccaagccctaattccatgactttgtgattattatcgccataaactctgaagtcttggctgggcacattttccacaaggggcttgtggtaaagtgtagaacaacgaactcagaaaaggcctattcaaaaatcagaactagtcatggtctaagatatattcccacaaagttctgaggccaagataacttaccgatatataacccaagaatatttctggatgtttcagttactgagcatccaggaagcctcacctctggacattgtgtgctaatcatctcttctttctttctttttttgaaaacagtctgtatccatcatcaaacacccctaggatgttatccttcttgatggacacattacagtttattcaggatataatttacacccccaaatttctatccctaactcagacctctcctctgattagattgttgcaatcagttggatatttctgatttgtattttaaacttattacacttgaatatttattaggcattttaaactgaaaacccctgacgcaaattttctgccatcaaacctgcttcttctacagccttgcccatttcaatgaatggcaactgtatccttccaatacctttggccaaaaaccttacaatcatttgtgccttttcttttacaccttacagccagtctgtcagaaaaatctattgtccctttttccaaatatattacgtttctcatctccactactacctcctggtctaagcatggttatctctcactgaatttaccacaataacctcttaactcatccctttgcttcatgtctcagtctttcgcagcacaggaatcacagtaggctgatgattcctactcaacatttatggtgagtgattgtggtgatggttgcatgactccatacatcagtcaaaactcatcaaatggtataatggaaattggcaaatgttattatatacaaattatattgcagtatagctgatgaaaacagaaaagaaagaaagaaaaaaaaacctcctcagcttcccacaagcaaagctgcttcctaatcgtactctgtacttatttgcttacatatatgctatctcccgcttgatttaatttcagcacctagcataagacttggcagagagatactcaacatatttactgaatgtattagactagtgaccttgggtacttagtgtctttttcaaattagtttccagtaaggtgataatcagtttagatgaaataatcattagctttattccaaatctataaaagcccattattctatgattctaacatagagtggcattgaagctctggaagattgctgattttaggccagtctctccaagagccatctagtgggaagagtaagtaattgccctgggtaattagagagagagagagagagagagagagagagagtgtgtgtgtgttttaggccagtctctccaagagcatctagtgggaagagtaagtaattgccctgggtaattaagagtgtgcgtgtgtgtgtgtgtgcgcgcgcgcgtgtgtgtgtgtgtgtgttttaggccagtctctccaagagctatctagtgggaagagtaagtaattgccctgggtaattaagagtgtgtgtgtgtgtgtgtgtgtgtgtgtgtgtgtgtgtttctataattcagtcacattaaatgacacaaagattcaccaacatcacacttttgccaaggtcttgcctaaaatagagcatttttctccctactggaattctgacttccaatttagaatgaactcctttggtgggaagtaatgaattggcctcagatacttatcatgagttacaggaagatctcatgaaactcatgcagaaatgcagccaggcctccaggaagagctgggaattctcgaggaaagtaagaagatttttcgtgctttgtcctctttctttctatgtacagctactttattcttctccctcttccaattggctttctctacttctttatccagaatgattaatattgtgtaggtctagaccagtaattttttactctacttaccagaaacacgtagagagttttaaaaattatgatgtccaggccaggtaccttcctactaattatatcagaatcccttggagggggactcaaataatagtatttttaaaaatattttaaaaatccctccaagaaattacacagagcattcaaggatgaggtcacttctccagtaacatgagttcttttcctagttcctaattatcaagtaagagattcaggcttggccaatattgtgttaggtgtctattttattcaactacgtggctactgggggtctgttcaagagaacagaccgtttaagttcggaagatagtctaaaaggtgctcatgtggacctctcatctgctaataaagtgtcagctctgacaagcatcaacacattgtccaaatgttaaggtctactgtaaaaataggacagttaaaatgtttttctattttattcttaaaatcaacaagacagttgtccatttgcaagtaatatttataccagatccagtgataagtattttttaatcacgatttttaaggtatgcattattctcctattgaagatgaggaaagtgaggcccaaagaaagtaaactgcttgtccaaagattaataagtggtagagcaagacctgaattgaaagtttacacaaactacattatatcaaactgcccccaaccttttttttttttctttttttttgagacggtgtgttgctctgtcgcccaggctggagtgcagtggcgtgatctcggctcactgcaagatctacctcccgggttcacgccattttcctgtctcagcctctcgagtagctgggaccacaggcgcctgccaccacgcccagctaatttttgtattttttgtagagacagggtttcaccatgttggccaggatggtcttgatttcctgacctcgtgatctgcctgccttggcctcccaaagtgctgggattacaggcgtgagccaccatgcccagctgctgcccccatcttacataaacatgaattttctaaattattaatgtcctcaaaacaagaaactaacctaaaaagttattcatgatggtttgattgaacacacagagtacatatacacacacattgaaaaatcttatcaaaaataaaaaccataccctattcaaatatcattaagacaatcataatgccattaaagaatagaaataaaaatacagtcaaactataataacccattattttattattaaattattactctttaccactggtttcctctgttatacctcgtggggtcatggaattatagcagagacatttggatgtgtaatgattatgttgttgggaaaaagtaactcacatggtaagtatacatcccagtggcattttctcctgatttgctttgctagaatgaaatttggaaaaaaaaaaaaaaaaaaaggaagagaaaagcactactaaaagcaatactagtggtagtgtttgttatatttgattgaagaagaaatcaccatcactatgttccatgcaattcaaaataatcaaacagctttcacttagtcattttgtttatatttcattgtgatatgctacaacgggccctatcttggagtacagctgctatagaaacatccattctgaaattattttaaggaaaagaataaataacattgcatagctgcttgtggctagattaattcacagactggattaatgcattaataattaactcaagatcagttccttcgctctttgaagaaatatctattgagggaaaaatcttacagggtaaaaattaatttggattagctgtttccatgatggaaaggcctagctccagtgattacaattataatataaaaacagatttcattctccattttgagaaattattattcataataaaatttccttctgatataaaatcttttctgatttgaggcttcagaagtttctacaaaataatgattccattttacgcatttctttaaaagactgtgttcacattcttctatacttgtaatctgagcataaaataagactagaaaattaaataatattaattggctccatggcataatggtcagcatatctggactctgaaaattaaatgatattaattcaaatccatgtcccatctttctccatctaaactctacctctacccccaattatcagctctttagcaacttaatgtagtaacatgcaaaaactcctcctccttcaacaaaaaataactattcctccccagttttcccccatttactttatgacactaccatccatcaagcttgttaaaacctgttaattgtattatttttgatatttcttctctctcaaatcccatttctattctacagcaaatctaattatttttgactccattctctttgccactattatctcttactgagactttttcttactgacttctgcattctccttgcctcctactcaaatctgttctttactctgtaccagagtagggtttttaaaacagaaatttgattgtgttatgcacctgcttaaacttttcattagtttttcattggattttgttaatattcaacttttcatgatagcctacaagctctttcatgatatggtcctgtctgcctatccaaacttaccttatgccaatctctataaatatacacatcatagtcacatgtgccttctaccaaactctgcctttaactggacatttacacttgctattttctctttctgatgtattctttttccatacttctatttccttgtaaactcttctcccactgccacgtaccagctctttagcaacctgaggtagtatcaccaatgagccaagtgaacttgtaaaatatgcttcctaaaccccatttgtcccatgatctaaaatatttccttagcatataaaatttatctatatctatcaagtgcattctatacggcaggcattctgtccaggtgctaggaacacaacagttaacagagtatcttttctttcttttttaaaaaaagtagtctattttatttattaatggttaaaaaacggcttcactaaacattgttttgttatttaaatattaatatgctgagagcagtattattacacacctttttttccacagccttattgaggtacaatcagtctacaataaacataattaatgtataaaagtcagtgctttggatatatgcatacactcatgttactatcactacaatccacgtcacaaacatatccatcacgttcaaaagtttacttgtgtccctttattgttgcttactttatcccttcctttttttcttttctctttctcttttcttttctttctttcctttcttttttctttcttcctttcttttctttcctttctttccttctttcccttcctttctttctttctctttcttctttctttctctttttcttttttccctttttctttctttcctttccttttctttttctctctcttctctctcccttccctcctgtcttccctttccttctttcctctttccttctttctccttcctcccttccttcttttcttttctttctctttctttccttctttacttttcttttctttccttctttctttccaatatacccagcatccctctcacccatctcctggaaaccatcattctattgtctatttctatacatttgactaccttagatgcctcatatagagggaatcatgcagtatgtgtccttctgtgatggccacttcatttggcatgtcttcccggtctatccattctttcacaaacagtacaatttctttcttttttaagtctgactaatattctcttggatgtatacatcagaatttctttttttttctttttttttttttttttttttgagacggagtctcgctctgtcacccaggctggagtgcagcggcacaatctcagctcactgcaaactctgcctcccaggttcacgccattctcctgcctcaacctcccgagcagctgggactacaggcgcccaccaccacgccaggctaattttttgtatttttagtagagacgggttttcaccatgttagccaggatggtctcgatctcctgacctcgtgatccgcccgcctcggcctcccaaagggctgggattacaggcgtgagccaccgcgcctggccattatccatttatctatcagtagacatttaggttatatcttggctattgtgaataatgttgcagtgaacatgtgggtgcagatatctctttgagataatgatttcagttattttagatatatacccagaagtgggactgttggatcatatgatagttctattttaaattttttgagaaacatctatactgttttctatagcagtttcaccattttacattgcaccaacagttgtataagggtttcaatttctccacaaacttgtcaaacttttgtttttctgataatagtcattgtatcaagtgtgaggtaatatctcaatgtggttttgattttcattttcctgatgatcagtgataagcattttttcatgtacctgttggccatttgtatggcttgtttgaaaaaatatctattcaagtcccttgctaatttttaaaattggactatttaaatattttgctattgaattttaaaagtttcttatattttttggaaattaactgctggttaattaatggtaaatatttcttcccattctaaaggctgctttattactctgttgattgtttccttagctatgcagaagttcttttagtttgttgtaatctcacttaatctccttttgcttttgttgactgcacttttggtgtcatatccatgaaattattgccaaaaccaatgtcatgaagcttttcccatatgcttccttctaaggagttttagagttgcaggtcttacattttagtctttaattaattgtgagttaatttttgtctgtggtgaaagaaaacattccaatttaattattttgcatgtacatagccacttttcccaatgtaacatttattgaagagacaatcctttccccgctatgcattcttgactttcgtattgaaagtcattgtatatgttgtatagttgactgtacatgacatggctgtaggatataagctctctattgttccaatgctctacatgtttgtttttatgccagtagcatactactctgattattgctttgtaattattttgaaatcaggaagtataatgtttctagctttattcttatttaaaattgtttttgttatttgggtattttgtggattcatacatattttaggattacattttctatttctgtaaaaatgtatttggaattttgataaggatttcattgaatctgtacattgctttaggtgaaatggatattttaacattagtttttccaatccaagaatataagatgtctttccatttagttttgtctgctttactttctggcagtattttagagtttttattttaaaagtatttcatgtccttgattcagtgtattcctaagtactttattctttctggtcttattgtaaatggatttttttcttaattttttggatagtttattgttggcatacagaaacacaactgctttttgtatgttgatttgaatcctgcaactttactgaatttgtttattagatctccagtttttgtgtgtgtgtgtgcagttttcagggttttgtatgtataagatcatgtcctctgcaaatagttaatttttcttcttgttatctgatatggatgccttttatttctttggtttggcatatggtttttgcccatcattctgttaatgcggtgttatcacatttattgatttgtgtatgttgaaccatctttgcatcctaggaataagtcttgctttatagagatttataggtcatagaatatgatctttttaatgtactgttgaatttggtttgctaatatttcattgaaagtttttgcatccatattcatcagggatattggcctgtcattttctttgtttgtggtgtctttgtctggatttggtaacagtgtgatgctggcctcataaaatgagtatggaagtatttactcttctactttttacaagcctttaggaagaaaggatattaattcttctttaaatgtacagtaaaattaacctgtgaagccacctggtcgtaggctttcctgtttgggttggttttttattactgactcaatctccttatttgttattggtcttttcaggttttctatttcttcttaattctgtctttataggttgtatgtttttaggaatttatccacttcttctaggttgtcaaatttgttcataatagtcccttatggtcttgctttttatttctctggcattagttgtaatgtctcctgtttcatttccgattttatttttgaatactctttttttttcttggttcagataacaaattgtcaattttatcttttgaaaaacaattcttaattttgttgattttgttctattgtatttttattcattttatcatttattcctgctctaatctttattatttccatccttctgctaactttgggcttagttgttttttttttttgttgttgttgttgttttgttgttattgttcatcgatgtttaaagttaggttatttatttcagatcttctttcttttgtaatgcagacatttactgctataaaacatctcttagtactgttcttgcattaagtttttttttattagtcttttggtattttgtgtttttgttttagtttgtcctgagagatactctaatcctgcccccatgattcaatcaccccccaccatgccgcacctccagcactggggattacaattcaacatgagatttggtggagacacagatctaaaccatatcactgaactacagtaatatgttggtttctttcacattctactagttataatattatctgttaatataatagcatgtagactattatagcctctactgcatacaaaccaaagagtctgttcaaagaataaaacagtaaattaacttcaagaaatgactttaagttagacagagatccccctaaaataataaataacatgttgacaaattttcaaaagtgtcaatcaaaaaggtaacaattgccatactgacaggccccggggcaaaggtggtgatactgctgacaagatgtcaatgactaaagtaataaaaacatggtgaccagctcagggtggtgcctgacagcaaatccatgtaacataaaggagtcagtatgatcaaggtgagagtgacgaaggtaaatcaaataagctgacatttaagacaggtgacagcagtgatgttaaatattaagccttggaataagaagttcaaaattgtaagtcaacaacatatcagccaatacttgctcttgtgttaacctattaacccttatatttctagaaggagaattctctgaaatagactaaggtgaggatagagtgtgaagagaaaaccagcgtagttgcccagaggtcacttcaaaatagaaataacaatatctatagggaaggatggttgtgaagatcaaatgagaaaaactacaaaccccaagcatgctcatttgtatccttctgttcccatggtaactctaccccaccatcaaacaccagatcttttagtagtctaaggtagtatctatcaccactgagccatgtgaacttataaaatccatttcctaaactcggtgtcctcataatctaaaacatttccaaaacctacccattgtttcaattgtatttattaagtgcctacatatggcaggcatttcattggccaaccaccaacaataaggtaaccactgttctagggatacaacagagaacaaaactgattaaaaatgtatttgaaggctacattctcacaggatgttgtctggtatacagtgactgttcaatatatgggaagtgatctaaaatgaaataaggtaaaattttgagtattggttataagaatcacaaaaagtccaatacttgtccccaccctggagcagagttctctgataactggtaggaacttacttatgtgttctgacttccacatgctcagctggaactcaaaaaaagagaaaagaacatcatgaggaaaaagtaagctggttattgaaaagaacagtagaaccgagaacagaaaaacttgggttctacccccagcattgccattaactagttttaacaccttaagaaaggcattacatttttttcttttattttttatggatgttattcttttctttatctctttgaggatatttaacaatttttacaacattttcagataattctattattgttgtattcttctgagtaaattatcttactatgtgaatttactcttttaaatccagttcctcagcttcctaactcatggccaactacatcttaaccaaatccagtatagttctccatttttttaaatgggaaaatggttaatccataggtaattttgcacacaatgtgaatgctaagcctctaaaaacaatcaaccataatgggtattcaataaattagatttttaattttttatatatattatttgagttttagaaccatataaaattataattctgccccttccatgaatgaaaatgatgaggttcaagataacgtattggagattttaaaagttgttaagtccttgagctgggaattctacctctatgatgacaaagttctgtctcagagacataagtgagaaaaccaaaaaggcaacatgatattcccaaaagtctgaaggcagaattactgagcaattagttcacaacttgaacccagactgcttgactttcaggatgccattataccatcctggatattttttgatctgatcctttacagcttgtttgagattcaactttactaaatcactgaattcagaagaacacaattctggtcaaaatttctaactaggttattttgtatttaaattctccacagcaaactaaagattttgggtgttttgttttattgtgctacattgccattagacccagcagaccccatgcattagagcgctgaaaatttggcatgggatgcataacacttctactctatttggaccaattgatactgcagtggttaatttccttaatactccatcaacatgaactaaggttagattccctacgtattggatcagatttttcagttagtttttatttctgccattctaatcttcaattatctctgcctgaagtagcaatctattgctatatgggtaaggaaatattctgtctttatggagacaatttcattttaaattacttttcaggtcaaacactgccatttaataaaagtttggaacctatacaaagtcaataaaaggcattaaaattacttattagtcatggtattttctttctctatcaccaactagacagttttgttttgatagctccattaggtacagcctcattgctcattttttccttgacttccttttagaacatatggatgttacaaaaaataaattctcctttacaaacaaaaaccttcacattattaggaatataattgttaatagaaaaagtgtcaagtatctgatgcataataattatttaaaaatattagctgaagaacacatcacaatttaacctgaatgtactatcaaagaggaaaattatgtggagagtactatagggtttaatgtatgtttatttataagcaactgaagaagacttcatttttctatgactgtaagcaaatttgactttactacttgccattgcgagagataaaggtgagatcacatacatttctggtactagttaagtctaaaggcccagtttcccaatgagactgacctgaagtcatctcaacagtatgatcctgacccagtggaaaaacttagcatggaaacagcatttagccatgacatacttcaatattattttttggaggctatcactatctcaaactaaacccattatgatttaaaactgtctttttattgatattcattgtttttcaacctgacagtggccaatgatttatatcaatcttctcttaacacaggaataaaagagtttgcaacatatcttaaactgaaggacactttttcagtaagtctcaagattttaatacagttgtcatttcaaaagcctacctcttctcagttggaaaggtttagagaagaagaagtcagctctgttgataagattgtttttatctgaagcagtagaggattcaaaaattagtatgacatatcgatgatgccctttcttcaggcatttttattctttaagtgcaagaacactgcagctggctgtcaatcattaaactacaaaatgaaatcctttgcctggctaggagatttgcaactatactgatgctggtaaactaaacaccaaattatagccttttctcttgcctcacccagatttcacaggggctgcacacccaaataaatgcctcttggctacccattcatctaacagctggaaagatgacacttgacatttggaaactttcctgtgaagattgctgcaaggctttcccattagcttcctggtgagactgtaaggtcgaataagctgcctcaaaacctgcaaagggtaacggaaatactctaatattaagcctgtgcaatttaaatttctaattctcgaatcatagttcttcagatattgtagaaatcactggtatatttcagggcaaaagaatgcctttgaagatgtgaaattaaagtgatattttaagcaatgataatgataacaagtgtcttttatttaaagttgggactgaaggtcttctaagtaacagggacttcaacacagagaagttcttgtaagtttgttttctaaaatccctgactgtcatattttcaacaactgttcatctttgtccagagcagaaatctttaacacgaggcagagttattaccattcttcactttttttcccacatcataagcattattgaaggtagctttaaaattcttacaacccagcattgtggattcatttcaaaaattactgcccccaacataaaataaaatagtaaatatgccattattaaaatgctgtcatcttataaaattttcaggtataaacaagccttttttcctcttcagaaagataattcctttaaaatgtccccaaatcagaaattgttaataaaatgacagtttattaaagatagcagaaagacaaaattcctcacataatctcaacccaaaaaagaatgtaaaaaatttcatttattgatatgaatgcacacaattcaattagattttatcacaatgatctttttccatgatactcaatttggaattccatatttttaattgtctttataattgtctgttcttgtttgttaactaagtatttttcaagtgaaagattaacaagaatgaaaaggcttccctaaatgttcagtcatatgtccaaattagatgaaattaatgtcatgattaaaaaggaaactgaaacctttaaaaaatatacgttgagggcattgaagaaatggaagacatgaatgatgtaactttcaatcttgaattcatcatcatctgagactaaaatcactttttaaaagttcaggaccagcctgaccaacaaaactaactgggcgtggtggcatatgcctgtaatcccagctacttgggaggctgaggccagagaatcgcttgaacccgggaggcggaggttgcagtgagccaagatcgtgccattgcactccagcctgggcaacaatagtgaaactctgtctcaaaaaaaaaaaaaaaagtcaatttagtgatgctgaattgtacctcattagcaatggatgtgcacctcttggccccaaatcacggcataaacctagttttctcatgccattccattaacgaatccaccaaaaggaagctcagctcacagaaagaagatggaatatctagcaatgactggacttctcatttctcttcaaaccaaaaccacagctaccatttgtactcactctactgcaggtctatggcatgaatttgtctccactaggtcttgaaatcacacattcatttcacatagcctattgaactgccatcagatggtaatgactttctgtcactcttgacctggggcagatttgaactagtgaccaagaggttaaaggctctgtatctcattaccaatcccctgagatacttagttccctcaaccactagtgattttttttgtgcctcagtcaagccagaagaaaatacacacagaaaaaatctaagcagtagaaaagtaggtcaccaatgcaagacatctatgatagttctcatgaacctaataaacacctatttcaaaatatacccatatactacatgtacctgagtagaatcacagtaactgttaaagaacttcattgtaactttcaatagtatttcacataagctaccattaagctgaaaaacactgcagagaaactgaagatacttgtgcttcatgagcttacagggttaaggaatgtattttagattcagtatcattccagaatatttgtgtgtgtgtcttgtgtatctattctaaaataattctgcctcacaagttagtttcagaggggggttgacaaattggaagaaataatatagattcataaatgaaataatcaaaacattatcaaacaccttaacgtggacacttactataggaatacagcatattttaataaggataaagtttgctgaagaaaacagaagaatagtatttaggaacatatatttaggcaaacatatatatatacagtagtagaaatattgaacctaagccaacaatgaaaaaattaactttttgttgttgtttttattgttgttgaaggttgacttcaaatgctggctgctaataaacaatattctataactattcaacggcaattattctgtacataactaagtaggcagtgactcctgaagtcacttagaaatatgtactcaaattttttttaaatttaatgccctgacgcctccttccttacactttgcattttcccctaaatgtttgattttcatggaatgaatcccacttggaagaaaatagatcttttccttttcatttcttgcctatatttaaaatggtgctctatacaaattattttatttgaatttctacctctacctgttgattccatatttatccttctattaataactcttattttttgtctctcaatatatatatatttctaccacaactgcttttgtagcagcaacatgtacatttagttgttcccttccactactggtaataaatactgtggctttttaaacgttgcatctaaaatatagagaattgaaaacaattcttaataaaagaataatgacacggcaaaaataactctaatgatgtaacaaaccagttagttttgtgattataatttctataaagatcaacattatttgacaaaatgttccatgtttataagagctccttctcaggactaccatgactactgaagggacaatgagcttctgatctgggattataatttagaataatttagtttgtgttctatctccaagttttttctcagtggcaggacaaaacatgatgagatatccatatagcctttttctctccactttttgcaaccaaatctgtctatatgctaatactagaacaaagtaagtgctccgccttctgaatgctgtgtgagtggataaaacaaactcagtttctccactaaaatctcacaacacgcttctgacaccaggtgtgtgcgaactgctccccaccagcaagcaagcaagcaatcaattctgtagtggacacaagctgaatgtcttctaattcagctcaattctgacactatctacctgatgatagcaccagttcctacaggttgagagctcattccccaaaactgccccctaccacttcaaatgccaataacaagccccaggttattttacctgtgcttctgaccaaccagctataaactgggattcccacaaccccttcttcgggttagattaactggttagagcagcttacagaacccggggtggggggtggggggtgggggtggcggcggggcagggaacaaaacaaaacaaaacaaaacaaaacaaaacaaaaaccaaacttttactagtttattacaaagagtattttaaaggatacaaacacaacagtcagatgaagagacacatagggcaaggtctgaaagggcccccagagcagaagcttctgtccctgtggagctggggtgtgccaccttcttggcacacggaagcgttctagtttactttcctggaagcacccccgtcacccatatttgtctattggcaagttctcagaacctagtccatttgagtttttatggaaagttcattacataggcatgattgattagatcattggccactgtcaatcaacttaaccttcagccccttgactctccccggaggttggggagcagggctgaaagtcccaatcctagtcctgcctcagtccttctggtgactagcccctatcctgtagttacctatgggctgtcagccatcagtcaactcattagcatacacacacacacacatactcatcactttggagattccaaagattttaggagttgtatgccaggaaacagggtaaagatgaaaatttcacaatatcaccatgtgtttttataaattagtaacattggatattaattcagtctctatttggtgcttttgtaatgaagaaactgaggtcctctacatgctctcttaaccaagttggttgcatctgacagatttactggactatttccttcccttgttttcctccctaagagacacaaaagatggccaagtaatgctgatgctttataaccagtggtacccctgtatacctacgaaatttctgcttttattagttgagttgtctacttatcaagagtcagctgtatgtttctcgccctgtttctgttggatataaatgtaaataaataaacattaattagttatatggatgcaaaaagaaagaaggttgattctatgaaaactaagttgaatgttcttgaaggatatgataaaaatgagttacttaaaaaatactgctgtcaaattaggtgttggtcaaaccactgaaatgactgcaggacaaacataaaaatctggaaaattgcattgtatgattctcgaaggtcttgtaccacttttaaaaatgaaaatggtagacaatatgttatagatagatttaggcaagatacataatacacatctggctattttatttaaaaacatcttggccctggatttttttaaaagaaaaaggaaaatgagaaaatatctatatgctttaaataaaattataagctttggtcatgtgctgcttatgtaataaataataaaatgatgaggttaatgtatgtgtatatcctttttacagtttcccattttaactttttctgattaaccaacaaagtattaattttggtttcataggaaaagagaaattaaggaattaaactaattaaggaattcatttagctatagtcattctttcagttacaaattctttctttaggtacactgtcaaaattatctttcgtattcagtaattcttattcatttggtagaagaaaataaatatgcctggactccactaatatcacattataaacaattaaggtgaagtcatattgaattattagtagaagtaactaaaaaagtaaatttaatattataacagaatgacacttaagaagggaatttctgacaaactggaaaacgcttttcttcacattaataccagatctgacactaccatatcatttctatacatgaacaattcctaccacattacctactccaaattgaaatcctagctaggcaatctcatcatgttctactcctggtataattactgaactttctctctctcatttttcctatataatctctatattcagagcttccatttgtccaccctatgctttttggtgaaataaaaaggagttgctgcacagtgcaaaacttatggaccaaacagagaacatctttatgaaaatttgaggaaggtactccctcctctgtatagaagcagaacaacaaaaggttttattgtttgattagtggagcttggtctggatttcagccagcttgtaccctggtctgggtacccctcatggagtgagcaacatataaaatcttatccagtagccttctttaaatcccagtaaatctaattacccagtattattctaatttttcttattctttttaaattttgtttcttgttgtttgtgatgtccttgctgattccacatcctaatacccacatccagatggaatcagtcattgtctcttccaggttacctttgtaacttgatgctttttattattgtgttaagtatgctatattgggcttacatttacacaactcacttctttactagacaataggattcttacttgcaaatttaaatctaataattggtgctatctattatatccactactttttaaaatgcatcttttgaatgaatgaattaattaatgcataaatgagattgatggatgtatgtggatgaataaattaatgactaaataaaatgcttttgcaactacctaaaatatcctatttcaatattcatctgttaagactctatacatcagatttctattcaaatttcctatttgccatctttttcctgatctcgttttaacaatacaaggtgaatgatttctaataacccacaacaatggtatacacaacaaatattcacaaagcttagtctttaccaagagctttccatactttctttcataatcttctgcaagacccaagaagatagcagctctaattattattttaagtaataataataatttataattgcttattcacttctataccctggagtgctgaagtaacctgtccaaggtaacatgattggaaagtgttggaactggatctgatgtcttctctgtagttcagagagcccaaatttataaccactatattatactgctcttatttatgcattgtggtaccctcccgaagtcaagtgtgggcccaaaggctattacttaataagtggtaattgagcaaattaactgatgaaatttaagtgaagctctcctcagagaaattgcctccactttctcccaacatggatgtcttcaaacaatcacatttatctgaaaatgcatattacaaagaatttctaaacacccaattgcatgcattaatactataatctgtttataaaatcatattttaaaataagctattcaatgttaccttttcccccaaaacaaactaatgtaaaatataagacaaaatgtcataagccttagttgtgaaacatactatagacattacagaaatttttttaacaaatgctacatttgtgagaaaacaatattatatgctaatgaacttatcatataacaaactcattagttttcttaactcctccttaaatgtatttaagataaatgatttctgcatatttttcctatgtaatagatgaatactttattttgagggtacagcaatacataaacatggttcctagcttgtgcagagacagaccagtaagcaggcttcaaacaaggagcacaaaggaagttcatgtcacaaactccctggacgaggaggagaaagccaatcctgaaggacaagtgggactcaaccagagggaaatgggtgaagtgggggaaaggcccagattcaggagaaatcttggtatgcttggggacattcaaatcagcatctcaaagctaagaagtttggcctttaccttgagtgtgagtaaaagtcattgaagggttttaaatgagctaattaggattcaactgataatctagaaagatgactctggctgcagtgtaggggcattggatttgacaggagagaaagtggaggcaatttcaagagaggtgatagaggccagaactaagttaatgacaatgtggagagagaaaaatcccactttgtctatatgtaccttgttagccttatcgctgcttagcactttgcatccaacaccctggcaggaaggtggaaatgttgattttacttgacagagatttttacctaccttccatctctactccattttaacatgtaattcaacacttagtttgacaagtctgaatccttcaaccaaatccaaaattcttacatggcacaacctttattttatatttcaaacactatcattcctagcaatatgtgtttttaaagcacatgcatgttttcttcattatagctaaaggtctgtttctctcctttctctacacatcagatttctattcaaacttcctatctgccattacatggaagtaaaataatttctttttttttccagtacacatttattagattcaggaagttacaagacaacagtgaaatgaacagaaaaaaaaaaaacattaagattcctttagaatgatattgtgaaacaccaccaaactacaatcataaatatatttaagcattgtttattcattttaatttaaaatctataaatggatttaaatatttaggataagaacaaaaaacaaaatcctccactgacctgtgttcaattttactttttcaaatctttttagcttctctgcccacataccattttcactatgaattcacacattcactgggcttcatctggtctaacacaagaacctcatctcttatcccttgattccactttcatttcttaaaggagctagcaggctgctcagtaagatttctggtcaatcaaaattataactccacacaaaagataaaataaaataagggtataaaagagtttttaagagatagaataagaattgaccagttatatagaaaagagagaagaataaaacttagataagtagttggtaaatacagctatgtaccgttttgtcttataatgaaaaaaaattatgtgcatgttgtatatgtgcaccaatgtaaatcttttaactgtactttcttgagcgtatctcttattctgagactctagcctttcctaactttttcataaagtgtcctattaatttatataaataaatgtcagtttcctttgttctaatattgttattctgtaaaagaagaagccatcagcattgtattgatttccaaatcaatgttgaaattttaattattctgagtaatttatgaggaccactaacttagtaggtttgaacctggaaataaaaaatgttaaatactggagttggagcaagttgggaagaaatgtttgacttaaaagcagtgaatctgaaatgtaggaaagacatttacatgaagatgtttggtgaatatgaaaagtagattagagacacaagggaagatattcagtggactgctggattatgcaagagagtgccctgttggaggtacagattagagagttacacagcaggaggtaagattaaaaactgtgaaactaaaaactgccaactaatagtaatggccccgaaccgtgaagaaagggaatttcgtgctccaactttggcatccctagaaaactgcatgaagctttctcagatggccgttcagggacttcagcaatttaagtctccccttctgcagctcccttacattgaagaggacaatcttagacaggtttctaatcataagaagtataaaatttaaactatccaggatttggtgagtttaaagaatcagattgtcatactctactgcacttccttgaagatgaaaaatatgaagaggttatggctgtccttgggagttttccatatgtgaccatgaatataaaatcacaggtgttagatgatgaagacagcaacaacatcacagtaggatccttagttacagtgctggttaagttgacaaggcaaacaatggctgaagtatttgaaaaggagcagtccttctgtgctgcagaggaacagccagcagaagatgggcagggtgaaactaacaagaacaggacaaaacgaggatggcaacagaagagtaaaggacccaagaaaactgctaaatcaaaaaaaaagaaacctttaaaaaaaaaaacctgcacctgtgctattaccacagtcaaagcaacagaaacaaaagctggcaaatggagttgttgggaatgaagctgcagtaaaggaagatgaagaagaagtttcagataagggcagtgattctgaagaagaagaaaccaatagagattcctgaagtgagaaagatgatggtagtgacagagactctgatagagagcaagatgaaaaacaaaacaaagatgatgaagcagagtggcaagaattactacaaagcatacagcaagaagagagcgctctattggaaaccaaatcaaaaataacacatcctgtgtatagcctttactttcctgaggaaaaacaagaatggtggtggctttacattgcagataggaaggagcagacattaatatccatgccatatcatgtgtgtacactaaaagatacagaggaagtagagctgaagtttcctgcaccaggcaagcctggaaattatcagtatactgtgtttctgagatcagactcctatatgggtttggatcagattaaaccattgaagttggaagttcatgaggccaagcctgtgccagaaaatcacccacagtgggatacagcaatagagggggatgaagaccaggaggacagtgagggctttgaagatagctttgaggaagaagaggaggaagaggaagatgatgactaagcagtactctgaatggaccatagtgtttgcacatatttgcaattttttgctgttttggaagtttatcataaaccagaaacagtacagaactgatgttgagggaggtgtagtttttttactctagaaatgggtgcataatataactaggcagtggcagtgccttggtacaacctgaaaaatgttaaggcttactgaaacctttcaagtatgggatggtgcatttatttcatctgcaaatgataataaatcctttgttattattaaaaaaaactgtgaaattactctgaaaataagagtagaatgagaaaataaaaacaggaagatagtttggggggcaggaaatgcagaaggaggcaaagtagggaaccatccactccctgagtggatagctgtcctttgctgcttcctctgtctgaggcaataaacacttggtaaagcatagtgctgctatctatccttcagtcactgcaaagactggagcctgaaccactcaccaacttgtctcctttgggttttccagtgtctgtctctgtttaaattgtgttctttttctttctttctttctttgcctagcctagtcccttttgatgtataactttttaaagttttaaaattttagatttggcatctccctagatgctatttcctgaatcaaagctttgtctctttgcaaaatccacaggctcctttctctctctttctctctcgttgttttgttgttgttgttgttgtttaaagatgaggtctcactctgtcacccaggctagagtgcagtggtgtgatcatagctcactatagcctccaacttctgggcttaagtaatcctcccacctcagtctcccaattacctcattcattttgagattcctacatttctgggacaccacggtttggcccaacaactcaagccccactactcaaagatgccaaggaggaggtggaagtaggcaggtgaatcaaacttttaaaagatgatactatcagtgtcaagtccaggccctacctagcaaataagtaggtcctgcattagttacacaaacatgagaaggacaactagaatagacaaaatggtcatggaaaagaggaagaaattaaaggaagcattaaagataaagtgaattttgttagcatgtgggaaacaaacaagagaaccaaaacaagagtggtaaaaacaagagtggtaaaaaggcatagtgtgagcactcttccttgaataggaaagaaagaataaaaattttattaacaagagcaaattttccaggaacattttacataaatgaggtaactgtatctacatttaattaaatcacagaacaaaaagaaaacaaagcatttagtcggaaagtaagctactgagatctggtagttacacttttcttcctcaagaccacagtcgttgtggcaaagtatgctcagcttcacatctcatcatttcacattctgtatcctaaattgttaaaaactaaattgttttcaaaaattacaactgaaggctgggcacggtggcttatgtctgtaatcccagcactttgggaggctgaggtgggcggatcacttgaggccaggagtttgagaccagcttggccaacatagtgaaaccccatctctactaaaaatacaaaaattagctgggtgtggtggcatgaacctatagtcccagctactcaggggctgaggcataagaattgcttgaacccaggaggtggaggctgcagtgagccaagatcgtgccactgcactccagcctgggcattagagcgagactttgtctcaaaaaatataaaaaaattaaatttaatttaatttaaaaaataaaaattacaactgaaattcatcaaatgtttgtttcctttccacttaggtgcatagaatttggaaaacagacaggaccttatctggtccaaatgaacagatcaaaccatcttttggagtatgtaagattataattaatgtagattctagtatatgtcctataatattgtataccatcagatttgataagtgtatgatctatgtatttaagccaataataaatattttgaacacatcaggactaatgacttcacagtactcaaatggtaggaatgcatgataaattttctttcttattttttttttttgagacaaggtctctctctgttgtccaggttgaagtgcaagtggcacgatcatggcttactgcagccttgacctcctcagctcaagagatcctcccacctcagcctcccaagaagctcgtaccacaggcgtgtgccaccatgcccatctaattttttattttttgtagagatgggatattcctatgttgcccaggctgatcttgaacaccgggctcaagcatcctcccgcttcagcctccaaaattgctgggattataggcattaggtggcatgcccgcctggcccaatttttaatcaactcaacagttctactacctagtctacattttaaaatttgtatccaagtatgtacgtgacatattgtatatatgcttattatataccaaatagaaatgctcttatagatgagtatcaaaaataaatgaagcacttatccattggaaaagaattaagtggaaatgatggcaaatgcctacctgtacgtatttgtgaatgtaccaagaagcttgctttccatcattcaccgattccactgtagtgttagccaaaccaacgacatcaccacctgcaaatacccatgcttcactagtttgcatagtttctggatctacttctgggagaccccatctgttaaattttatagggctcaaggcttcttttactgaaaaaacaagtgaaaaacaatagacaatcactagtcaacagacaattccataacaataattttaaaattaagaaaaattatggtttaattattgttccagggattcaaacaactgtttttagtaaactataaaaatgaaaagctaacgaaatattggagttaacaacacatttgaagggcactgacttaactttacacctcacatacaggaattaaagaccacagatttggtcaatgtttcagagcggacatttatgtctacgaagtatggatctataaagaaggaaagtacaaccttttaaatacatacaaaatacatttttctaaaactttattcatagccatcatttttacaaatctgttactacttatattatccccaacttgttcatgtgtgtcacttttgaaagttacatcatgaattcaggtcaatggctaatctcccttttacaacaaaacattttataaagcaaaatgagacaacatatataacattttcattaaattatttgcacttactattaagcaatttaatggatctagtatacagttacatttagccagcaatttctgctttgttttgttaaaagcaacaaatgcaaacattaccattaattccttgtggaaattgctctgtaaagtagttttgcaattatttactaaatatgctgcattctaatgaatctaaaagagtcatggaagaggaatgaagctgtgtttctttaagaaaaatatctaacgaacattttgaaagcataatcctgacatgtggaagagatcaatggatgcaatttagagaaagggttgagtaagagaagaaatgaagaaaggtggacaacaccctatttgatggagtaaactgagtaagccagtgtttaggataaaatgttctctccaggtaacgtcataatttttaagcacagcatctcagacagactaagggccttattctttactccaactccaaagagaaaatattagtaacaacttaaactaaaggaagagagcttgggagattttggaacagaaaagttagttgttgaatttatttatgaatcaagtataacacaaaatagccaaatacaaaaaatgttatttttgacacctaaaaccagtttcttctgagtaaaatagaggaaaaaaatagaaataaaataaacactggtatatatttgtagctttctacttaaagaatgttagagttgtagaaaattattgagggtttactgttgattgtgtttttcccacaagatcataggttccatgagaacagcaatttgtccacactgcttgcctgtgttccacagagcacactacagtttttggagcagaggacactcaattggattgatggatgaatgaatgaatgagtagatgggtcaatgctatcatactcaggtttttattttaaaatcttctactgtttctatttgttttttcgtctttcattgagaggaaaattaaatattcatgtaattattttcaaagcagaaaggcattttaaggaaatttttctaatgtttttaaaggtcacatgaaaagagatctttatcatttgttccctgttgcataacagatcatcactaccatctgttgacagttacttgagttgcaagaaagtcaatagtgagtatggctcatcaattcaacctattttaataatggcaactgtaacacatcatcattgaatgatatatgtaatgagctttataaatagtggcaaggggtaaaaatgaattctgttctatcagaaatgatcttatgtttccaaaactttggcctacaacagatctgaaataaagataattaataaaaagataagaaattcaaaattttatcactaggagatcaaagcatttttttttacatttatctcatgtttcacagcaatatccttgaaatttaagtagagatttcattctatgcttgagcaaggtaggaataattccttagttatctctgagtcccacaacataaattagagtcaaagacatgtttacagtcggccctccatatctgtgggttccacatctgaggattcaatcaactgtgcattgaaaatatttgggaaaaaaatagaatgtttatgtctgtactgaacgtgtacatacttttttctttccattattccctaaacaatatagtatatcaagtatatatacagcatatacattgtattagatataccataagtaatccaaagatgatttaaagtatatggaaggatatgtgtagattatatgcaaataatacactattttctataacagacttaagagcatagatggattttggtatccatgggggatcctggaaccaagcccccctagatgtgaagggataactttatcatgaagttactgaagcttaagtagggtccctcacttgcatgggactctttcaaagccctgcgcctaatttcaaatctatgaatttttcttttcttaaagaagagctctcaaattgtatacacttcaggcctcataaaatttgaatcttcacttgagcacagtgaattgtacacaggaggtgctgaataaatgcttcacaaattaaattgaagttcttgaagaatgtgctttaccatattttaggatgcaaaaaatgtacatagaacaattcactttaacactccacctgtcacaaactcggtccataagtagtcaggaaatgttactctgagtttaataagtaactttatgtttcttaaaatatttagcaccaacatcataagccaccctaggggcatttatttgtgaattcaaaagcactcttctgctcatgggcatttctattgtatatgcattgtgttattatgtatccttaaacattcataatactcatgtatacttttaaaaataagctttctttccttaatatttgatttatttattctgtgaagtcttaaacctgaatatcaactgttttaattattttatcatttgtaatatccagctaacctcattaaaaatcaaacaattctttgatactctattctaaaatagaaaaaggattttctttcatattaaaaatcatctcagtctccttttgaaaattaactaccaaatttcctcctgctcattttggagaccttcaagtttaacatgttcctaatttcattccagaaataaaaagaaaaagctgagagatcacacagctggttatgaggttactaacatcaatcaaaatagagaccatctgtatatattttaatacccaatatttggctcatcaaatatctacaaaaagatcactaagaaagtagaatatggacaacatttataaatataagcaatgctacagtgggtcagaaatatttctttcagtagccctaagcaccaagaatgactatcacaactggaatatcaaatggttaggatcatttccttgtacatgtagtagactctaagcacatgtaatattcatatatagtatgaatttgattcatactatatatgaatttactgaaactttgttaaatctggagctaaatacctttcctaatttcaacaattcttttaaaatatagccattattttaattatttaatcattttcttaagcttagaactcaaatcaaggattcagtgaaaaaatccacgtgcatgttattcataatttctcagaaaggaattcatttatttagttgctccttatgaggaagactatcatcctcatcattgtaactgttcttctatgaactcctcagagctcttttacatctctgctgatagatttaacttggaatacaataaaaataaaactcagaagcaaatcttctgttctgtctttacccagcttggaaggagtgaaagcataagtgaatgaaaaatgtatatttacatctgcaaaccaaataactgcttgccatttcctctgaagtgttaaatgaatattaatagaaggattgtattattcctttcttgtttataaaacgggggggattttctgttatgttcatgcacagttttctcagattttccatgagattgcatcttgatggagactgtggcatatgtcccaggagctccatagttgaacagaaaaagaacttgaaaaagaatcccaaaacatgcttattcacagtctatattattctgcaattggaagagaaatttgttaaatgatatggtgcctggaattttatgcagtctttataaagaatgaaaacgtccttaattcataccaaacattcaagatttatgttaattttctgctttaattactactatgttcaaatgagcttatttaaaaaacaaagacactctgaggtagctttataacaagaaacggttttgaaattggaacttttagtcaatttaatgctgtgcatgaaatgattttttatacagacttaatggtattgtgacacacaagttcttcaataagccacagcttaaaattgcagaaaccgtccctcagggacacatcactagcagatgcagattgccaaggtcaattaaactgatgtagctgtgctgtcacatatgtaaaagagaaacccacaagcatatgacaagtatatttctcagtttttataaaaagatgtcaagaatgttatattttagtacacaaatataaattaattctccataaacaataaaacaatacaacagatatcataatgaagaaggattattagtattctttggagagtttgatgtgttataaaacaatggggggaataaaaactttcaacatttacaataaaatgataccttgaaaacatagatgaattcatctatgtccttgttgtttaattttacataacctatcacccactaggaccaaatcacaatgaaactaaaaggtgtgctgaggcagtaatctcagtaattcagcgctgaaagcaaaatctcagcaagatcaaaataaattctaattacaaggccaggatatcagagttctgtttaaatagaataacctggggtaaggaagggccagaaccagagaatgcctccaactaagaatatcaagtctggatggcttgagctttgtcttcacatctcccttccacttctcagtactttaatcagtatgctctccacaatgaagattcattgttttccttctgccagtctctcagaagataaccttgattctgtaccttcctgctcctccaggtcctcaaacactgtctcttactcttttcagtatattgtatgtgtcattttctcctctcctctccaatttgaaaaaaactttgtttttgacatggttatcttttctcactgccattcttatatcttcctttacccaatttctcggtcatatacttggactgcttacttgtctcaccaccaaattattccttgaatgaaagtatggtctccacggtcaccaaattctgtgaccttagtcttcagctcttttgcctttctgtagcatccaacagttgaatggcattaattttgatcttttttgatttgcagaatgctcctctaccctggctctgcttatctttaaactgtccttcttgggctctagcccctcttcacctcttcattttcctcttctcagctctcaaatattcagtccactgcactttctctgtcagaaatcatagtcatttagggccttcaatttcatctctataaagatggcctcgaactctcccttgagttcttccttttattctggaacttctggatgcctgtttaagattataacctgtatgctctaatgtcccttccaaatcatcacatccaaaactcagttcacaagcttcccctgggccttcccacctcatgatttattattggtgaccttactctttcatttcctccactcattgtgaacacgtcttacctttgcttcactcctcaaaacttctatagacttgactcctttctcttgcccccactgtcaggagaaggccttgtcccacaattcacagagaatataaaagccatcacatgggaactctcttttcttcccatcagcaaaactacaaacctactggatctataccttcgctctctctctcttcctttttaataccactaaggaactctccctactatcagaagccattctctccacatgggcccaagaatcctctcctctgacctggtaggaattttgcccctgacactatatccactctcttctctattaccagccactctctacaaattagaggtttcccatatgtaggtacatacatgtacagtagtacctcccaatttaaaaccattccacatctgcatttgactccaaagcttcactaaacctcttttcactgatatgattaattggttccaggtcgccaagtccagtgattcttctcagtgatcatcttgcttcagagcctgaaatagggtgaggtgagtgaggcagacaaagaacaaaatttaaggaggtccttactctcagggtcatgcaaaggcaaagttgttggacaggcacctaaggtgcctcccccttgttgtgctccttgatttctcagcaaaattcaacagataaccacttcctcctcatgaaagtcttttagcctggcttctgtgacatcatactttctgctttccacctgtcctcatgatgcatttttaatagtcattgctgcttttttctattccctttttttttattttattttattatgatttttttcttttttttattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaagacatgaactcatcattttttatggctgcatagtattccatggtgtatatgtgccacattttcttaatccagtctatcattgttggacatttgggttggttccaagtctttgctattgtgaataatgtcgcaataaacatacatgtgcatgtgtctttatagcagcatgatttatagtcctttgggtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgaggtggtatctcattgtggttttgatttgcatttctctgatggccagtgatgatgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctattccctttttcttttcttttttttttttttttttttgaggagtctcactctgccgcccagtctggagtgcagtggcatgacctccgctcactgtaacctccacctactaggttcaagtgatcaagtgattctcgtgcttcagcctcccaagtagctgggattacaggcgcttgtcaccacgcacagctaatttttgtatttttagtagggatggggtttcagcaggttggccaggctggtctcaaactcctgacctcaagtgatttaccagcctcggcctcccaaagtgctggaattacaggcatgagccatcgcatctggtcccattcccttcttcaaaactaaaaatagagcttacaaatcttagtataatccatgaatcttgtttccaaatatatcaacatccagtcagttaacatgttgtgccaatccatccaatgaaaattttatcctagttacttcttacattccattaacatcactgtcaactaaagaagaatgttagaaaaaataatcaatcagcacttatggatctctagtacatggcaggcatactgctggatatttccatagaatatcttattagatcacaaaagaacccttgaaggtggatattatcatcctcaataaagccaagaggtggcagaggcagtatttgaatccaattatttcatctccaaagtcctgctgcttctgactttgggtgtgggggcaagagaaagccagaataaatagactctccacagtctcataaaattcagcattggggatcatgggaataactaaagtgaagacaggaacagcaaagaattctagtcttggctagcttcacagattcagccttgagagcatcctttccaatgaaacctttttccccccctttctagtgaattaaccactaacgactttctgttacgctaggcactatgtgactttatttcaagtatttgttttacctctactactcctaagttcagataacttatttaagtcagctacttccccccagcatctagcatataattggcatataaggggaatctagtatatgttttttggtcaaaaaatgtagtatttgtccattccatttatttagcattcatattattctgtcttagttatttttcttgtagatcttattttcacaattagtcagttcatcatgtggagaaaaagtatttctacactgacaaacatactgactagggaagaatgggcacatagtgaatttcttttgatcaatttaaatatctgattttcctactgctatggttagataattttcagtttgaatatgctagtagaattcagtcagggtaaaatacagatctgatcttctccctcaccctattcaggataaacttaggctccccaagttgaatggaaacgatggatgtcaataatagcctatagcaactccttttgtgttatttgtattctattggaagtttcatttccacttcctaaactgaccaacaaaccaattcagaattaaaatagtccaagcacttcaccttgatctgcttatgtctctgaaataattctatctatttaagacgctgaactccttgaacattggatttcattttacctggaagagatctcctccaggaggtcagtgtccttgaagtaaatatatgggaattgttttcaaattctctgttggattcccaaatgctgtactttgatttgcttatttatattcaatgataccatctctttaagactgcaaactgcttgaaggaatagatcatcctttaatctggtttggaccataatcattataattctatgcacatttgggtgcttaatatttcttgataattatgagatagtgaaaaaatagcgtattgaaatattttttgtatacttctcagcaaacaaaattttttaaatgctcaattatgtcatcaaatgatataaacaattactgaaaggggttaagaaaaatgtttcatataaaattcccatttgctgcatttaacggaaaaataaaaacaaataggaaaccagtagtaaattatactacttgtgaaaacaatattattaaaatataagtgaacactgaaaaatattttaattaacaaaataaatcaaatggaaaagattccctaaatagagctttaaaagtaagtctatgtgtgtctgactgccatgactaattatgtatccatgtaatgtgtgttcaatttgggcttatttaaatagcagaaatgctcattagctgcagtatatctgtgaagcttcagtaaacagtttaatggtttttatgtttaaccaatttcataagttcctgtaattttagctttagcagctcattaatgttattttttgatatccatcttacggcttttttttttccttgtcaatcgtcagtaggcacacttcaatgcaaacttaaaacacacagtagaattttgtttaaacaattttagtacataagtaaatgtgcaattcaaaagtatagtttctttatatagagaactagctgtattatcatgcactcaaaaaatatcaacattggcaaaggctatatctaatggggataaaactataataatggaaaacatttattgagcgctttcatcagcatgtagctggctctaggctaggcactgtatatactatctctttggatcctcacaaaataggtataactcaattttatagttgaggaatgtgagattgagataagttaccaaggtcacacccttaggatttaaacctcactagaaattaactacatatgtagttggaaaatgcctgaaaaatccacagaagcatttggagatacacacctagacctcagatgaaggcactgcaacttgggatcaaataaatcacaaggctgggtaaagtttccaaagaaagagtgcaaaaacaggtgacaatagaatcatccacttatttttaaagtgtcagcaagcataacctgaactaaagctagagaataattcctcagagttacgtgagaatcaaaatatttctaagccacaaaagccaagtaaagaggtaaattcaacaagtattaaatacaaaagaaatataatgtaggtaaatagattgatgacgtggaggtcaatgaaccgtaaaaaggtgacacttgcagttaaatagtaaaggcaaaaaacagaattctgaagttatggacaaagtatctggcaaagacataagacagtgtacacaagctattcttcccaggtgtttcataatttttaataggaaaaaaagcaaggcattaccttgccttcattcattcaattagcaaaaaaaaaaaaaaaaaattgtttttggtctctcatgtattacatcctgctgcaggcaccgtagtaaaccacagataagagacccatccttgtgtgttgtaaatttcatctggcagaagataaaaaatgaaaagtaaataagtaagtgaactatatgatagtgaaaatggttatgaatagggttacatgaaagagactagtacaagatgagggatgtgagaagcagaaggggtgctttagatcatagcaattatggagggtcagagagcgcctctttgatgagatgccatcagagctaaaacataaaggataagaatgaaccagtcacgtgatgacttagaggcagattattccaagaagcgggaacagtggcaagggtgttaaggatgagatgcagttatagcacgtgaggagtagaaggaaggttttatgtgggtgaaggaaagcaagtgagacaagagaggaagtctgagaaataggcaggggccaaaccaaggagtgtgttagaaactgtagtaagaagtttgttacaataaaataggacagcatttgtagatttagaacaacaacaaaaaagaaattaaataatctctgtttagaagctcattctggtaggattatatggaagtgagagtagaagcaggatgaccagtcttaggaaaccattctcaatgcaaagagaaagcatccagcgtctgaccattccctgaacagaaggagggctggctggccttcatgacacctcacaaatacaacactttcacatgattttgcccttactgttaattttcagtacagacatttagaataagtcacttcattcttttcattcaaccatttattcatctcttcactcattcatccatttggtgaatatttattgagttaaggactgtgctggatctttgggttaaaatataaataaagtaccctgcagtggtactgtcaatatacttcagaatatgtaagatatacagagtgaaatagaagagcaagaatcaaaaaggagaagcatatttaactacatggtccctatatgtgtgtagcaaacatatttaatctacgtgcctctttagatttccagtaccacaattctggaataaaattcacatagttaaacactaaaaacatttcatgaattagcaatgatatgtttttccacccttactctattatttcgcatataccttataatctagacgaagaaactcccccatgtattcatccagcctgtttactataactggaatgggctttcaatccctgtctctgttctcctaattcctacccaatcctcaactattataaatgtcactgcctccacaaaaccttttaattcttgctgctgcaagtcatctctctaccctgtatgttacaccagaaatttatctgtttctcctgagtcactttctacctaaaggtaactttatttgcatgcatctttcctcctttattagactgcaagctcctgcagatggggacaatgtattcatttttgtgaactttagagaacctaaaagaatcttgtataattaatacaaaacacatataataaatacagaatgaaagaatgggaagtaacatcccacaagtatgtaggagggcagattagtaggatgtcaaaattaaattgaagcatttggttttaatcccaccatcagggaagaatagttttagattccaaagtatgagagtaatgtgatgagactggtgatgtaaagttcatttggcatcagtatgcaaatacagggagaaacactgggtcatgttaaaccaaatgaattgtaaatacactttgaggagggcttggaaaatcactggatatttggcaaacacttactatgcaacatgcttgccattctttcacatacttgtatggaaaaaatggtcaggtaagtcttgaaaacactttaaagagctttagaattacaaaatataacaagtatggttgttaaagaggaaaaaaagattagcactggttagcattaatccacatactgttaggcaggatccccaaatggatgttaacattaatactggtttcctcctccaacaatggcagtatattacatttgaattgagtagcttccatattttgggagtagatattgaataagatttaatgtaattttctaatttatacaatagcatatatgcagatcaatgtcttatttttttgagatggagtctcactctgttgcccaggccagagtgcagtggcatgatcttggctcgctgcaacctctgcctcctgggttcaagtgattctcctgcctcagcccccccgagtagctgggattacaggtgtgcgccattacacctggctaatttttgttttttcagtagagacagggtttcaccatgttggccagctggtctcaaactcctgacctcaagtgatccacctgcctcagccgcccaaagtgctgggattacaggcgtgagccaccatgcccggccaaatatctaatttaaccagagtattttagatagggatgttgtcctatttatattgtgctttgagtcaagaacagaaacacaaagtaattaacaataataatctcactctgcaatacaaaatacatataattaagaaccttactatactctatattatcattttatagtttaattaaatcttacatcttgattttacatctcacagcggcttagttttagtttaacatttcaccagcatgttaggtttcagaataaccttttactatactataagctaactagtttttaaaataaaaatattataggctgtggtcaataaagctcagtttatctattacactcaccgtatctattacattaaatacatctattacactcactgtgtgttcaaaaccattggctatgttttatgatttctgttctctgaaacaattacgttattttttcccattttctaccttctttccctaacaaaacttgttacatgccactgctctacttcttgtatgtaatcttcaatttgatggaaaactactgatttatccactgtctccctgtaagaatgcatatgatatcaaccagtagtgaaacctggaaaataaagataaggaaaggctctgagcagagctattcactggggaaacaaacctattcctatgcagttattagagggaagtaaaataattacagaaatatcatgttgtgcttcaaatggatatctaaggcagatgtaagtgatgtggtgttgattcccaatcactttcaacactgttatcagtttgacctccatcctcatcacctccaccctttcaaaataattccaaagaaaacctgtgcaaggattccattagtttggatagttattctgcagaaatgccagtacttacactagattccaccacttcatcctcaccctgcacaacatatttcgtaatagaaagatgataaatctttcaaccaagcaaaaatacttctgataatcagaacaatttttgaaacatgtacagtgtttcagttaggttcctgaaaattcttcttgcccaaaatataattaaaggcaaagcactgtacaaagaaggcaaaaatagttcattttcatcatttcgcaatcggtacacaggatctatcaatgttattattcaggcattttaaaacaacatggcagcacatgaggaatcatgtgtgttattaaaaagcgaacaggtggtagagagagtaccatggaataaaactgtcccttcatgtcataacctccttaaaatatttaccatcaggaaatcaacagtaacaaaagctgaccttttttctcttcatattatggaatatgacaggcttctggatttccagaatcaatgccacatatactctttaatcacactcttaagaagctgttatttaaatgataggctacaacacctttcattaattaattaaatcaatgaacagctcctgctgtaggcattaaggtatagtagtgaaaagacaggaagatgatgtgtactaattcccaatgtctgttttcagtcattctctgtttccttagttctagtcccctgcttcagttgttcaatagcaaatccaaattcaacacaccaccatttcactcagatctcttctatctgtgagttctgtcagcactataaacacctgtttacctcccagctagctaccccacatccaatctctttatcaagcagataaccaaatcctgactattctacttaagaaatatatcttgattccaaattttctcctgtatttccacttcctctaacttagtcacggtaactactgaaaaaattattttaatcctttaacttgtctttcttaattccaggccatctttcccaaaattactgacactgtagttccacactcctgatgttgccttccatgtaaagaaacaatcatttgtataacagtcagggtgtcgcattgtacctttctcgcctctctccaaaacactaaaatagaatccaaattagtgaatctggaagaagaaataaggcatatataatccaccctggtcaaacctataacttgagagctgcccatctgagcataggttctcagtcgcccctgatactgaaaatgttactgggtcagcttctcataacggcatttactgtgtgggatcataccctgtgactgaataaccacctaattcaggtcaccaaatgttagaaaatgcatttgcctactaacatgaaccatctcaaaatgtggttgcttattttctaacccccaactatttgaagattattacaaatggtgcacaatccaagcagagagaaggaagctctaacacctgctagaattacctcattcaagacaaagagctcttccttatttaaacctcctcatttgtcacctgcatgtctacagcataaaattcaaaatccctactttagcatataatcctttgactccacatatattttagccatatttcctgccatcttatccctacctgctccctacccttatgtaaccacacaccatctggtccagcaaaacagaatgcctccccgttgtctgggcatatgaggtcattttgtcggcccatacttttgtatatgatgttctctgtaacaggaaaactcctactcaagctctaaaacccattccaaatgtgatctcaaattagcacactgtgttgctatatatgtatttacatgtctatttctctcattagcctataggtccctgaagggcaatgactcttttacttgtgtctgtattcctagtgcctgagtagtgcctggaacacagttgtgcatcaagaaatgttcattgcatggtgaataatgagagaatgaatagtagaaatcataaaataaaaagttctatttagaaatacaaatgaaaaattcagaccatcatttacgaagatgagaacatgcatgaagtaagtaggctgatgacaactttctaaagacatatattttttacagctttttaaaatgactgtaaaatgactatttaatctaacagtgcggtgttgagcaaattgcataatctccctgtggcttccctcccttccacccccgttccacctggaaactcctacacatcactcagacttcaatttacaacccacttcctctaggaagcttccctgaatgcttagactctgttctgtgcttcctcgggaatctaaacttctcaaagtacaatttattgtaattctgagcctcccctgttaaaatgtgcattcttggaggcaaagtttgcatttctcttttcactactttatccctgaaacgtatctttaaaaagagtctgcactagccaccatacgttatttaaaaacctgtgaagtgaggggattagaatatatgatctctaaggtccttctagcacattcagaaatataaataaggaaaatcctaatgcaagttattgtattgtatccagtgtattataccggactgattactttagttcttaatgttaggtaagaatgtcattcattcttacttatattaatccttaataagtcccttcctctaatgttttgccattagtcaaaaaggtatcctaattagcaatataatgcagtattctttaatctgttctttgaaacttcattgtaaatatttgtttattaaaatgcatgcaacagtgaaaatttgatgaattatgatagtttctcaaattagtattcaatttttcccccttcccctttatttttgatatgagaaattacgtaagctgaaggtcataaagagtggttagttgttcaaagaaaattttgccaccagtagcttctataagatatgttttgttgtttgaaaaatagaacatgatgttaaccaaaaactgtggtttattaaaatgttctagcattctcaatttcattataaattaccaaataagttacattttaataaggagtaaatcaaatcaaacatactgattccaggtcttttaaaacatagctaactaccatttttgaatacctaaataatataatgccaacattaaaacatttttcataggctcttcccaacacttaaacaattgagaaaagaaaaatggacacatttgaaaaattcttgaatttttgcatcgtaagaatcttagcaggccatttcttgcctaactggcaatttctagttctgagttaggccagaacaaggcaaattaacccatggcctgcaccttttctcagtatgggggcaagtgaatcaaagctacactcaaagctgctattgacagaatgtttgatttaccccatgaggctttcaaaaacttttctgagggccttctaataagaggaactgatgagtgatttaaaaacctttttttttttcctgcaaacactcccttatggaactaactgcaatcaatgttatcaagggagctgatttctgagagttgcatttaagattcagaactatctaggttttgtgtttccttgttatctctagttcccagtgagtgagcagaaagaaaatgtaagcagtgggtgaagtacgtaaattcctttcctaacagaagggtcgtatcttccctggctgtgccctgagctcagtcaccttgtctccgctctactgagcagtgtggtgcaacatgatgctgagtccctcaccattcatcctaacatcttccttcccaaaacatgggtttttaatcttagttatgtaatcccataattttcaagcatttaaaatctcaaacttagttgaaaattcaaaagtgcctttcttgtcttaaaatacaaatgaatgatccttacactaaacaaaaaaatgtggtccaattttcaccatttctaagaggaagaacaaaagtcatttaaaaatatgtgctttttacatacctcatttgcagaaattcaaaatggagatttcttttttttttattatactttaagttttagggtacatatgcacaacgtgtaggtttgttacgtatgtatacacgtgccatgttggtgcgctgcatctggatcaagaaaatttggcaaaatggagatttctaacaactaaaaatagttgaaaaattgttttcgatggcatgaaaaacattagaattgataatagtttaaaaatatataatacagttacagactgttcaatctttttttcaggaaaaaaactaaccaaatatattgaacaatttctcattaaaaaaatcatgaatgtatgagcatctgcttcacttatttacaaagtcatgttgacagagcctccaaagttcctgatgaagtattgatattcaaatgactttattcccaaacaacatgaatagctacataaaagttaatataaatcaatttaattactaaaatatggttttgttacagattaataataacatctgtaacttaagcttactatatgctacgcctatatgtaaatgatttacatatattattaattcatttcttctaaataactctaggatattcatactatagtcatcccccttacagcatgaggaccatgaagaacaggtagactaagtaactcattaagacgatgaagttagaaggaggacagccaggtttccagctggggcagcctggctccagagaccccactctcagccaatataccagatagactctaattagtgtaatatttattgtattatgaagaatacaacaatttatgccacaacaaaggaaaaattcagagcaatagaataatagaattatttttctaacttttacattttcgaagaaaaataaaccaagcagatcccatcataggagaaaatagtaactcataagaaaattaataccctaacatgaagcaagtcaagtcaaatgcacaaatatttttgtggatctattatgggcacactaatatgtcagttgctattgggactacaatttagtataaaggtgcactccttgctctccttggggtttataggataatttgaaaataaaatagattccggaagatcacagaacataaatctttacagagtcaaaatttcatataatgaaagagtggttgtggtacagggtatggaggaggcacagaatcacagaatgagctaaagtacattcattcagttgtctgaaagcatattcaacaaatcataaaattatgtcatccagatctcctaggaatgtgaggacacaggcaaccttattgccttggttgtaaaaatgaagcagtgagattagtgaaagggtggaagaattcttactaatgcaaaactaacagaaatttgggcccacttaacaactgccagtttggttccaacaagaaagagaaggagagatacactataaaacaaacaataaatcgattaaacctgacactgtaccaacaaacaagaagaaacacaattcaattcaataaatattgaaaatagtgtttagcagaagaggaaacatcctatattaggaaatatatatatttatatcatatatagaaatatatattcatatatttatattatatttatattatacatatatgtataataaaatatacatatacatattttaaataaacgtttagaactttccagtgaatggacaatatttgtaaagcagaaatgcagttacagaaagtttgtgcttaatctcctgatagcctttacagtctatctagaacaacaaaatcccaagttaatgtgacgtgatatggagtcgtacattcttagagggaatagaggagactttttaaaagtagaaccattttgagtttttcacaagaaagatatttaaggctgacgttatatcaattgagtcagaaattggacaccattgcctttaaaatttgagctagtgtttaatgaagtattcaattaaattatgctgatcggcacataacatattccatgcacatggatatggaatatgtagtcttttgttcctacttcccactccctggtacaatccaaaaagtgatggaagaaacagaattatgtaaagtaatgatgattacttatcactcttattatccttagtggcaacgaaataattagcaactataatcccaaactcttatccaagtttattttataaatgatatacttatcttttctataagctgttgaggcacttatcattttatgatagggaatatttattacagatatattaggtgtataacactaaaaaagttattttacattctccattgtgaaacaaatttagaaacttacaaagattgtggaatatttcagaaaaaactgacattaaaaatgtaatctcctttcaattttccaattagcttagcttttcaagttcttattattgatatatttgagattttaaaagtattttcatttacaatattattgcaaccagagacttctgagagtgtaatttatcactgtactttatatgtactctgtcaagtttacttcattacttgaatttttcagtatgtctttatgtaatgcatttaccaaagattttctgtgttgccactatggaatgttccctgtgctggatgctggcaggaataattcaacagggaacagaagaaaatataggtggatacacagaatgtatataaggccatttgctgatgttctcaagtgttgagaagtggaagctttataccatagtataagataacattggtacatttaataaatattataattagaaatttgaactggggtaaaattttgaactttggctatggggagtactaatggtaccatttgcaataatagtgaatttgagaaaagatctgttttaggtaaatctgataaggtgaacttttttttttttactttgtgcaaatctctcttaatgtacacattcctcactttgtaataaaattaattgattacagatctgcctccaccctagtctatggaattttaaagcccatgcaatgactcgctcattttcatactctctagaatataatttggcacctggcattcattaggtactcagtaaatgtttgtcacatgcctgagcaaaaatttaggatgaaaggaggtcttctgcgaaatggggagtggaaaactagatttaagagtcatttttacacaaaaaggaaatagtgcctactgtaagtctagccactgtctggcacagagaagttcatttatatgtcttgaggaatgaatgcacgtatgaatggataaatgaaagaatgaacaagacattcatttcactgaagaaataaatacgataaggagagaaaatgaacaaattctgaactttggaaagtaaaaagctagaggaagaaaagcagtcagtgataggcttggaaaggaatagttaaaagaagcagcaaggtaatagagtgtcacaaacaagaatatgctctagttttgtttccaagtcttttacattatttcattttaattctgacaatagtcctgagaggtagaaagataatgtattactacgcttttttttagtagataaagaaattgagcctcagaaagtttaagtgacttggaggagagcattttaaacagaattcttaacattatcaatcataaaatgcagaaaatatactaaggactgaaaggatgtcactgcatttggcatgcagttcactgaagtctgggcaaagtgaggttgaaaaggagaaaagtggaggggtggaaagagaagtaaacattttaaaagatgaatgcattaaaacaggtatcacatatgtgataatcactaggtaccatccagaaatgacatgacatagtgttaggatggggaagaatttatggtagaagaggattaacatgaatatcttctcttcttacccaaatggacatcttgcttccaataaaatgcttttcattttattttacatatatgtgtgcacatgacagttttctgactttgaaactattaagattttaaatcctattgagtaagatcttcttgatcaaattctaacaaacactgcttctgtgactcctttatttaatgttttccatccaaaagaacagtactgaaaacatttagatgggagtccaggaatgaatgctatctcacactgcagctctgccagctcccctctcacttggagaataacttcttattaaagtaaacatggaaggctcctggtaaagttagtaattctacttaaggataatttctacaggcagtttattatttcaaaccagaagaggaaaaaaaaatagcgaagaaacatttttttccttgacttctctaaatttataagaggtggcatatgtgaagtactagaagaaatatacacagtaaattctggaataaaatgcataaattctgaaatgacctagtcaaacttgaatagatcaaattttctccttcttcatattttatatgctaacttaaatcttttattcttcatacatacatacacaaatacacatgcctgcgcgcacacacacacaagcacaagcttataaaatcgtatctgagattgcaaaagctgttttctgagccaaatctgttcaggtttgtttaggaaaatataattattattaatattaggattgtcaattatggaacacaaatttaaatagttaagctaacctttttggataggcaaataatcaacagaattgctagttaaacatgattcaacattttactcaatttttggtgatgtacatagtatttaatagtaagaagaatgggatttttaagataatataagcactttatatatcattcttttttccttcctgaattcagttaaataaataaactatactctgactgtgtctacataccacataaatgtctagataaaaagtgacaaatttaggccatcatccagctatttgaaaacatttatctcgatgacattaaacatctggatgtttccacataccaagatgtttgatgccctgcagataaaatatctgatgactagttgaatcctttacttatctgtggcataaaaatatacattttcatgtatatatctcttccaacttcagacaaaaaatgtaattttagcatggatatagtaggaagtcataggaatcatcaggtttagagagatttttggtatggttgttcttaatgaatctctgacctagaaaaacatattttattttcccttcagaaaacaaaagagttaattgtcatttcaataatgtgaattaaaaggtaaaaggatttgtaaaatgaaagtacctagatacataagctttcatctacaatgacccacagaaacactgtatgtgggaaaagtataacataaagtagtcttacttgactgaatcattattcagttgaaatgttatataaaacatttctttctctcattatctttttaaaaaacattttgtttttcttagcatgctcatttatgccatccaggtgaaaatgacagacatttaaactttctaatttgataattctgacatctgaagtgatgatctggcacaaggatggtaataaacacaaattctatttttggccattcattagattttgatttgtctgaatcattgaagactggctgttccaactactctgcctcattttcttactctagtctaattgaagaaaaagccattcttctataagaaacaaggcaaatatcattatagagtagaatatgtgttttggttataagcttaaaagaaagattaatgttcttttcaatacttgccactttaaaaataattctatataagcattaaataacatttctaagccttttgaatcaagattgcttttacttcttaactagaagaggaaaataaattttaaagtgaaaaacaattccctgaaagctagaaactattacagcactaaaataacagacaattgcatcacacatttcagctcccagcactgtacctttaggatcactcagaactgaaccaaaggcactgatgaccacatcggctttcagatggaccatctgatcttcatcttcattccattttccagtttcatcttgctctgtccgaacaaactgcatagcaacaattctcccaccttttactataaccttccgtggggacaggaatggcagaaattcacacttttcttccttagcaagttccatctaaaacaaaacagaacagagaagaaacttgaaaatgtttcttattccacacagtatttgatttctaattgaattacacatgctaaagcttatgatattaagtcaatatgcagctttttctttcaccaaacctgagtttcagttaccagttatttgcattttgtaaatcactgactcagggagtcttgaattggagttgtaatgtggacgtttatagatcacggcatcataaggtatttctcaagttttaagtactgcatgctctacatttggtagtttgtgaggtttctgaccatagtagcctattatttttatgttttcaattcagtagattaaggtctctttttttaatcatgctgcatattaaaataaatacttctgtttattaccaggttgcatacatccaagctggaaaaaagtcaataaagtgggtgagccaatctgtgcaagtacatgattagaatggtaggtaggagaaaaagactagagaaactctgtagaactaagaaataaaaaacattttttcttccctttataaaaccacagaagcaaatactataaatgaaaaactgaggacagcgaaacaagcatgtcctcctgatgaatgcccagttcttccccatttcctacgtaattcattttgccataaaatctggatacctcggtttctgtttgttttcatatgcataatggaatgttcattgagacagaatattaatgtttactcatttgcttatttttccattaattgtttttggagaaatccaggcctttgtcaatgcaatcagaagtactatgttgaatgttctttttttaaaaaatgcaaaaatgtcctactgaagtgttttgggatgttgtcttattattttccttcactctgaaagccaggtagattctcaataggctccctgggtaatgtttccactgaggttgtgtgtatgaggcttcaaactaagagttatctgagctttgtcaagatggaaaaactgagacataaaataattaactcaatgctgtaatcaagccatgggcccatctttcaacaacctatccagagctagtgccatgcatcacaatcacctggaaggctaattaaaccagactgcgcaggcccattttcagagtttctaactttggagggttaagtggggactgaggatttgcatgtctaacaaatgcctaaggtgatgctatgcttctagtgcacagatgatactttgttaaccactgtctttattagattatagctgactggctcagcacttgttctctatgatgcattttcaaagacaggaatattgcccctagggagcaaaaattaattcttgggggaaagaaaaaaatcctcagatatcataatggtcttgtcccttcaagaagagctaaagtatgtaaacagttatacagtatatctatggtattaaaatcatagcagggaggattaagaaaaaaatctaaagatactcccaaaaagggtaagaagaaaatggttgggaaacactgatctatactatacattattttgaagctattcaatctatgtcttatttaggatatttttaatattgtcattaaaggcttaaaaattggaaccacataaaaattattacacagtctttccctttttattatgaaaatcaagaaattagcaatataaaacaaaacatgtgggatgttatgctggtaaacatacaaaacagttgatataaaactgctcactcctcagacaggaagattagaggtaagcggaattgaatcaaatttgaaaactgctctgctgcttatttgggatagtttccttatatataaaatggggagaacaccatctcattaatcggtatgtgtggtgttacttaaaacaactccaaaatgtaaaatgcctaaagcagaatttagcatatagaaggctatgtactcatagttgctattttctgaattcactttttttttctctgaatcattcttcagctattcaatatcacttagaaataagattgtgatttcaagagaaaggtggcccaataacaaaggttagtaaaaggcagcacaaagacaaaccttagactcctctttagttttctacaaaataaaaatgtatgatttctggaaggcaaattattccttgaataattcaaattacaaaataaatatgattccaatatgtaaaatatgttttctgtatcgcttttgtcatatttgtgccacatatcaccttataactcatcaatataaaccagtttattgtgtttcaaaatgtcaagtggtgctacattttaatgataatgccacacttgactgaataacaactccaaatgtttatggtttgaataaatcaatatacaatgtgtacctgtaacagtactgttttctgtggagggcagaaatgaaacactgaactatgctgtacctattgggaatatgtcttacagatcgatttaggatctgtttgatcccactctatctttgctatctattaatacctctacagtatctgttattacatatagataatctcttatatattttggcaaatttggcattaaatttggaaacaaaaaattggacatgactaaatcaaaaacttctatgaatttaaaataaagattattaatcactgaatgcctaagcatgttttagtaatgtttagtaatgttctcaccatggttttgatttttgaggaccttgtataaccatatatagttacaaacataaaaaaactggctttagcatatgctcatctatgtgccccaggtttgattacatgtattcaaatatctggcattcttaccaattatccgacagtgcactggggatggcatgagcactggaccccacagagattcatctgcatttttgcttttgaaactttggagattttcttcactcactagtacatgtagaactagactattaagcagcagacataaatcacaccacttctgctatttagctcgatagctagattttccattttacataagaaagggaaaattgtttaaagaaaaaatagtaatatcatttgcatatatatatttgtttggaaagtattaatattgggagagtgagatcatgttaagatttatcttgggaaatagggaaatactaggacaatgaaaacacagggtaaacttgtatagtgaatgcttatcattttatgctgccttggcatctattttaaatataagctggactttgttatagcagaagaaagattcagtcacccttgacacacatagtttccaattctatactctacctccctgcagcacccccgtttctcagtgtggtggatcaagatatttcccttatacacctgctccctgatcaccacatccctatgaaacgagtagatgcagcctgctggactggtcctgctgaccctccaccctgcatggactgtgcagacacaccacagtgactgcctctcagtcaatgcttgacgtcctggaacttgtgcctgcttgctttaaaccaaccagttaaaatttcccacgagaaacctgtttggataacgccctggacccataaataaaggcactggcccgcaggtcccattttctctctttctctttctctctctccatgcactcctaacctccgtgtgtgtggcctctgtgcattatgtgtaccccttcaggaactgtaagtaataaaatctttatttccatcttgagcctgtcccaatcattgaaggaatgctctcatcttaaagatcctaaattaaaattgacattacatgtgaagtgaaatatactttgaaatatttttggacattataaggatttactttcactatttaacaaatctattatttgtcttgttataagtattgtcttattatttttgttattttttattttattttaattaattaattaattaatttgagacggagtttcgctctgttgccagttgcccaggctggagggtagtggcaagatctcagctcactgcagtctccgcctccccagttcaagtgattctcctgcctcagccttccaagtagctgaaattacaggcacccgccaccatgcctggctaatttttgtatttttagtagagacggggtttcactctgttggccaggttggtctcaaactcctgacctcaagtgttccgcccacctcagcctcccaaagtactgggaatacaggcgtaagacaccacgcccagccataaatcttgttttataagaagataaataataatggtaataagtatttataacacttaaaagtattcttttaagtgctttacaggtaattcacttaatcttcacacagaaaatacatataatgctttacctgtaactcaatcttcagacagaaaatgttatgacacccatatatttgttacaaaaaaaaagtatttagcttcaaaccgactttgtctccgtgctgtggtgcaaaaagccaaaaccgcactgggcatcatcatgattttacagatttagcatacagccttaggcacactgctgcttgctggcctcacaaagaaaaaaaaaatctgtggacaagcattattttcttcctacagaggagaaactgaggctcagagaagccaaaaatacactaagggatgaaaaaacttatctgaaattaggatctggctgaaacgaaatcctatgtgatcttcattatgtccaagaataacaactgtagtatatttgaaataatgagactgtatgattctagttgctgaacctcaaacaaagcaaagtggaaaaggaaaagctaaagtgaaaggtgaagggcttggctagacatagttccctttgtgggaagaggagactcaagcttcccagtctaagctcatttacaggtactataaaatcatgaaatataggaaccacatgatggatttatgaacccaatactgtaaacgagttaatagagacaccttgaatccagataaagagtaaatttagaacaaaaaaaagtactacttcacaaagtggatattagatacacagaacatattatcttaagatacaaaatttaaaaactaacagaatttaaataagtttgttcgatagtaaactcgttctcaacactctttagaggaagaataccttatttaacattctatcctttatgtccaagagtgatattaaaatagtcaacaattgataagtataagcccatgaacattaagatagacacccagcaaatcagaatatatgccagtcaataagccaacgaagaggcatcaagtgaatgtcacatggaaggacagggcatcaagactggtcacagccctacctgtgtctatcaaaatgattggcacacagtagaccttgaatacagttttgtttagtagaatgaaggacaaattattatgaaaatctgaagaacattcaaattaaggaaagtacaaccaactagtagtatactgagtgaatggctattaaacatccatcccaatgtaagtaacaggacacagcagaagacatgctacctgcccagatcatcctatgttgcgaggttgaaataaaaaagcaaatggtgttcctcatcagttgtcaagttatgctgctatcagaaaacatggaccaaattgacctgtggtctaaccacatgcagcgttactgtttaaattaaccagccttctgtgacaagtaattcacacatgtcagtgttagtgccttttaacaactaatgtttgtcaataatcattaataatcagtaactctgaatctggatatgaatgcttctcctcatggcacccatatatatttatttgtttgatggagcatgtctttatgagggacaactggtttatcaagcaaacatgccaacctctcttttcctagtctccaccaataaagtagtaagcagctataagggtccattttttacatttgacaaatcaggttgtcactttctttttacacagtagtgggaaagttaaaaaaaattctcagctttgattttcacctccatattcaggaaagatatgtggctgatgctgagtgaaataaaaatagcatgctataaacttgcaataatgatcatcattttaatgattaactttatgtaatgcgatgatttggtctgattaatattacaggcatcatactctagaaattatgaaacaacttaattttctataattaaaagcatgatgtcaactcacttttagattgcacataggcaaagcaagaataggttataaagtataatgagcagagctcaaaaccagcatatattaaattctggaataacttctaataagccaaagtttgagaagcaatatgaagaaacaacattctttataaaggttaccctctaatactaattgaccatttatccattctatatgaacacaaaaacctaaaaatattatttagaagcaaaattgtttagaagtccactttggccagtgataaacctagaaaatattatctcatttcatcactgttaaattattggatgtaccagaaacattcagagccatgtggtaagagcacgctctatgcataaatctaaccaaacatttgttaaatattatgtacaaaaatagtgctgtgagctacagttaaaataaactctgccttaaaaatctcatagaagcagaaaatcagcatttgtaggtaataatgtatgacaaacattatttgcttgacccaactttagtcaggtttctgaaccttttcctaagcccacttgtgtgcttttttgtaaaatccagatttagcaataaccctgctaagtcagtttagcaaaatccctcacccttgatatctaatcatcttcaatatctcatcaggtacctcatcctccactatgacccaggtgatgtcttaccctcgcctgtcttctgcaagaatcctgttagattgatttagccaacaggattaagccttaccttgatgtttcctttcagtaatattttatctactaacccgcaacctactccttggctattacttcctacctccgcattctgtatttggagtttaactcgcatttgggggataaaaagtgtcatcagatattgataatggagggttcttgctaaaactgcactttatggggaagtacacaggtgggccttggagaaggtttaggagcctgattaaaatttggcctttgggaggccaaggcaggcagatcacgaggtctggagatccagaccatcctggctagcacggtgaaaccctgtctctattaaaaatgcaacaacaacaacaacaacaacaacaaaaattagctggggtggtggcgggcgcctgtagtcccagctactcaggatgctgaggcaggagaatggcatgaacccgggaagtggaggttgcagtgagctgagatcgcaccactgcactccagcctgggcgacagagcgagactcagtctcaaaaaaaaaaaaaaaaaaaaaaaaaaaaattggccaagttaggaatctttgtcatgtgtaaaggcagtgtacttgaatggcacataaatgggcatttcacctagcagtagtgcagatcaaggaagggcagcattgctgggcatggtagctcaggcctataatctcagtgctttggaaggttgaggtgggagaactgtttaaggctatgagttgaagactagcctgggtaaaatagagaaacctcatctctactaaattttttttaaaaaatttgccaggtatggtggcatctgcctgtagtcccagctacttggaaggctgaggtgggaggatctgtagagcccagatgtttcagattgcaatgagctgtgatcacgccactgcattctggccttggtgacacagcaagatcctgtctcaaaaaaaaaaaaaaaaaaaaaagaaaggacagcatggaaaaggtgctatataagctaatcttgaaagaaaagtaggaattaatcactggaaaggaattagttactaggaagttcttgtatggaatccattctctctctttgaagaagtgggtgtggaagggtaaaggagtttatctcaagaagaaaagaaggaaagcagcttggttaaagctctatgtaatatgtaaacatcctactgggaaacaaactattgtcatttataagtggaagagtccttaccaatggaatgcttttggcatggcgtatctgttagtttaggattgctatagtaaacaaacctggaaacgtgaatttagggggcatagatcactataaagagtaatgcaagttacataactatctgagtataaattagatgtctcataagtgaaacaagttttttgacctaagtgatggagctacttacatgacttagagaccacatgttaatctggtttagagcaaatcctaatgcagcaagatagaacctgaggaaatctgtgggcagtggtcctgcacttcttgtttacctgagtttgtttttaattgtatccttgaagttaataataaagtttgatacagagtgatatttaattcatatgaatttgatttcacaatccaatcttctagttatcttggttaccaaggacatgaaggagggtaaaggaagaggcatcaaactcggcccattcacacttgatctcatattctttaatttactaaacagttttttaatatttagtaatttttgacttattttattttgagtggtgaaatgcagaacaatttttatatgttaattaatctctggcctgtacaagcaaattctgcaattattcttttaattaggcaaaaaaagtttgctgagaccacaaattgacattccttcttttagtacctggtatggtattacaggcttcattcacatatagaatgttttcattttaagttttttaaagttgaagaatcttgaacataaagaaacatttaaccaaatgagagttgtactacacattggataaatatagtcgtcccttaactgagtccttactaattttattgtgtcactattgtgctgcaaaacccagatatgcaatgtaaggaataatttagaggcttaaaatggcttgacacaactatcattaaatacatctcttttaacaagtaaagggttgattttttgttgttgttgtttgttttttgagatggagtctgactctgtcgcccaggctggagtgcaggggtgtgatctccactcattgcgagctctgcctcccgggttcacgccattctcctgtctcagcctcccgagtagctgggactacaggcgcccgccaccacaccccgctaatttttttgtatttttagtagagacggggtttcactgtgttagccaggatggtctcgagctcctgacctcgtgatccacccgccccggcttcccaaagtgctgggattacaggcgtgaaccactgcgcctgaccaaaaagagtatttttaaacactattcatttactattgatgacattttctttttttattattattatactttaagatttagggtacatgtgcacaatgtgcaggttagttacatatgatgacgttttcttaaacctaacacctattttcttcatcttaggttttgatggattcaagcctccctggcagctgttggagtatctcacaaaactacgttctgtgtaacttggtgcctttgtagttcctcctttaatcttaaaatgcctccatgtacaaattctttacaaattaggatcatctgttttctgccacctgctaatactctcggattctagtaatttttattattttttgcttttttatatattgcttgctcgtatttcctttttttttttttttttagttctcaggtatcttttaagagactgaaaactagggataatttacttttttcagtctacttttaatgttagattgacataaaaatgtgacgcaatattttttttaacagtttaaaataaaatgtgtacttattccagtctatcattgttggacatttgggttggttccaagtctttgctattgtgaatagtgccgcaataaacatacatgtgcatgtgtcttcatagcaccatgatttataatcctttgggtatatacccagtaataggatggctgggtcaaatggtatttctagttctagatccctgaggaatagccacactgactttccacaatggttgaactagtttacagtcccacgaacagtgtaaaagtgttcctatttctccacatcctctccagcacctgtggtttcctgacttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatcctttgcccactttttgacggggttgtttttttcttgtaaatttgtttgagttcattgtagattctggatattagccctttgtcagatgagtaggttgcaaaaattttctcccattctgtaggttgcctgttcactctgatggtggtttcttttgctttgcagaagctctttagtttaattagatcctatttgtcaattttggcttttgttgccattgtttttagtgttttagacatgaagtccttgcccatgcctatgtcctgaatggtattgcctaggtcttcttccagggtttttatggttttaggtctaacatgtaagtctttaatccatcttgaattaatttttgtggcacatatacaccatggaatactatgcagccataaaaaatgatgagttcatgtcctttgcagggacatggatgaagctggaaaccatcattctcagcaaactaccgcaacgacaaaaagccaaacactgcatgttctcattcataggtgggaattgaacaatgagaacacatggacacaggaaggggaacatcacacaccggggactgttgtggggtggggggaggggggagggatagcattaggtcatatacctaatgctaaatgacaagttaatgggtgcagcacaccaacatggcacatgtatacatatgtaacaaacctgcacgttgtgcacatgtaccctaaaacttaaagtataataataataataataataataaagaaataaaataaaatgtgtacttatttaaaagctatcagaaataattttgagttgtatgtacatacgtaaaattatatattttgaaaatttcatattaacttaaagtcttcctatgaagttttcaatgcttttaatatattggctaattcaacatgcctcactggtctgccaccttgaatcaagggctgcactatatgttgagtcagataccaagttgaattcatcaatccaataaagaagcttgtatttcagtttatggaataagtataaagtaataagtaccctatgtgataaattctattaacagcaggaagcataaaaagcccacagaaaagagaaattaaattggtagggaactaaggaagccttcaagagaaaatgacatttggagcagaccttgaaggatgagttcacgtgtagtagttaggggctcccctggtactaagatattaagtacacctctaagactttatgatgacagggggatgacacattccaaggatctgtatatgtttatctttttgaaagttgtgaaaattcagtatagtatgaaaaggtagaatggaattttagaatttagaattttagaaaaaaattttaaaattttttaaaaaatcacttttaaaacaatgacaattctttgtttttatgttaattcatgtgtatttttcatttatgtctttcgaatagcatatacattgactaatgtgtgtttaatagattatacaaattactttttaatattttcattttataggacaagaaaagatattgaaaagcggaggtgaatatttttaaatgaagaggggcttctaatgttcacctaaaaatgaatgaagtagagcatacagatctcttcccactttcaattattgccaggcagtggccaaagggaagttcaactcctttgtgacttctgacagcaagaaagaaccataaaaggtatttcaatgcaccttcccatgttcacagaacaattatgtcttccctctttccaaagagctgagatagaagtacaatgtttgatccatgcccatctgaaaggatgatgaagttcaggttgtgtgaggacactaaaaagttcagcaagttggcaaagtggtccaaggttacaggaagaattatgtcatttacattgaacgggtgcagcagaaaaagactgggctaataggacaactattcgtttgggcattgccccagcaaggtggttattaggttggaagtgaaaaaaacccacaaaagatccttgaatggaaagccaaatctcaccaagtgggaaaggaacaggacaaacataagatagaaacgatagagatggtgcaggaataaagtagtcttatatacaattttcattacaaactactaaaatgaaaaaaaaattaatagagtaataacaacttgttgttattaaataaggcctgacagtgacacaccaggtaaaaaacgttcacttttaatgaatctgtgggcttatctgtgaaaatacatacatacatatatatatatatatatatatatatatatatatatatatatatatatatatatgctgtgaaaaaaatatatatagaagattagtaaagatttcttaaaagcatataattttcagctcctcagatattcctggtcaacataatgcaacaacctccttcagaattttgaaaatagttatgcttttaaaatatgtaatcttaaatgggcacaagcttttgttggctcctggcctatttgcagtcttcttttttttccactcaccatctgaattatcacatgtactgtagaattctgacaatttcacctgtcagtttctttatactcatgtcttgaatatggtagattttacctcaccaattggctggggatacattaattgcaatttgttttaagtgtaatatttatacacatttctaaaattttcagtatagagctgtcactctgtgaagaaatagagccttcctgtccagattccacatcattcatatatatttctctgaatgttaaaaatataaaatgaggaatggaaaaaactttaagaagcatataattacaacactaattttatagatgggcatactcagactagaatgtaaatcaagaaccaagtgctccaactgtaattcctttttgactattccattctaccttttcatactacactgaagtttcacaactttccaaaagataaatatatacagatccttggaatgtgtcatccccctgtcatcataaagtcttaaaggtgtactttaatatcttagtaccaggggagcccctaactactgttaattagctttttgtgcctagagaagattttgtgtgagtgttcgttttcagctaccttcagagagcaaatcatgtcaacatgtctctgattaccttccatgaagaacaccaactcaaatgacgtgcaggtgccaaacgttgaagaactgctgtaagcatcacttttagtaaataaaattaaatttgtcagcttatgggggctattttctaaaaatagtcccaggttcatatttgttgtaattaaattaaaactagaaaacatcagttatctgtagaaaatacatgtttaggccacgcacggtggctcacaccggtaatccccgcactttgggaggccgaggagggcggatcacaaggtcaggagatggggaccctcctggctaacatggtgaaaccccgtttcgaacttaaaaatacaaaaaattagacgggcatggtggtgggcgcctgtagtcccagctactcaggaggctgcaggagaatggcgtgaacccgggaggcagagcctgcagtgagtcgagatcgcgccactgcactccagcctaggtgacagagcaagactccatctccaaaaaaaaaaaaaagaaaaaaaaaaaagcatgtttagccataagaaattgatgacaaaactatccatagacatagctttaacatggtcctttgacattaaaaatatctgagaagaggcctataggtcatgccacaaaaatgatctattatggggtatgctgtgtggtggtggaaaaaaatcaggtaaaaggcacattcttttaaatgttgtgctatttcaaagttgtagtaccagatgaagaaaaatttgatgaacagactgagcaatccggtattgttatttttctaattaaaataataaagtagcattaattatcaaaacagttaaccctctcaatagctaaaacatgtaaaaactgacataccaaagttaaatcagttaccattttgacaaacaaacaaagggaagctaaggcgtaccaggggtagcatgcaggccccataaaaatgcagcagaattaaagatcaatcgtgttttgctcctattggaaaattgaatatgtaaataacagatctttgaaatatactttgtgtgtgggattgtgctattaaaagtaaatttgaaaccatcctcttctcggtaataattaataagaaatataaagtccttctctaaccttatcctttaaatttatcaactctagcaggtctgttgagttctgaccttcatgcctccttttagggattcccaactgcctaaagcatccttgcagttctatctgatctgtcaacagcttttaataccagcattttgggggattctgttatcctgtgaaatttaatctcacctatttaagcttgcagaaagtactggagggaattattaacagattttccctcatcttcttagaggatagtgtcgagtgattggctggtttccctaaggacccatggctgagaagcgctagtttgtcagtagcatcctatttagcatgtgtgtgaggccacaagggagctggaaagacacttggaatcagaattacatcaatatgctgatgatgcctgcatatcttcatttcatcaaacctatatcctttagtattaatgctttcttagccaagatggaaagtacctccacacagcacactgtttgtgactctaattagacagctggaaagcatgttgatgatacatcagagcagtggaccagcaacctcagcatcacaaggaaacttgttaaaaatgcaaattctcagacccaccccagacttactgaatcagcaactctagggacagggcccagcaatctgtgtttaacaagccctctaggtgacttaatgcaccctaaagtttgaaaacctctacattagagaaatgggatgtgtttgtcactacagagtctattggatgatgtctcctacttttgtggattaaaacattcctgagtctaaccatatagttcttggttactaaccacataatatacatggtctcaaacaattccatgtgtatggttaagctttgtgcccccactcaattctcattttgaattgtaatccccataatccccacctgtcaagggagaatcatgggggtggttcccccatgctgttctcatgatggtgagtgagttctcacagatctgatgattgtataagtggctcttatctttttgctcagcacttctccttcctgccaccttgtgaagaaggtgccttgctttcctccatgatcgttaagtttcctgaggcctccccagtcatgctgaactgtgagtcaattaaacctcttgcctttataaattacccagtctcgggcagttcttcacagcagtatgaaaatggactaataaaccatgttaaatgtaactggcttctgtcataattcatatttgtcactaaaggataagtaaacttcatattgttctgtatttccctcactcagagaatgagaattagactgcaccatcagacatatacatgttgacatgcctaatggtgaggcattttactgacaaaccatgctatttccaaattacacccaagagtccatgaccattaaataacacacatatttgacgacatctctaaatgtccctgtccctcaatcttcactgactctaaagaaaccaaatgtggctgaagtttttactaggggagacagtgtaggagaaagaagacaattactcaagaaattagggccaatattaaattcttcatattggctaaaaattatgtgctagacctaacctttcaaaacctgtatcttaaagtagataatgatattggacctgtactctcctgactttccagtttcatgagtgttagcactgcaatattttggctcctcttttgatgtatacaaaaccaagcaatggccataaaggattaacactgaaacttctatgaatgccaaaagttcccagtccttacatggtattacccctggtaagagaatcaatcctgaaaactttgcataatctaatcatatattacttattattccatctctccaagaaattttgcctataattatgagatgaaccttcaaaggcctactgttataatatttatctaacttggaaggtattagcccgtgtaatgctagaaagccttcggtgctgattccctccagtaaatattcattccacaattattggttgaatcttttataggtagcacccaaggtgctaaacaggcggaaggtaaaagtgacccagagagatgatcatggccctttctctcatgaagctcaaggtcaattagttttaatatcatataaaaatttggttaattgtaagctaataataaaataattcaaacaatctaacatttgttcttctagttttaattaagaccagacccatttgagttctactaagctctactgcaggcaggttacctattatctcaaggatctgttgcttctcaacactttggtaatcaagtttcaggcagctgagctctggccttccaaggtgctatgcctctactctgatcctgtgcttcttgtaatctactcacattaaccaatagctcactcttttacttagcccctgactagcctctctgcttctgatgccactccactatagtcaattctcagcagagtagccattttaaaatttaaatcagagcttggcacttctctgttcaaagcagcccagtgatttttctctttcaatgagagtaaaagctaaaggtcttatgaatgcctacaatacataatccggtcagccacattctgtcctctcttactctattctgatgatactggcgttttttctattccacaaatccagaagacttccacaataaagggtgaaggcatttagcttgccatggaatgtttatctcctggatgcctactttccctcaacttcctcatctctttgttcaaaaatcatctcatcggagaggtcttccagggccaccctgtttaaaatggcaaaccctgccttctcttccaccattatcctcatctctcacacactcattatactcctatattaatttttctccacagttctaattacttttcaatatattatttatgtgacagtttatttgtttaattattgggtatcttctgtcactaggtacaaattccatgagggcatgaaattctaactggtttgctgactgttgtatctaagttgcccagaacaatacctggtacataatagatgctcagtaaatgtagttttaataaatgaatgaatgaatgaataaataaattcataccgctaccctcttcttatctggtctcagtttgtttgtgtcttagttctacctaagacagaagaaataaccaccattcatttccagtgacccttgcaaatggaagatgactatgatataaaatgtgaagtaaattgatattgccaatcagtgtcatcttccccttccaaccctcaagaagtcacctttggtaatgaaacttttctaacattggaatcagaaggataagacttaatatttaaaatgtttagttcaaaacctatttctcaagtacaaactatgtgccaggtcctgtgctatgcacaggaatacaaagatcaaaatgtttctttctatgtgtaaaaaaaaaccatgattacactaattattgcctaagactgtatcccaggaaaaaaaaaaaagaaacctatgatcataaaaactaccttggattttataaaaaagtctaaaaagggtagattggatggagaaaagtccagataataaacgtggaatttgaaactcagccatgaaccaatggtgaccctgatattttggtaagattaatttgtaatgtgggtaatctacatatgacaaattacctattgactacagctataattcttgcctagtatagagactccaaacacattcaggcattccgaagcaagtcaagttcataatactgatttgatttaaatgagtaatttatctttctataaatacatttggttcttgttctcagaactaatattctttataaggtattatatttctctaatagcattaaaatttgagaagtgtgtagtacatgtaaatagccgatacctcacccaagactactcaccagtcactggtaagaatgaaatgattttaaacatgttattattactatttttttgagacagagtctctctctgtcacccaggctggagtgcagtggcacgatctgggctcactgcaagctccgcctcccgggttcacgccattctcctgcctcagcctcctgagtagctgggattacaggcgcccaccaccacgcccggctaatttttttgtatttttagtagagacggggtttcaccgtgttagtcaggatggtcttgatctcctgaccttgtgatccgccggcctcagcctcccaaagtgctgggattacaggcgtgagccaccgcgcacagccaaacgttatttttagtatgctaactaactactaattttgagtagtgcttatattagagcactttaaaaatatacatgacacccttttctttctatttgcttcacaaataatgaactgactgaaagtatgaccaaggtatacatcttagaatgcagtctgtaaattggcttacggaaaattccgtatgtgtcttattaccacattcttctaatatgcatacattttgtgaagagtacctactattcaggatatggaagacttagcactttacattgttactagttacatagaatacatttcaagcatattaacactaacaagaagcccttgagtattgacaaagattaaatttctcattttacccaaatcagtattacaaattttcttttacttggaatgtctgaattagaaaagaaacaattatgtgtagccctgaaatttttaaacttgaatttgacaatttcaacattctagcgatttaaacattaacagtttcatctcctaaaatctgttggagtacaactccatattttctgatggttccattttacctcctcagggacagctcttatattaacaaagccttttctgaagacgatgaacacacggcgagctccacaacgtagagcagatgttgcacagtcaaaggcagtgtctccagctccaagtacaatcacgactccccgtatcgatggcaatggagagtgacaggcgcacattcctgaatgatgaaaggaaaaccccattttcaagtagagaaaccatttctgcatgacagctcaaaagatacttgtactcaaagcagtgtaaaattgcatcttgcagttttccaggatgaagtgtcactatcaaattattctgcttcattgaaagacagttttattcccattttaaaaatatgctcatatatgtaatttcatagtcagtatctttagtttcttttttcttctaggattcctacaacacattttgagaagtttaggtcataacagactggaatcaatcaattaaaactctcttcatcaaaattgtgctatctatctttaactcagcataattttccttttgctagaagaaaaaagtgatccttatgatctgtgttaacggtttgcaatatttcattataatacttttttatgtattaccttatataatttctaacacatacctctgttatatattttgttaactttgaatattaacgtgctgaataagtgtcctttatgtaactgaagaatttctgagaactattttcttgaaatagttcaaataaatctttctccctttcactgctttcctctggttttgtttgtgaaactgggcagtaaaagaaatatgactttctaagcatccatttctcaaggtcatctctattaagatttgctgtccatatgaagatccttgtaaaaaaagtaaaatgcaagtattccttatgtgttaggtagcagtgtataataagattaaataaaactgtttataagatcaattactataattttttaaatggtaccaagaatagaataaacctataatttcaataagtgtaatcattttgcttggaagattttgtatttgggacactctgtaattttcaaatacaagctaggtgcactatgaccttcctcagaaagggtttcagacatacaaacatccagttctactgagaggcagaaggtggagagggtatgcatctttagctgtaaacttctgaagaataatttaatatagaaagtttcttactgttttaagtcctgggagaagcataaaagtttgtatcatttctacatgtaattaatgtaggaatagctgtggctcagacctctttaaaaatatacatttgaaggatttagattatctgactttggataaaatattacaattttccccaaagacaatgactctggtcaggccaaaccaaggtacaaccttcattcaggtggttcttcttggggtgtataaagtgatagggtgtctatcaaagtattttattttaacatcataaaattactgtttaagagaagacagtcaatctttctgcctgtgtagatacaaatcatataagatatgtgacgattcatgccatttctttgaaaaacatcttccaatgtttgttaaggacttgcttaccttgaagcaatttttcatgatgtagtttagacatatatattacagtgaaaattccttacgatgatactttattggaagaatgaacaaacagatgattctggcaaactgttatacccggcctttttttttttaattttacatttgggtcttaggcaaggttgggtgtgagagctgaacaatgtgctgctgagcttgattttgatattaatttatcataaataaaatagcatactcactattaagcataaaagacaatatgttatacctgctttactgcctttggctacaagtggcaaaaagtctttggatgtataaaacccctggtcctgcgtcaggccttggaagatggcatctttattgggttctggcaaacctaagtaatcaaatttataaaatatcattagcaggaggaggggcttttcctattagatattaaaacaaaaaagaaaactttaatctttgaaataatgtcattcttagaggaaaacatctgtaagcaaatcaatataaaatgtacataatacagtctaacggatctcagagtatattatgtatatctttaatatataaccaagtacacatcgtaaatcacacattaatgtatacctataaatatatggaaacatatgtatatacacacataaacatatataacattacagggaaaatcaggttatattcttgcctcatatcataaataagtcagtttcagctacattaaagtactaaatataaaaaaagttaaaaatgggtacatatttatctaattcctgaataagtaaaatcatttcttttttaatgaaagaaaaaaattaaaggaaaaaacaatgtattttgccacaataattcaaccactgctaaatttaaaaaatataaatgaattaaaacgaaaattattaaccaagaagatgttttaataattaaatgtctttactgtataaattctccaaatcagtaaggaacatattagcttttcaatggaaacataaagaataataaaaattgggagaagaaaaaatataaatcacctataagcactaaaaatattaactccattaagtcattaaactgcaaattaaaagaataaaattgtaacttctctataaaaagaaaaatatttaagaaaattaaactatacaccaagggtagacatggaacttgtcatactctttcagtggaaatatacattggtgttcaatatctagaaaatagtcttaaatctatcttaagaaaatactgacacatgcaaataaaggtttaatgcacaaaaatgattaatacagaaagaggaaaataagatgagagagtaccagaatgtcaggtaaatgaagaaattagttttaccgtataaaagaaaaagacaacagaacgaatatttgagaaatatggtataagattgtaatcaaaatacagtcttaaatgaacctgcaggattcaaaactctgtatagtataattcaaattttgtaaaaaaatgtattaatataaaccatgtaatctaaacagagatcatttagagtggtggtattaaggatattccaatttttattatttccttattttccaaattttctacattgtacatatatcaactataaattagtaaattcttaccaaaactttgaaaggaaaataaatggcagactaaattttttccaaagtgtaaatgaagaaaatcttatagcagtcaccccatccaaggcaagtagagaaataattcatctcaattccataaatgcaggggaaaacatgtagttttattttattactaagactcattctaccaatgggtcattctagagaggcaggagtttattttacaatgaaatgaagggcaatggacatttgctggtagatacagagtaataagcatagccgaaggatgacttttgtcatatgagataaggtgggtgccatatctgatctgaaagctgaaggtttctgtgggttgcctgtaatcagcaataaaccaccattgtctcttcagattaaaccaaacatttttcttccccatccagcatcccctgaatctccttttccatagcatttgctcataaatgattttaaaagaacttttgctttcaaaatgatttccattatgtagtagcatagttaggggagccacctcacctgcctttgcctcagcttctctgtaaaggaaatggggataagactgtttcccccttttatgacataaaaaggtatattagtaacagaaacaattatataaatgggtggccgtttatgtgattcttttagaaaacctgggttggagggatggggttggtaaaaatagctgaatatgttcttgaaggctctctaatgacaaaatgatttcttctgaaacctgttaaaagaagactgaagttaggtctacatttgactattcaaaccaacatatacatatgctacatataattagcttttctttccagtttatttagccacaccccaggtcacacatagggcctcaaggtccacggagccctcctcctctacctgggtgacaggtcatcccttctggccagggacagtgcatctgaaggtctccatgtggatactttgatagtctatgctaatcatagtgctgtgggatgatcagaagcagggattttgtcactagacagactttggtatgagtccttcctctctcatttaccagttctgtggtattgtataagttcctgtgaatcctgtgaaggttagggttagatgtcaatttggctaggctataacacccgttagtcaatcaaacactaaggtaggtattgctgggaaagccttttgttgatgtgattaatatctacaaccacttgactttaaggagattgcctcaataatgtgggtgggccctatccaatcaattaatcaaaaggccttaagaacaaaattgtggtttccctgaggaaggagaaattctgtcttaagtctgcacaatcagctcctacttgggagttccagtctcctgtcctgcgctaaggagttggacttaccagctcccacaattaaatagcccaattccctaaaataagtcatctctatctacccatctgtccatcctactaattatgtttttctggagaaccctgaaattgattttccactacttcatttctaaaaacagagataaaaattctacttctctcatggatgtgagattttttaaaaatgttaaaaaaattacaaaattatgaaaatattaaaaatatatccatatggataaaccatatatataattgagagctggcacatcgtgaatactcattaaacattagctattaatattaagataggtttattctataatttatcaattatttcatacttcatattgcatggcaaggaaagaataaaagcttaaataaaaataaagtattaaaccttagcatatgtaaatcaagttccacaaagaaagaaaaatgaggcaaccttaagtgaaatatgaaagaaaatgaaacttgcaaatagtcatctatcaaaggaagacttctctgagagtaggtggcatattaataaataaggtatgtgtctatactaggatgatttcaaaatgacactgaaatgactttttaattcacctttcagtgtgaaaaagagagtttatgaataaagatgaattgacaaagatttgacaaacaaaacagttcagcgtagtagatatgtatagtctttgtctttcaaggaggccggatagtttgtttctttagaatagttattgaagtttttggtgttttagcatgcatttatacaaaggaacacctccttaagaattatttttaaatggtgattttcacgttctctgaaaaagaagggagggagggagggaaggagggagggagggaggaacgaaggaaggaaggaaggatcctgcttatgttacagaaaatttaaattaacttttattgactacagacactactctaaatgcctggcccccaggtgattattatataactcattttaattctcaaaataattgtatgaggcaactgatgttattatccacattttaaatatgaggaaattgaggcatatagggattaagtaactcgctgaaggatcacagaacatgtaagaagcagcgccaatttctaacgtggacactggttgtagagtctatgttatgagttcaaaatggctgcctttttcatgtttaaggttataactaggccaggttataatgtgaagctacataaccagtcctatctaaagtaatcattcaacatgtatgtattaagtttctctacaaggctgcagatatgcgtacctcacaggatgtgtctgcagccaggttccaatctagtgacagagaaaggactggctgcttctcttgtcagcatttttgttttgtgattattttctccagtacaatccctttctgaaatgttttccttcttaagtgaattcctcttgggtatatcctggttatttttcactatttgatattctttgaaatgtgtatccttgcattgttgccaaagcacctccctctggaacaactacagaataaataacagcagtatatatagtaaattctttccttgtgctcacataaagttttgcacaacttcagttaacatgaacaagatattagatgttctgttacatattaaaatctaggaagtaataagagaaaaaaaaaagcttttaaggctttgctttcatagctatggtagggcatgtttaagaattactcagattctataatgtttgcttgtgttacttcaccaagccacttgtttagtgttaactgaatgatgcaagcatttgtgtgatgcttcctgtccttgaaaggattcatctgaatgacagctaagccatcatgagaaagacagtcatctttggagatagactcacaaatcccaggtgtgaagaagatagcacagaccacagagaaactacctcaggtccctggccaaaggctgtggctcacagaaatgggtgatgctggccagtcacggtggctcctgcctgtaatcccagcactttgtgaggccaaggtgggtggatcacttgaggtcaggaattcgagatcagcctgaccaacatgacaaaaacccatctccacaaaaaaaaaaaaaaaaaaaaaaaaaaaaaaaaaaaattagccgggcgtgctggctcatgcctgtaatcccagctattccagaggctgaggcacaagaatcgctgcacctgggaggcagaggttgcagtgagctgagatcgcaccactgcactccaggctgggtgacagagtgagactctgtctcaaaaaaacaaaaacaaaaacaaaaacaaatggacaatgctctagtatactgaactctacaggaacaccaattcttattatttcacacaggtgctttttcaataagactttggtagacaaataaaacaacactgattgtcactactctcaagttttctggatgagatcagcaaaatgtagctgatggcaaataccgtaagtttttcaccttccaaagtacttttgtatgtgagatctcacatgttatgttactcagtccttattttctaatgctggcttgggaaatggtgctgcattagggacagtattaaaatatacagattaaacatgtatttatggaataaaccaggctaacttccccctctgtcttagtaaaagaaaaatccatgtaacaacttttgtctttatttttgtttattaaatcttataaaatatcttaaggccgactgacctatttgtataattatttgtaaacagtatactggataggactgaaaactctgaagtcagacttcctgcattaaaattctagttctagcacttactagctattatgaccttggccaaataaattatactttctgggcaacagcttcctcatcacaggactgttgggagaattaacacgaaaaacaggtatataaagctctttgcacagatgtgaaataaatgtttcctttaattttctttgcttccttaaagcctttgtttgacttaatgaaatgatacgtttgagtacatataagttaaatgatcatctaatccatgatatacacagtttatattattacatatttaagtggtcagtattggataggtagtatcacagtccacgaaacttagcatctttggctaaaatgaaaggatgtagccacataagagtattattctaacttcattcattctatagactacaatgaactccagctacatgtgcatcaaaacaaggaaagtattaacagcaagataaagtccactcctgctcaaagtgtcattcaaattggagcattaagaacaaaatcatgtctcagacagcattgacctagggtctaaagaactgggttctaatctcattatttccattttctaactgtaattgaataaaattgcttaatcctgtggctttcaaactccttgattttagaatgcagacaaccctgcttactatacagggttctttggaaaattaggtagaaaagtgcacataaagcatgctggtaaatctaaaataacattaaaatgtaagtcattattactgtctttggtaaaatataaaaactatgggggaaaaaggcttacatgataaagagattcataataaacactttcaaataaagaagatattgcaaactaatcataagccatttgggtggctgtatacaggatgtgtaaaagtaggtagaaaatcataaatatatgcatctatgtatatatatgtttatatatgtattagagaagataagctattcctgattcaagcccaagcagttgagattacaatatggaagtaaaatattcctttcaagtgtctaactaagcatgtcgcagttccacaatggattataaagtgtttcatctgtcacttaaagatcactcaaaggatttatgtcttacttctaagggacaatagtgccatatgggttatcattctaggatctatatattgatgagaaagagaatagatcaatgatggcctattgtggttcttttctcaataaaactccccattttcttcccgatgtgctgctgtaaatgcgtttagtactgagtgttcagacagaatgcagaaaaaaatggagtgattcaatataacacatatgaaattagatcaccatgcatcacaataatattcatttcattgatttttgaaatccccattaaacatctgtttcatataactgctgtctatactctttctctaaatgtgaccacacacattaattgtgtgtatcacacaattggttagagaataacaagaacatttttaaaaatgttatgaatggagacaccatttaaatagtatttttttccattacacaagattctttttgtacaccagcacataacaataagtccagaaccaagtggattactgagtattattatatcattttgaaaatctgatacatgctgaatttctctttgtatttaatgtataaaacagtacaattttaaaaagcactagaaaagagaataaaataatcaaataatttttatgaagttatagtatttcaattggcttctatacttcatgtagaaaacacacaaattctatcgtgccaatgtaattacttcacctaacttcatgttagaacttatatcagacttcaatttagaatatctacaggtgagaaaggatgtgaacatattctttataacaaagcaatgaatgtattaagaagtacaagtacacatatgaaatgaattgaatttgagtggttgaaattcttatagaggattttttatctgtaataaatgtccagtgatttaatacaaacacaatgagaatatgggttcaccatgcatttttggtctcatactttttacttcctttatacatttggaaaaaatacatagattttattttgtttaacaaaattatggctttctttatggagatggataaaatatccttgagtatattgtacttttataacagatcatgtctatattaggatctgttgcatcttttcttctatctataggacattatgacacaatgagaacaacaaaccctttggacaaaaaaaagaagtacctttttcttcattattattttataatattgcaatttgcttataattagtagaagttattgcaataattgaaattatactttaatataagcatttggtttagttgaaacatttctagaaaagatgttaatgtaatttcatatttcagccataaatttatcctcattactctgctttatggtattatttattaaagtatactttgtctcttgagccttttctcttctccttttctttatttccctcccttctattttctctgtttctttttctcatttggcttttgctataaaacaatttccttaaattttaatccccgcattgtgaagtaagggtaagcaaaaatctcaaacaatacgcctcaggcaaagattttttttcttaatgattggagttcttagatagtgttaggaaattactgtttaggactgtgtaagtacactatatcccaaagtaaagaaatcattaataataaaatactaaaaaggaacagttatattacaaaataaatcttccaggcttacaaagaaaacaaatttgcaacagccacctgctgtggagatgaggcagtaatctcaacagcaggaaataaaaggaaagagaggagaaaaatacaaaagcacagacattaaaaaagtaattaaaacacttatctccatcgacatacataacggaaaaaaaccctcaaccaaccacctaaaaacatactctattgaactgcacagtaggaaacagcattaaagctgccaccataaacacacattccgtagaaggaagaagacccctttaaaaatgtaatatcaaaagtattactaaagtgttaatcaccagtaaatgtaactcacattcattgtattgtattagttactttctggaaggcgtttttaaaaattgtacttttacattttttactcaagtaaattcttaaacacaggcactgataacccctttatcagtaattgttctagcaaattatacaatcatattgtgagactgaaacattctgtatttgaaaaactttatgtaataattgttaacatatcatgcatcttgataatggcatttaaacagtttcctttgaagtaaactagcctttgctatagtactggaaaaaaatgaggtgaaacacaatgtatgagttagggtcatggattaaaacggaaatgaaagctaagaatcgttctgaattactcatgtatgctctggccttcagagctctgcaaagtgaaacaatgcaagactgaggaagcaagtggcaggctttaaaataaagaacatgtagcaaacgcgcttgtgactctcttagctgctggaatttgttttctacatctatgtgattttctccaggcatatatgtgaaacgatggagagctgctcagttcagaaggataagatctctctaatgagctcttggctctgttacttatatagctataaatccaagcataaataattaaactttaagcctcagtttcctcatctttaaaatgagaagctacaaaaccgcatctccttatagaactgttatgtggacaagtaagcataaaatagctctgtcatactgaaataattttataggtagaaaatgtaattcacaaacatagaaatttgtcgtgctaccatataattattttatctggtgataatattcatcgatcagtgttatttcattttaattctgcattttcttctttaaatgataaacttctgtgcaaatttattttattttactctaagtcattactgtaatttcataagttttccaaaaaaattactgttctcaatagatttttacaagaaatatgttagatattagaaaatatgaaatcattttcatgcataaatatacttggaatatatttagtattactgtcatattgctgagacttaaaatcacagtacttttctaggaattcagaaaattccacaagaaaatcaccttctaaagggcattcttgatggatgcgcttggtcaacaattccagaaacatgtttgacctttttgcacctcagtttcttcatccataaaataggtaaatcatctagaaatggagttctgggccttgtctgtgttttttacagactccaagactatattaaaacagagtaccttttagaagtatgcattttattgtgtacagagggctcacacttttcatgacattctcctaggatcctgtgactcaaaaataattaaagaatcacatttccccactctagcattaaatcaattacactataccatatccaaatgtcttttcaagtgtacagactatggctgaaaatgccaaatgcactgcgattttccacatctaacaatcactacatacctgttcataaaagaaagaatatctgtttataaaagaagttgtaagaatattgggtccagtgtaagcggaagcaacagtttttaatatcagacatccttatgttcatatcgatatgtgatatggtttgactgtatccccacccaaatctcatcttgaattgtaatctctgtaatccccattaattctcacatgttgtgggagggacctggtgggaggtaactgaatcatgggggtgatttcccccatgctgttctcatgatagtgagtgagttctcatgagatctgatggttttataagcatctgtgatttcccctgctggcactcactccgtcctgctaccctgtgagtaaggtgcttgcttctcctttgccttctgccatactgtaagtttcctgaggcctccccagcaatgtgaaactgtgagtcaattaaacctctatcctttataaattatccagtcttgggtatttcttcatagcagcgtgagaaccaactaatatactacttcactataaatactagctgtttaaccttgcataatcacagttatttaaattttaagtctcagtctcaactataaaatctgctctgctgggatattaaatgagataatatatctcaatagtatgataattgcttagcatactgactggcatatggaaaatgttaacagatgaactgatcttgatgtacttaaagcttaaaaaatctattattttcatatgcatacctttcttgatattttttcttccttgatatttaacacaattattatataaaacaccataaaaacaactttaacaacaatgaaaactatggacactttaaaacattcagtcccaattgaaatttccttgagtattggtgattaagcatacaaaacttggcagtttcattgtataatcattatatatctagttctgaaatttttgttgcataaaattattttaaaatagtctatcatattcaacttttggatctggaaaccagcttgatgttttaagaatcatgaggacaatcagttggaaatacaaatcctaggtattaatttaaccacttattcattaatatttactgaatgcctactacgtgctaaacaccatattaggtgatgaagatacatagatgagtacctactatgtactaaacaccatattaggtgctgggaatatatagataaatagcttctggggtagtaggaagaaggacatgtaataaaaaaatttagaatagagcaagacacctgctatgagagaaggatgcataggttaccacaggagcagttacaaaggcacttcacctggactgcagacaacattctaaagctgagtcttaaaagattaatgtttccagtcatagaaaaagggggagtataagcttcatatacaagggcatgatggggtatgagttcaatctgacaacaactggggtatgatgaggggagtagataggaggagacaggaagaagcaaaatgcgaaatttgacaaataggcagggtccaaactatgaggggtcattcaagtcacaccaggatgtttggattttacactgaggaaacattttaggaaatgatataatcagctttgtacattagcaaggacaaattggtagtagtatatagaaataatttgcagaaaataagaatggaagaaggtggatataaggggatactgcataaatccagataagaaaggaaaacttctcttcttcttcttaaccaggattactagtaacctccactaacatggcattgcagggggtatccatagcttagtataaacacagcttaccctcctggggcaacaatttcactcaaagataagtaacttaaattatagtgttcatattacgacaaatgtagagagactgaaaaatgagatgcaaattttgaatgaaattttaatacttcaaagacattctatatatggcattcaaaactgtgcctccagattccctagaggtatgttttcattctcttctcctattacagtaacttaaatgagaaaaaatagcacttatactaagatactgacagtggggatgcagaagaataaaaatataatctcaatatatttaggcattaacttcataggatttggtcccttgtggttataaatggcaaggtcaaagctgagtctcagctttctgttgtatctcaatagcctatacgtccttctctcatagcacatgtcttgctccattctaatttttttttattacatgtccttcttctactgcactgtgattcagtatagtggaagaggggcagattctaagggaagagtgttgttcctttttggacatatttaatggagtgtggaacaaaaatctgaagctcaggagggaaatcccgtctagataaacagatttgaaaattgttagcaaaaaaaatggtgctgggagtcagagatgctaatgagcattaatccagggagagcgtatacaataatcagaagagaaggccaagaggggagcataagataacacacataccttaaggaaggaaagagaaaaggaagctaaaggagatattgaagaaggaccaatcagtcaggaggaggggtaggaaaaagcggcatgctggaagtcaaaaaaagagaggtatcagctcaaactttcttgttatcacagaagaaaactggatgcaaaaatttaaaacattatacagcgcataacactatgtacactgtaaagcacaaacagtgttcaaaagaacacttttgattttaggagtcatctttcttgatttttcagtacaatacatggccactagcctacaattaattttagaaataatataaacaaaaaagatttattgaaagagaatattaaacagaacaaaagcaacaaaacacaaatacatatattgtaactattagaatctatttaaatgagccaactcagaagaagaaaggggaaaactctataatagccacatggggaagtattctagtggcaatgttggacaagtatgaaaagaatgaattggccagaaggagaatacatcacatgaaatcccaggaatcagtacaatggagaatatattcgcactggagcactttctcaagaagtaaaaattaagtcagtaatggcaactgcacatcagttacattctgagtaaataatataaaagggacataacttaatttgtgtaatatttgtttgattaaaaactacatttagaaaatattctcttacaatcttaaataaatacatcaaaactaaagccctgaacaatggaggtgttgtttttctactagtgggtttggaaatcccacagaagggtacattcacgtctggttcaccctaccacagattttctgacctctgaaaccaaaaccaaataaagactcctagacagtagaaatatatgggtaacgtagcgacacctaggtttgctctcggtttccctacctactagctttgtgatgtatggcaaattagcttacttccctgtgccttagtttcctcacctgtgaaatgaaatgtttagtgcttcctcacctgacctaagtgctcttgaattatgaagcatgtagacagatatgagaaatttaataataatgaaaattattttcattttaattggagcacattaaaatgtacattaatatgcatttaatataaatttaataatacacatataaatgtatattaatgtgcaattggcaaacagtcatgttttgatttatcccactactaggtgaagaatctatagcaacagttcatggtggattaattagggagatcaaatagaaattctcagttgctgtttagaaactatttaagttcactgtaaactatataatacataccaattcacgaattatactaacatctgaaccactctaatgatagtatagagagcatacattttgacagaatcaataaaaatctcacatttttaaagtcaatgtaaaataatgaattacattccaaatgcctttggtttaataaactgagcagtctgctttgatactttcttttcagtttctgaataggtaatttctatgatgacatatggttttagggccatttttaatcatttgtaaatacgtttatattttttaaagaaggcatattctaatgctaagccatgtgattcatcctctaagaccaggctgtataaagggccactaccggcaatgaagtctagttcaatcagtttacattccagccacaatctagactcttttgaaaccctaacttgctgttttgtcaatgtattctacagaagataaagaaaaagagagagaatctaattcagaaggtctttcaccactaactgtcttaaatataggctcaacattatacaagctcagtaataataaatattttaaaactttgcatttgtaaagtgatttattacttaaaaatatttcttatatacttgagccccacaaaaacactatggactaggtatccttatgctcatttacagatgacaaactgaggttcaaggcagtaaaaaaagctttctataatctcacagacaagtggcaaagacagatttaaaatagcaaaaactgttaaatacatcgtttcttccatcatttcataaaatatactttagggcagcatttaatctttattgttagagagagaaaaaggaagcttaacctagtctgaaaatttggcatacaatgctatgtggtgcttgaatgttaatatagctattttattcataagaaagaaaaaaatatgctttaaagattagtaggtaattacttacctatcatcccacctacactacattttggaatgattttaggtaagccacacccacttaaacttaaatggcgtcttgtaaaagtatcttctaagcactactcatttgtttaaagcacagatctacaatgacaaaaatcaattcattttgagaaagaggtaataattaaagtgttatttttcttctttcactgcaagtcatttggcctatgttaaatcaactatcaaattttcattcattatttctacatgaaggattctgccagctcaaaaaagtataaatcttcatttgacaaatttaaactataactgtcccagatgttatcaggcctcatagttcttatcccttaaaaacagcaaaatattgtcaagtcacaccaccccccataccctcagataacccctggaatcaataatatttgtaacttgtaagtgcacggttaaggagaacagaaggcaagtgctgtcctcgttaaccacattgagctgtgataccacagccgactcccttgtgtgacctgtgatcaattttaatctcctgaccaagaataaaagagtgcagactcctgattctggattcatcttgaaaggagattatagatttgcatgtttgcagtgggaatgaaagatttaattcaactggcatttcaggaaagaacacatctaaactatcattcctcctcatttaccctcactgcttccaggtcctctattgacagaactaaatactgaaaactgtgtacgcgatgggttaaaaagcaaagctatcttcgtggacatatgatcaaataactacagaaacagactccatagtgatttcagtacatgatttcagatggaatcagatttttgtatctcagatttcagatttctctataaagattacaattttttgcccaacttcttcatgtgaaaatcctatttttaagcaattaaagaattcattgtttgctcaaatcatgattagctgcttacaaaatacatatatccaagtacattgatacatctggggagctttaaaatgcaaagtaaccgtgatgtcagaaagaggaaagacattaccagttttagtttcatatctctatttgtaactatatatcggtgtgtttgtgtgtgtgtatatatatatgtgtgtgtgtgtgtctgtgtacgtatgtacaaacatacatatgataatagatgtattcatccattttcacactgctgataaagacatacaggagacagggcaatttacaaaagaaagagacttattggacttatagtaccatgtggctgggaaggcctcacaatcatgccagaaggcaaggaggagcaagtcacatcttacatggaaggcagcaggcaaaaagagagcctgtgcagagaaactcttgcttttaaaaccatcagatttggtgagacccatttactatcacgagaacaacacaggaaagacctgcccccatgattcaatcatttcccaccaggttcctcccacaacacatgggaattatgggagctataagatgagagttgggtggggacagagaatttcatttgggtgataaaccgtatcagtgagtttatacaaaaatgcacaaatcttatttttctatagagagaaaaaataaaatatcttattgttgaaaatcaagtaaatataaggtgttctaggaggttacaggggcaatccatgcaactgcaatttgaaaattctataattagtattaaataactttttctatacatcagataacatttccaattccacatcatcacagcagttttcaaacattcacaatgcatcacgtactgtgctagacaaatccgagccagaacctaagtttgagtcctgactctgctactttccagcaagttagcttaccatcttttactacagattttttcatctgcaaaacaagaataagatccttaatagcactgagattaggattttttgtaatgattaaatgagataatataagcaaacctagaagtagtgctcgtggtacttaatagttactacacaggtgttagttgtagtaaaacgtattctgattcattcattcattctttcataaacattcatcactccccgtgttgcaaggactgcgttaggaaatattctcataactttattgttaacataaccttcaagcattagtttatgactagaagatgcatgagtggctcatgtgtaatctgggacataatgacaaatatttaggatgtatcctatttccacagatccccttatgccctgtattgatattaagtggtattaaaagtagagagggcaaaatagaccaacttaatatggtgttgcatttttaaattcagcatattaatgcaatatactattgtctctgtggagtttcatttcacacgataaaagaaccaggaggcatctgatcaataaatagaaaatcaagttatatgttcctgttagggtggtctaacaaggattaatctcagaaatgttggtgcatgcctaatgctgtggcttttaatcttttcacacaagtgggtctaaaatacttgctattagcactaatgtaaaaaaaaattaatactttacatatggctatccactgtactcaaatgaaggggttaatggtaaaacaagcctttaaagatgtaaatgattcctcccatgtggctgcaaaatagcttaagtgtttgccatctaaaattattaacatatagaaacattattatctctgcagttaatatgcacctcactgaaaatctcatggatgcaacaattaaggaaggcaccatccttaatgaagttataagacatatatcatttattaagcagcaaataatatctttaattttggctttaatatatctttaattttagctttaatgattatatgcaaaatgtcttccaaaacctcaggacaaattataccatagcagttgggcttgtttcttcaatccctcatcctctatgctgcccccagtgctgagcaagagttgtcatttacctgaggcttcctttctatgagcatgtgcttctctgaaatactgagataatcaaggccaggacaacactacatggatgttttttcattaagagtttatatctaattttgaaattttcttactgattattatagagttttgaataatctagaatgaatgttatccatcacatttttattactaccctaaaatgctaaatagtagcataaaaatattgaaaccaagttgggcagacatgtcttttctctctctttccctttctctctttccttttttctgcccttcccttgattccttccttccttcaataaatatttattaagcagccttcctgtaacaggcattgttctctaggcaagttatctaaatttgtttaaatcatatactaattgaatgtaaagtctatttgtacagtcaaaagataattttggtggttaatagtcaattgagtttaagtctgggaaccctctttcctaaggaaaatatttcctttatcacactctttgttcagtgtgctcataaaaatcaatcataactctctgaaaatgatgagaaaaaaagagtggacatgtcactaaaatctttaataaattttttactcttctgcatcctcatatttatcatctgttttacataaactattgggtggtttcactcacaaaaagtccttaaatgcgacatctagaaatctggggcatactgagtgtgctggtgagactttccgaaacacctgttttcaacgcatgatctgccaatatgtgtttaaatttgttcatttgttcaatatatatttactaattaaaattataaatggaaagagctagagcatgaatatagcgtttaagtaataaaatgaatcctaatgtacagatttttaggcacaaaggacatgacagaaataagataaatagacaacaatgggtatgattatgtattagcaaacatcaataattagtaaaggcacaagtagaaaggataatgtcatagtggcagtagctacagagatcataaaagtagcagttctaccatgttattttcctttgtgcatacatacaatattataacagtctttgaatttcctttactagctcatccttttatctaattatctggctcacgaagagccagggggagggatggatcttacttgtaatctcagcaatttctctcattgagttgatattcaagtaactgaaaaattttatatagcagctaccgtagttccacacatggtattgggatatggtgatttaaaacttaattaatatttttaaatgaggcaaatcttcaaagtttattaaaaattttttaaagttttatgacagggtgtatcaaacagaatccctacaaaaaataaatgtcacacttaaattaggataacccgagattttatttactaaagaataattataaagatataggtaaggtgttaaggtactacaagagttagagacttgagctagaagaattagtttaatatcaatgtttctgatgaataatttaaatacttttactctgtgttttcagtagatcaagtgttgccttaatagatattatgtgaatgatatttataagactgagttgatttcccccacaagtttgacaggataaaatcacacataaatacttttaataaaaccatagtagactagagataaaaggcatgtcaaggacaattagcccctagaaggggcttaacaagtccaaaattttatagctaattattcacagagatgaggcctaaatccagttagctaattctaagttccacttcattttcattagcaatggagggaagcatcacgactactcactaatataaatcaactatacatcctccccacccatcaagatgcacacttttcaatatgtattttaaaatctttaagtatgaatgtacaggattatttaatgttacaggttgaagagacattggataccatgaaatatcattgtctcattttagcactgaggaaactgcagtctagaaaattttacaattcttagtgactaaaatctagttaacagcaaagttaaggcttacagatcttctaattcaaaaatcaatgctctttccacaatcaaagccgcctcttttctctgccttatttattccttaagactgtaggcttttaaaatccagggcaatatctagtttttcatatatgcctaaaagatctagcttactcttaaactatgcaatactatttgaatactagtgctaactatgattaaagttagcacacatttggaaacttgcataacactgctaaggtctctaaccatgagtaagacacaattcttgtttacaaaaataaaaattcataaacccatatatccagttgtccaactgcttactgaacatcttccactggttgggctagtaacacaacaaattcaagatgtccaaaatgcgattcttcattttcttctccaaatgttctattattcacactttctgtctttttgaactatgagatgatcattgattcaaaatatattcatagagcacttactatgagctagacactatgctgggtgtcgggaatctatgctgaccaacagtggggtgattctgaccttcatgtaaaacatgacaaaataattggtaagtacaaactacataccagctatgcagattaccaagtaacaaacagaaccatcctacacaactccctctccatcaaacttcatttctacaatcaccaaatcctattcttttcacttaataatctttcaaattaatctcctcagtctcactaatattgcttaggcccttatcttttctatcctggctgacaaaaaaataacctcccaaactgatcttcctgcttctttcctctctgttggtatcattccccatcatgctggcagataagtttttctaaaatgaaaaattcgagggactccccagtgtttcactccttagcaaggaatataaggcccttcattatttgaaccttagtctcatctcccccaaccccttcagcaattacacttcatttctgataaaccaatttgaattctgtcctatagtgcactgaatacaacattccccttcattacccctgagttaagattccctctgactggcatgcccttccttccctcctttgcctggcttccatttaccttgatccttatgaagcatatgatacgttaactcctctgagaagactgacagaccactgtcactccctaccccaaacagaaatagcagattcctaccatgtgttcctcctcttcattatccttacacccagggtttgagtctattttattggtatttacactgcactctaataaatgatttttttttttgtctgggaactctttacggagtttctgctttgttcttctcggcattctttctgcctaggacatactaggtattcaattaatgttagtctaatgaaggaatggtaaattcagttttcatttgttcattttttatttattgtcacacttttctcagcatcataaaagaaaggttccacacataagtgagtaaatcatccctttctttttaaatatccaaggatcaaaatgtaatttaggataatgagattgaaaattattccaagtcaagaataaaattcttattcaaaatattatctttttgagacagataggattacattaaaagaccagagagaccacacggagatgctggatacttacctattgttcacttaattattcatgcaaactacttggatgttttactaaaaccaagatttgcaagcatattaatattataaacccaagaatcacaaatattaaaaaccgtctctaaccatgtagctcaaattacttaagtgcttagataaccgtgataacacaaaaaatagagacctagttcatacaaaaaagaagaaatatatatcctaggtgaatgacttgtacaatatgaaacacagcaattataatttttaatttcaattgtttatgttatgtacaaaaagaaaacttgaagaatgaatatttcactattgcattaaaattcctaagattattagagtagtgatttctcctaaaattaaggctatgaaagttttatttctttttttttgagacggagtctccctctgttgccgggctggagtgcagtggtgggatctcagctcactgcaacctccgcctcccgggttcaagtgattctactgcaagaccatcctggccaacatggtgaaaacccatccctactaaaaatacaaaaattagctgggcatggtggtgcacacatgcagtccaagctgctaggaaaattctctttctttcttttgtaaatgatccaaggatctaattcccacatattcagatggggcataagtatgaagaaaacacacatacaaacacctacgcatacacacacacaaacacacagttcgtgtctacaacctccaaacgttctttatcagaaccacaagactgttctaaaatgtctatacaaaaacactcaactatccatgcctaaataaaggtaattggctagggactactgatttcaggcaaatatatttttacaagagttacaaaacactaagcaacagtggctgtgtcagactagtcagcctgtcctactcatatttgtaagttagtaatttaaaaagctatttggcttaaataaaattatatttacattggaattcttagaactttagctttgctggatctttggcttctggtggtctctaggtccagtgaaaaacaccaacattgagagtaagttcagggtgaggataaaacatctcctatgaactagggatacctacaaaatatttgcagggagattctatctctgagagaggtgctgtggaggggttgggggtgtctgctgacaggcactaggtggagtgcatacctgggaaacaagacttgtcaaatcattgctaccaagcaaggtctgcacatctgcagcatcagcaccatgtgagaaatgcagaaactcagactccacccctctgagtcagagatggatgcacatctccaggtgattcctacacgcattaaagtttaagaactattaaaccatgagttatcacctcgaaataaggagaaacttttatgaaaagaaggaaaaagtctcaagctgccttctcttttaaaactctctcagtttgccacttgggtccccaaaatgtaagtcataccagggtcagatctgctgtaggtctgataactatataagaaaccaaatgggcaagtatgtagagaaataatttttatatggtacagtagacccctttaagtgttgtcacctgaaaggtataaaaatcattgccctgccttgctttttgtcaaatttcaatgataaggacattaaagctttgccttagtactgttctagatcagtgtttctcagactctccatggcaagggactagtcttctttcattccaatccttttcaattattttttaagaaaacaaaaataaattactagaaacagaaattgacaaaaaaaatcacaggcatagcatgtcctgacattttattacttgattcattagacatgtaattattctgtcaaggattttttttctttttttttttttttctagatggagtctggctctgtcacacatgctggagtgcagtggcatgatctcggttcactgcaacctccgcctcccgggttcaagcaagtctcctgcctcagcctcttgagcaactgggattacaggcatgtgccaccatgcccggttaatttttttgtatactctgtcaagtttctataaaagtttctaaatacagtgtgtgggcttatctcattacagaccagtaataaccagttcagagtccggcgccagtctatggctacacaaccagcagcattgctatagatgacacagaatttgaatttaggtagatgatacagaatttgaattcaggtagccacacttcagaaataaacgtaggattttaatccaggcaatcaggcttcaaaaccaacagtttcaaccaagccaccatcacagattaatgaagggcacggggttccttgcccatagcttaatatggagttttggtgagctcaccacataaaatcgaaggcagtgtagatagaagaaataataatgcaccagaaacatccaggatgcaatcttgtgtctcatttctgcagtaacagtaagtaatcttggtgaagatgtttttatttatcttcattcctttttatgatttttgtttctatttgatgtggatatccaccagactgtaaatggggataatatatcacacaaccaggttgttataaggattatatactttggtaaaattttgttgttttatttcatacagattggtaaaatttacaaaatcttacattctagaaaagtgtagtcaattgtttagtttcaaatcaattaggtaatcataaaatattttcctttcttttaggattgctagagatgcctaataacattatttctactttaaacaatttgtactaaattatatttaagtatcttatttatatcaacctgacaactactagcttatgatcaaaatggaatgctggttgacaggacaaaataccatgttctgtttgattcgcttgtctttagcatgtagtaatatatagagataacaagttagcaactttccatgaaattggacttaagcatacgtttgtacttaattgttcagaatgtcatatgagaatcctgaaggaataatctgcttttctttcaaatgtattgcctatattaaatccgcatccacccttttatcaatgcaagggaaacaccggttacaaagttaatgttaacgaccattgcttctatttttataatactgactagcataaaaattcaagtaatcatgcttcttataactttgaaaaatgttagttttttccttgctcttggtatcttttgtgattttaccattacacaaactatctaatttcacttagtttctaggaaatttgaaggtaactttttaaaatggatatatttaatatgaaaacattattttctgggcttaaggccttaaagtattgccagtggcatttgtgcctatactgtttgacagctttttctcatgttgaaaaatagatttgaggaagttaaatcaaattcaaacatctgtgattgccatgactgattctaaatacaaaaaagctgaaagctgtaagaaccgtttttagccattctttttcatttaattttaaagttcggcaaaatctcccagtataagtgaaaaaaaaaaaaaacataggcactttggaattattagcctgggttacactcagattccagtgagatttggctgcaatcactattccaattgatacacagggcattcatcttaatgttctgccatttactggtgttcccatacccattttgaaggcatttacattttctttttgtccttttaaaaaaaatttttttgagacagtgtcactttgttgaccaggttagagtgcagtggcatgatcgtagcacacactataacctcaaattcctgagcttaagcaatcctccagcctcagcctccctcctaagtgggactatcggcacatgccaccacactccactatatatttatttatttgtagagataaaggtctccctatgtttctcaggctggtctcaaactcctggcctcaattgatcctccccgcttggcttcccaaagtgttaggattacaagtgtgagccaaggcacccactctcacatttagatttcttactggcaacatctcataggttattaaccatctgccctcttaaaattaactttttaaacatagttggccaaaatttatttcagtgaagtttcagataaattacaatttctggatatctggacaggaatccacatttaccttttatattgttcataattttataaattctattcgtatatgctctttcattcttcactgtcccaaaatgtaaaagtccaatcttcttagccttccttcatacttctgcccctatctaatcattcttttagcaacttctggttccattttgataatcattttttaatttaaaaaatcagcttcctacttgtacatggattacagctttatttaacaattcgataattagataatgctttcatcctcttaagagatttatcatgaaataaaaaagtttagcatttcattcaaactcagctatctaacaatcagcatatttgtacatatactgtacaagcctgtctaattttataatgatggccatgtcagcactgcaagaggctgtaatgccttttgaatatcaaaagaaatttagatttgattgagtatattaactattttggagactcatcaatagcatataggacctactataaattcatctttattctaggtcctttcagtagtacagaaacatgctaagtatctggcacttttgtatcattttaaacataatgaattggaatggtggtatgaattaataattttaatgaatgtaaataagaattgaataattaagtaaactgatagtagattatgggagtcaggtgttttcactgttgtattgggaggttaaatgtaaataagaagaaaaggatagagagaggctacaatggtctacgtggtgatgaattagagtggaagacatcagtatatacacatgtttcatttaatacagatacatatggttaaagaaatatgtatgtattagcattttattcaaaaatcagctatctaataattaacatatttgtacataaataatataagtctaattttgtactgatgtccacatacatgtatatgcataggttagtatacacatatatattcccttacccatcagctgggagggcctaacaagcaataacatcacagtagcaatgagcacacttagctcccagatcttgatttctaataccattatccaataaaagaaatcagggcccccttggagaaacacctgattctaggacttaggaaggaaatatacaagataagcctagatcatcttgtagggccagaaattaagtgctaaaacacaaacacacactaatgcatgcacatacacacatacacacgcacagatgtagatatattaaagggacacaggagtaaactaaaagaactcccaatggacacagccagaacaatttgagcaacaaaacaaagtgatattagtttacagcaaaaagtaaaaaataaatatccacgagtccatcatacttatataaataaatgactgaataaataaatgggcagaatagacaaattcccatgcagatgaatcccaaatgatttatgtagatactctattctcaaggaagtggagcataattccccactcattaggtgtggcctgctcatagtggctttcttccaaagaacatgatatgcaaagagtcataaaagagtaattttttagtggagaaacctgacatacactatgttagtcatgaaatcaaggttaacattaatcatgacaaagcttattgatagtatataaaataaggtgatttaaataaccctttacctctgtggtcttctgcccaaaaacccataaccccagtttaatcatgagaaaaaacacatataaatgtcatttgaggaacattctaaaaaaatacttgactagtaatcctcacagctgtcaaggtcatcaaaaataaggaaagtctgaaaaaaccattgcaaccaaaaaaaagcataagaagacatggccactaaatataacttgggatcttggatagactctaggtaaaaccgaccctgggtaaaaactaaggaaatctagcaaatgtgtggaccttagttaataataacgtattaattctggttcattaattgtaacaaaaacatactatactaatgtaaggtgctaacaagagaggaaactgaatgtggactccagcgattctgtattgtctctaaagtaactctgtaaatctaaaactgttctaaaataaaaaagtttatttaaaaagataccgaggaataaaagactaagttgcatgaagtatgagtttctatacaagactgtatataattagatgttattttatgcagtttccagtgtggtgaaagtgaagaagaaaggcaggcaaacaagatctgaaggaatcaggaaatagtttcatgaaaagaatggcgtttacacagaatcaggagagctaagatttgcatatgtgaagttgagaagggagtatcatgatactgaagggcaaaacagatgcaaagacttcaggcaaaaattatttaaaaccacttctcaagaaagtgggtatgagataggactctggtcattctagtttccatcaagctgggcaatgttgaaagtgaatggagttagtccaaggatattggcaatgaccagtgactcaagaagcaaaggaatgctctcaagaatcatgaccaaagactgtgaagcagagaggtaagaattaggtgcaaactgaggggtgtcccccacaaaaaagcaagatgaagaaagcagtctgaataacaaaggcaagccagtaaagattcctcatgaatttccccacaaaggagaaaacacataatcttactcataaagctagagcaggctgttaaatgttctcttatggaaagtaaaaaggatgttcagtcttcagcaaacataattcactgcagaataacaggaaataaatttgggaacacagtgttcaattgttaccaaggcctcagggagtcaggcatagtgatagaaacattttaatgagggggtttggatcaaagtcataatataatgaaaataactactgacaaaaggaatctacaggttcagtgcaatccccatgaaaattccaactttaattttcatagaaatagagaaaacattaccaaaacacatatggaaccattgaaaaaccctgaatagccaatgcaatcatgagcaaaaagaacaaaactggaggtatcacattacctgatttcaaactatacaacaaagctagagtaattaaaacagaaaggtattcgccaaaaaaaaatagacacatcaaccaagggaacagagtagagcatccagaaataaacccatgcatatatgatcaactgatttttgacaaaggtgccaagaataagcaatgggtaaaggatagtctcattgaaaagtactattgggaaaactggatttccacatgtagaagaacaaaatttgaccttgcaccatataaaaaaccaactcaaaatgtactaaatactgaaacataaaaccagaaactctaaaattgccagaagaaaggataggagaaaagctacatgacattggtctgggaaatgatgttttggatttgatcccaaaagcacaggcaacaaaagcaaaaatagagaaatgggatttgatcaaactaaaagacttctgcattaccaaggaagcaattaacagtgtgtagagacaacttacagatcaagagaaaatatttgaaagctgtacctcagataaggagttaatatccaaaatacttaagaaactaaactcaacagcagtaaaacaaaaatcccaattaaaaatgggcaagggatctaaatagacatttctcaaaagatgacatacaaatggcctagaatatatgaaaattatcctcaatatcactaatcactagggaaatacaaattaaaacaatgaaatatcatctcaaacctgtcagaataacttttattaaaaagatgaaagataacaagtgttagcaaggatgtggagaaaagaaaacactcttgttagtgagaatgtaaattagtagagccactatagaaagcagaaaggcagttcctcgaaaaactggaaatacaattaccatgtgatccagaaatcccacttctgggtatttacccaaaagatttgaaatcagtttgttgaagacatgtctgcacccccatgtttattacagcactattcacaatagctaaactttagaatcaaactaagtatctatcaacagataaatggataaagaaaatgtatatatacagtatgaaatactattcggacttaaaaaagggaaattttattatttgtaacaacatgggtggaattggagaacattacactaagtgaaacaagtcaagcatagaaatacaagtactgcatgttctcacttggatgtcgaatctgaaacaattaaactcatagatgcaaagaggagaatggtggttacagagcttgtgtgttggggaatggggtgatgatggtcaaagggtaaaatctcagaccataagtgtgtgcttttttcttttttttgagttatactgcacagcacagtgaatatagttaataacagaatactgtacatttcaaaattcctaagatattaagttcatatgttcttaccacaaaaaagttaagatttgaggtgatggggatgttaactagcttgatttaattgtaccacatactatttgcaatattataacatcatcttatgcctcataaatgtatacaattataactgtcaatttataataaacttttataaatcaagaaaagaactattgagaaataattctaattggaaggattacatgtaagaagaatttctgaacaagagtctgcctttaaaagaaaacactgttgtttataagcatctggattagagtagtatcagaggcaatagaataactggatgtaaaatgatgacagaatgactatagatgatatatcaatgggtaactgttgtgaactgagtagtatcccctcaaattgatatgctgaagtcctaactccaaatacctgacaatgcatctgtatttggagataagatcttcaaagaaagaattaaaattatggtcattagttagagtgggccctaattcaacatgactggtgccctaaaaacaggaggaaattaggacataggcatatacagaggtgacagcatgtaaacacacagggaggagatggtcatctacaatgccaaggagagacacctcagaggaaaaaccaactctgctgccaccgtgaactcagacttcctgcctccagaactgtgagaaaataaatttctgttttaagccaccctgtctgtgatactttgttatggcagccctggcaatctaatacgatgataaaacactcagttttattttttgaagctttgcaaccttatacaataattgtgacatcactgacatagactggacaaatgaaagaaaaggtcacgtgggctttggcagatgatgaatctgtcaatacaaataaataattgttcttttcgggtcatttcaaatatcaagggtaggaaagcttgtcctcttggacctactagactatgggcaaagtgaggtcagagaccacttctttcttaattgttcactctatccgtgatgcctgaaatacagcattaaatacttaactatttgttaaatgaataaactcgtatttcccacggtgccaagtccagagtctcttgcattttgtcagcgtttcattaatgtttgctaaatcaatgggaaaaaaatgtcttaagctctaatctaagttgcaactattctgaaatgtcaatgatattaacataaatgagaaaatcattaatataaacagaaaattcatataaatattcagttacttcaactatttcttttttagaagattttattctcaatttaaattggaagtaaatatttccaatgactacgactgtttactacaaagacaagaaaaaaacaaacaaacaacaacataaaaaaacatacaatgacttcccatttcctccaaaaggaggcaagctcctctgcctaactgaaaattggttcacattttgcctcaagtttctactcccatctatagtttctgaatgtgatatatacatttcacaaacattggtcttctaaaacaatgttaaatcaatatcagttattatttgcctgattatcataggtgggaaagataaagtcttagtatgtcttccttccgcattagcctgaccattataaaaataaacgacatagtaaggaaagagaatggaggggaactttaatttctgaaatacatattacatgctaagtattttctcagtgacttaaattcccaaagcatctcagtaaaatatattagtagtctttctttcttttttttccacaagggaactaactagagcttaaatagactgaaatacctttccatggtgtcttagttccggcttctatgtcaaagtgccatagactgcgtgacttataaacagcagaaactcatgtctcatagttctaggagctggaaatctcagatcagtgtgtcagcatgtctggatctggtgcagggcctcttcaggcccagctccttgaggctccttttatgagggcactaatccagttcatgagggctccactctcaggtcctcatcacttcccaaagaccccacctcctaataccattacaacaagggttgggatttcaacatacacatttagggagacataaacagtccataacacaaggtaaaacatctgctgagatgcagatccaggatttggattcaaatcctacataatttaacttacaacatattgcctccaggattaatgtcattttatatgtaaatattaccaacaataatttaagaaacattatttctagaaacagaaaagttttcaattatctcttccaagtaagaactgatgctaccgcctaatccccagtgttccattgtgcactgagagcacgaggaagccagcctgtggcaactcactctgtttcaggtattttccctatatcaccctcctgctctgcaattccccaggttttctaagaaccaaaaaatgtatgcttctttttcatttcttgttaacaaagaacaagacactgtattaggatgcctttatcttacccacttatgctatcatctgccatagggctagcaacttgtaaaattcctcaatttccaccttgcttttaatagaaaatactgctctaaataacaccaactctcttctctccaagtattctatcttgaaacatttatccagcctagatgacctagaggagttgaacatcattagcagattatcatctgatataacattactaatagtattatatattaatattatataaaacacatatacatatacaaaaaataacattataatactattaggttcaggaaggcaaaattataaagggccttttgagccatgctaaagactttagatgctatccttaaaaagaccagtttgaaagtgagttgtaactatctgctagcaaaaagacaattgcatggacaaagataatgatagtaggaatgaaagggcaggttcctatttcagagacattgaggcacagactcttcatgatatgaaaactgcctggatgttgggggaaagggaaagggtcttccaaatcttgaccactttcatggaccaaatcctcctctgataagtacttgtttcctagctctattaattctattgcccaggctctccaataccctccatctatattctagggaccagatggactttttgctgtaaggacctatttctaaattcttcccatgtgtcctcatcattcctccctataccttgatttcaaggcaactcaaactttgaataatacgtatcacattcctagacaccactcagtatacacagtgatttttcttattgtgtatgggaaagagaaaatattctcagacattaacagttaaattatcatttgtaaatcagctagtgataagagaagatgcctttggcatcatatatattttgcctgctgttttaggtcctgccatcaagcatgtagtaatattttcaaacaattctatcaaataacagttgattatagaaaattcagtacaacttagaaatcttgccaataataataatgatagtaatattacctcttaatttttatgagaagggtcatgatttttgaaatgatagccaagtccaacttagacttacaaaatactttatatatgcatacatgcaaaaaaaaagtggctagaagaaaaattcagcaccacctcttcattatatgcaaatagaattagtaaatacgaatgtactacgtactagtaatatgcatgtatatatgtatgtaaatatgaatgtatgaccatgctgttttatagcctatgtactatctgtgcaaaagaggacagtggttatttgctcagactttagaactagataccttgagttcaaatcccagcctctacatgctaaataaaagaacccagactcataatgatggggctttagggataactcatatgatttaacatgtgcagcaggactaggtgagtccctggcaattagtaaacaatcacacaagttggatgtttttatggctccttttaatgattaacattaaaaataagtcatttatttgattttctgttttcctcctaccccatatctaatctatcagtaaatcctatcggtctcacttctaaatggcatgcggattctgatgaattcttaccacttacattgttaccactctcttagcttgggttcttccagaagcagagcctgagtcaagaaatcaagtggaagtatttatttgggagataatcccaggaaacaccaataggagggtgggcaagtgaaacaggaaacaaaataaagcatgtgttaaaaagtcatgctaaaaattctaggagccaatgtaggacacacacctcaaagctatcctaccccagtggtcaggcagttggtgcatgaagggggcatcattcatcgtttgaaggctgctcacagaggcactagttcttttaacacatcctcctccaatgttgtcatctcttttgcccccttacttagttagatatagccatattttatcagaatacagccaacataactgacactctcacttcttgcagttaactcaaaggtccctccacagacaggccatttctgataatcctatttaaaatagtgtctctccaaaaacaaaaaaaaacaaacaaaaacaaaaatgcataaaatgctagaaatctttgccatatatcaatatattcagcaaattctacgagtggattttagaaattaggatttagacaatgctatgatctatgcaatcattttaattttattcacctatgtaatgggggtaatgaaatttatactgggggctgtgagaattgaataaaataatacaaataaccactaacctattacccatttctaaaatatcataatttcaaaacattgtataaatagaatcataaagtatgtaaccttttagaatcagatttttccactcagtcttattgtctggataatcatctaagttgtcacgtatatcaataatttgttcctttttaatgctaactagtactaatatgatatatattatgacagtttgtttaaccattagtcagtgaagaacgtctatgctgtttatagtttttggctattacggataaagccactatatacagtcaaaaaaaaaagaaatataaagcactatataaatataatacaaatgtattattcttacattggacattttttatattttgccctaaagttttctgtgcaatttgttttatttcatttcccattttcctaaccagttacttttgttttgtttttacctccaaaactcctttaagtactttatgtgcctcatcatctctcagtgtttaatttggtgttgctctatttctccatgccttctctctaatgctgtttctagctccctccacatccccctcttggggtgcctgctccttcctctgagcactctgccagtgttgtctttcctgcagctcgaagctaacaagaccctgaactgctgcttctctaggacctcagagcttagtgttttgtcagcttcaagctgttttggagaaagtgttggcttatttctcagctgtagcattgacttagcaagtctttcttctaaacttgtaaataattcatttcaggtcaagttttgctaccagaaacttttcccagtaaataacaagtttctttatctccagtaagaaagtatggttttgtggtaatagtggtgagcaacttattaataaaagataagttctataataggaagggataagccttccactttggtacaactcttattttgctactattttttgatagggagcaaagtaaagaattatagtggtaacacaacttcctgccctttacaaagcccatcaataggaagtattatcaaaagctttgagagataagccaaacctcaaaaggatactaatactcctttgtcttgatttgtttcattccaggtcctctaataacttaaataattgaagaaatggaggtagttgaaacaacaaaaacataagcacgtaacaggcttctgagagcaagcttactgattttcatttgctggaaccacgccaaatgtgggctatggcgtctcaacaggatttccagtcacttcaaactgtcattgtctgagctgccccagtgactggattgagatcaggagtttcaagcattctgtttggccactgcaagccaaaaggagtgatggctgcaaggcataaaagggtacagactctctctgactagcaaaattgaaagcccagccagccacaatcaggctggcttaaagcatagtttattttctcttgtcaatctcagcaaaccctatttgttgttggcgtttcaacgagcaagacttattaagggtgaaatgtcaatcttgggccttgctctaccttgtcccaggtcagtaggcaaccaaagtggtcattctagcaagtagcattttgcaatcataagtgcttatgtgaacccaatctgagaaatgatttatgttgacaaaagagtaagagagcaaatgtataaagcaaaaaagagatggacaaaagagaaaaagtgcttcaaaggaactaagccagaggaatttcatatataaaaatatatatgaattaattttatatgctttactcaggaaaagacacacatacataccacaaaaatgtaagaataattgaaaatagagtcttcttgaaacatatttaggaatttgaacaaatgtctgttctttaaagttacgggagtgggtagagctttatgacactgtgtggggatatgggggatagaggagtcagagaaaccataacattaaacagatgcataaaaataatattagagtattttatggatgacacagttatagtttttaaaaatgatttttaaagacccctttgaaattgagatttgaattatacataaatatagccacaggacttctaaaattctataccaccgttcgattgtaatctaaaagggatgccaaaagtgcataagcagaagcccatgtaacttcttcacagtaaaaattactaatataacagggactgaaatgaaaagagctggcaatgcattttccccccagcatatcaagcaggttttcataaggaagctgtggtcatcaatcactacctcattaccagcccgtcatctgggcttaggctaaatgtattctggctggctgccatactaaatgttcaatgaaacatccttaaggctctctacaagttcagctgaagtcgcacatgctatacatcaaagaggaacattagcgttatcatagcttaataaatagtgccattccagcgatgtaatcctgtgttctagagctatctaccatccccagtattctactgcttaagtaaacaatctttctgtctcctgtgaggtttatttaatgataaatacatgtagagataattagtcatactactactgatatacaaatgtacttctaaacttgctgaaacctggacatgaatgagagtaacaaatattttaagacacacaatacatttacaaaatctgtcttggaatattaatcatacatgtacattgctattcatcaatgatattttgactctcattggaaaagttttaagccaaataatgaccccaatcttacttctgacttccccaagttcaactgattgaaatgttgtgcaaataagcaaccatttccttattgaaatggtcaacaaggacctcagttaaaacaatggtctcaggatttttaatatatttacaggtgtcactaccttcatttgtataaactatcctcagataaaaagactaaaagatgggttttttaaaagacgaaaattagacaaaattgttttagatcactcaacatttttacaattgctggtcaatcttagattggtctttagagcctaaagatagagccaacattcacattactaaataaaatgtccctggcttctctccaagtttcagaaacacacgtaatcttagcacaaaaaaaatggggcatacttttcaaactgtatcaaatttgcccaggccacatggctttctttagttttcctgctaatcacatgctattgattaaaagccaaaaaaataatatttgagagacctgaaaggtgaacctaaaatgtgaagtaaaccatgtttataagaattttgggtcaagataggatatgacaacaataagttatattcaataagaaagaaaaagacttagggtcaaatatgagataaagattattttggaccacgaaatgagacagaaatataaagtagcaagcaatcttaaggcccctataatgtaaagggaactaaaagcgtcatggggatctagaaccaggttttccctgaaagcctgggcctagggtagtattaagctgccaaagataagtggccaaaactgttgccaacacactgactgcaattttgactttattttaaaatgggaacctagagagagtgggagggcatagacacagcctcttcactattaatcaaaccaaatcatcaacgattttagacatcactgtgggaagaagccccacaacacattattaagatgttgggaaaaaaaaccaaaaaacttttcttgtatcctcataggttctgtcaagggggcctgcaaattaaactaacaaaagctaggtaagagaaaaggtctaaaatttttattaatatttacatggataggaattcacagaaaacaagtgaaattcaagtggttagattcaggggcttatatgccttttaaaagggggcattaggcttcaagggatgattaactcatggggaagtggctagacaatatatgggggaattaatggaatagtcgggttatattagtaaggtttattcgtgcaaactcgtttcagcgttgactccccatttgcagtgataagagttgttcttcctttcttggtgccaggctagggagggagagccttcacaaaggaaaatttatgccctgcttttagacagataaggggaaagaagataactcttcctgcatcttctgcttctcaactgggcttcagctcgaaaatcatccttatgccaaagtagaatattttgcagtagattctcattgaagacctgataagaactagagtcctgaaggaacaggtgaagaaactgctaaaccactaaataggaaggacagtttatagatgaggagagagaagaaagtaaagccaacatgaatttacaaattcctattaaaaataagcctgaaaacccaaactcaaatcctgtaaaagattctaatgctaagaacaaaaaccaagtaagtcaataagtgaatcatgaattcacagaatttaaattaattttaaggaacaccaacaaaaactttgaaataagtatgtcaatgcttaaaatggaaactgacacactggcttttatcaaaatgaagcatcaatttatgacacaaaaagaaaaataattaaatataaaacaacagatttgaagaaaataactaatacataacaatagaaaacatatataatcatcaaaataaaaataactaaaaagataattcttactctgaagatgtcaaagcagtaattagtgatgataccaagaaattcatccacaaggtagaggaaaaagccatgaataagtaggtggaagatacaaaatataacaacagatgtcttataagcaccaaagaataaaatagaaagagaaacactatttgaaaaaattgtaggtgagcattgtgcagtatttgacactggtggccacagtaggcatacacgtttctgcaaggcatatagaatagcatcagaacaaagcctattcactgtctggatatagtaaaactgacaatatcaggagttttagggacaaagagaagcccctcaggaccaaatctaatcttatccatctagttgcaattgcttgaaattcctttaactagagacaaagcctttcaatctatagctagagataaagggcttaaaatgcaaataaccagggagaaaaaaaatgtgttcagtccatgttctgtttacttaaatggagtgttgaaaacagtgaggagacacagaggtgccattgagagtgatgcctctgaagagaaacgctggagtggcactgcctcaggcccaggctagcttgatccttggctccagagtttaaaaggcactgaccatagaggacactgctcttctttggctgtaccttaggataaggaattatgtagggaccgatatatatgcccacctcaagcccgcaccttccttcctcccatttaattgtgggaattccattcccaaaaggctgaacctgtttccagggcctttgtgaggcacagtctattccttagtgttccatccctagagtgacgtgtctacataccaagagctaggggtggccagggtgcagttcttgggatgggagaggaatgtactgcctacttctccctcagtggctccgccatgggattatgtgttaacgatgtaattggcacccacagtttaagaccaccagtgtggttcttgcctaaataatgaatttacttacaaattgcactgaaattattctctagctattaaatacatggatgcatttcttaatcaactagcatggaattcttcaagggcagggaatacgtctgctaaaattattcaactatcctcagtgtctatattgtacatgtagagtgtattcaaaaattaatgtcaaacaatttaaaaggaaagatactgacattctcattaactcaactcattatgtctaaagttgaagaaattgtcccgtcccaaaaactagatatttttctgttcctcataattgtttttatttgtttgcttctttgtttttgagacaggatcttactctgttgccctggctggaatgcagtggtgtgatcacggctcactgcagccttgagttcctaggcccaagcaatcttcccacctcagcctccccagtacctgggactataggcatgcatcaccatgcccagctaagttttgtattttattgtagagatggggtttcgccatattgctcaggctggtctcgaactcctggactcaagctatccacccaccttggcctcccaaagtgctgggattacaggcatgagccactgcacccagccatagtccctcataatttctattaaaaaaaaatcactaagccaggctcacttagcatcatttttggcttcattcccatctctcactccaagcatatagtagttactaagtcaatcatccaagtaataatatcaaagtaataataccaattaatgaagtcatactgttgatcctatttcatccctttttcccactttcatttccatttcaactggccccacctttctctaggtctctatttcttactcctagattacaatcatcacatctgagtcctaccgcttacagctgtgttaccctgggcaagtcacccgacctttccaatttcatgatctttataaataaaatatagataaaaatccaccaaatagaattgtgcaaaattaagtatgatttatttatgtttcttagtgcctgacaagaacacttttaggattacttgcatttgccatttttatatgaaagaggacatgggcaaatgaagacatataatatgtgaattatcatttttataattattatttaaaatcatcattaataacaaacttttgcttccccacttctctgagatcaacacagctttacaatgttattttctaccgaagagtcttgaatgcttccccagtaatgtctgaattctttaatctctgtaacaagtgaaaagttcttattcatattatcttaacactagaaatgagaagttcactcagtgaatgagggcattgtctctcccatgaaatgccttgacaaacctacccagggtcagtaagaaatcctgtgagcatggatggcaggcatacaatgttgcaaaatgccagggaccttgattcactgtgtgggaacccactcaggtccccagagttggtataagaaattaaattgaaggtatttgagattcaaccaatgcagaaaaaaacattgttggagctttcccaatttgactaaaagcagaaacttctgggaaatgaggctgccataaattccatcttctgggtggcttctactcccaggaagaagactaagagtacagctaccataaatcctctcttcaggagagtttcatggcatgaagaagaaggaaaaaccacacacacctcataaatgaacattatcacaaactttatctcccatttgttctcctcaaaaccaatttgtctttcctaaagaaacctacttgttattcccatagaagccttcccccactcccctactaagttgggtatattaggctttaactttaaccatttatccagctacctacttcttttgttagctcctttatgcatatgaataaaccttttttccttctgataatatcttttggcagtttattttatagaccccccagacactgaacataagagagtacaggaaaagttttccccccctcaacaacacaaaataccctaaggttggcaagcacccagaaaaccaggcaaaggactaaagagctttgccttagaccaggagacatatatattattttgctccaagacaaacaagaaagaagtgagaaaagagaaagggcagaaagaagacaacaaaggaaataggtgagatgtaatttcacgaagggaacaagtgtgatagccaacgaatattttaagaacagtgatgcctactctgctttctaattaatatttttattactttactatacatctcttttccaattcctttaaaatatttcaggaaaatactaaccttactgatggattttgtgcaaatctatactaaggatcattctgaaaggatggaatagagaacagataaaccaagaccttttgttgacaaggtctcttttgcttgaagggtgcgctaaatgcaatacgttgtgcccagcatcatttctctgaatttgcctgatgagcccttggtgttcactctaagcacatgtactgtatctcatgtaacattaaatattaatggtgttctcataaaacttgctctcttccttggccttgacaagtctagaacttgtgtttccaatttgttgagaccaaggaagagaacaagttttcatctggaaggcagaaggttttacagatgagaatcacatgcataacattttcaaaatgtacatacagtgagggtaaaaaccctcactgtcagctcagcataccaggatttggtcaagagaggcacacagacatatgtacattggcacatcccctgaagttatgctctcatttatttccacagagaactatgccctgggaagccatgcctgacagaataagacacagatgtttttgcacatgtgggtacttgtggcaaatcattatgtcacctaggagaagctactttctaaattaatggccatcaacaagcttaccaactctttattattgatcatatagactaagccattatgaaaattcaagaattaagttgaaagctcctggtattgagtgagagaaaatcttcatattggatgacttagtccattttgcattgctataaaggagtacctgagactgtgtaatttataaagaaaagaagtttatttgccaatgcaggctgtactaacatggcactcatatctgtttggcttctagtgaggcctcagtagacttacaatcgtggcagaagggagggggagctggtatgtcacacggtgagagagagagcaagagagaaaggaggaagtgtcgggctcttcttaaaaaccaggtctcatgtgaacttacagggtgagaactcactcaatgcaaggacaatgccaagctattcatgagggatctagtcccatgattcaaacacctcccactaagccccaactctaacaatgaggaccacatttcaacataagatttggatgggataaacatccaaaccatatcatttggagatggtatcataacggtttcaatatatatttttgaagctttaaaaacatatttttagccacagaacagtcctgcattgttacccatcagcagtgtagtaaggcaaatcttctttgtaggcagttgatgaggcagaagatatacagacactgggttgcattcaaccagcactacccatttgctaactgtaaggcacacagttttaaataatcttggtgtctctatatacaaaacagaaataagactattctcaggattgcaataatgacttaaaaatacattatagatgattggtatatatatgtaaacagttaataaattctattgcttactgttattgataatgccattattacaaaatatgtgtgtgtactaaattaaaaataatattctattaccttttgttttctaccgctccatggctcagacactgaaaaaaattattgtactctattcactattaactgttattttgtgtgtgtattttcagttgctttccttcatcttatatttttcttacttatataaattttggaaaaaaaatgtaagcactatgcatttttaaaagtataaataagagtttaatttactagaggtttttaaaaatctccttcctagtgataattaaggtgatgtgctatatcaaataatcaatggtctcattaaaaacaagaccccaatcttataaatagtctatgaagctgggtccttcagcgttataagggtgtgtgtatgtgaacttaatttcatataattggtaggtaaacaaagaaataagattttcagataaaacattgattccaattatctcattgttaattcaagaaactactatggaggctttaataccaatttttttaaaatacatggtcaaattagatcctcaaacgcatgtgtatgaacagatgacgcagaacatgcctattcaagacaacatggtttctgagtgacactgattaacaatcttgtgaaagctggcctttattctactcaacttaactgaaacaatggggcagaaatggtgtttttgccatatcacaaatatgaagttaattttcaaaacaaaagcaacccaaagttaatcagacatcagaaaatctatctgtctagtcttcatatataactgacaactcattaaaatgtttaaatacatactaatgaagtcaagttacgtagtgacttacagatttaaagggtacaaattcttcgatttgtttttaagaaaaaacttctaagaaaatggcattttccaaatccaattgttgcatttaagatttttttttattattgcttccagcttcttgtagaagcatttttacttacaaatttcttttattttcttttatttttatttattttttatttttgacggagtctctctctcaggctggagtgcaatggcaccatctcagctcactgcaaactccgcctcccaggttcaagcagttctcctgcctcagcctcctgcgtaactgggattagaggcacttgctaccatgaccagctaatttttgtatttttagtagaggtggggtttcaccatgttggtcaggctggtctcaaactcctgacttgaggtgatcctcccactgaagcctcccacagtgctgggattataggtgtgagccactgtgcccggcaatttatttactttctgttagattattagagtctgtaattgtaagttatgtaaccacaccatgaattaacaggcttgagggctttccctgaaagatgggcaaaaggtgggacagagcctgagttttccacaactgctactgccatgaagttcctgcccctttacacaagtggtccctcataaaaatttcccctgggtgaaaaaaaatggtcacttcaatagaaaagtcacagaggccaaaacagtgatagaagaaaagcatgactcatacttggccctgttgcttgaggcaccaagatatgacatttagtataagtaatttgtttattcttgcctgctatgattttaatgggtgggccttctagcataaaattcttctagcataaacttttcctcttcaatttgaaaagggagccataggctcccagtttttcttagatgaaggatatgactacctgtctggcacatggatggagtgtaaaagctatatggcactgctgagactgtcctcaggcttgcatgggggaacataccaaatgatcatttctttatacacagttgattagatgggggatgaacgcctaatctagttcctgatttctgacaaatccacccagatattgtacacagtgcgtagtgggcaatttggctgaaatctggtgcaaagtacaggactgagaacttcttttggagacatatataatgagcacatataaaggtgcagaggaaaggaaggggatggagatagaagaaacaaaaagtgacagatcagatataaaagactttctaaccaccaaataaagaaagattttacttctactcctgatattttccagttccgctttcatttcctacataatccatcacataaacagaaccaatgacaaaaagccacatgattatctcaatagatgcagaaagggctttcgataaaattcaacaccacttcatgctaaaaactctcaataacctaggtattgatggaacgtatctcaaaataataagagcagtttatgataaacctacagtcaatatcacactgaatgggcaaaagctggaaccattccctttgaaaaccagtagaagacaaggatgccctctctcaccactcctattcaacacagtattggaagttctggccagggcaatcaggcaagagaaagaaataaagggtattcaattaggaaaagaggaagtcaaattgtccctgtttgcagatgacatgattgtatatttagaaaaccccatcgtctcagcccaaaatctccttaagctgataagcaaattcagcaaagtctcaggatacaaaaatcaatgtgcaaaaatcacaagcattcttatacaccaataacagacaaaccaagagacaaatcatgagtgaactctcattcacaactgctacaaagagaataaaatacctaggaatacaaattacaaggggtgtgaaggacctcctcaaggagaactataaaccactgctcaaggaaatgagaggacacaatcaaatggaaaaacattccatgctcatggagaggaagaatcaatatggtgaaaatggccatagagcccaaagtttacagattcagtgcgatcctcatcaagctaccattgactttcttcatagaaaaaaaaattgttaaatttcatatggaactaaaaaagagtaagtatagccaagaaaacattaagcatgaagaacaaagctggaggcatcatgctacctgacttcaaactatactacagggctacagtaaccaaaacagcatggtactggtaccaacacagatatatagaccaatggaacagaacagaggcctcagaaataatgccacacatctacaaccatctgatctttgacaaacctgacaaaaacaagaaatggggaaaggattccttatttaataaatgttgttgggaaaactggctagccatatgcagaaaactgaaactggattccttccttacaccttttacaaaaattagctcaagatggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaggggggagggatagctttaggagatatacctaatgctaaatgacgagttaatggctgcagcacaccagcatggcacatgtatacatatgtaactaacctgcacattgtgcacatgtaccctaaaacttgaagtataataataataaaattaaattaaattaaattaaattaaattaagttacattaaatttaaaagatggattaaagaccgaaatataaaatctaaaaccataaaaaccctagaagaaaacctaggcaataccattcaggacataggcatggacaaagacttcatgactaaaacaccaaaagcaatggcaacaaaacccaaaattgacaaatgggatctaattaaactaaagaacttctgcacagcaaaagaaactatcaccaatgaacaggtgacctacagaataggagaatttttttgtaatctatccatctgacaaagggctaatatccagaaactacaaggaacttaaacaaatttataagaaataagcaaacaaccccatcaaaaagtgggcaaaggataagaacagacacttctcaaaagaagacatttatgtggctaacaagcatatgaaaaaaagctcatcatccctggtcattacagtaatataaatcaaaatcacaatgagatactatctcatgccagttagaatggcaatcattaaaaagtcaggaaacaacagattctggagaggatgtggagaaataggaacacttttacactgttggtgggaatgtaaattagttcaaccattgtggatgacagtgtgacaattcctcaagtatcaagaactggaaataccatttgacccagcaatcccattactgggtatatacccaaaggatgataaatcattctactatagacacatgcacatgtatatttattgtggcactgtttacaatagcaaagacttgaaaccaacccaaatggccatcaatgatagactggataaagaaaatgtggcacatatacaccatggaatactatgcagccataaaaaaggatgagttcatgtcctttgcagggacatggatgaagctggaaaccatcattctcagcaaactaacacagtaacagaaaaccgaacactgcatgttctcactcataagtgggagttgaacaatgagaacacatggacgcagggaggggaacatcacacaccagggcctgtcaggggttggggggctaggggagggatagcattaggagaaatacctaatgtagatgagggattgatgggttcagcaaaccaccatggcacgtgtgtacctatgtaacaaacctgcacgttctgcacatgcaacctagaacttaaagtataataaaaaaaagaaaattgtatttttaaaatctgaaaaaaaaagaatcatcctttatttgagctcactgcaatggttttctacacagaagtcttctactgagaaccacagaaaacatctgtattgaatgctatgtctgtatatgggggaacttggaaaagaaaatttcaagcttttcaatctccaatgattaataaaaataaaactgtaattttatatatctaccaaaagatcatgttaaaaattcttgccatcgctttctgacccttggtttcaggtaactatatgttgcaaataatttgagtatatacatcagatggtaatacattataaagtgaattttccatttttgtttgtttgtttgttttgagacagagtctccatctattgccctgtctgaagtgcagtgtcacaatcttggctcactgcaacctccgcctcttggattccagagattctcctgcctcagcctcccaagtagctgggactccaggcgagcaccaccacacacagctagcttgttttttgttttttgtttttgttttttttttttgtatttttagtagaaacagggtatcaccacattggccaggctggtctcaaactcctgacctcatgatctgcccacctcagcctcccaaagtgctgggattacaggcatgagccaccgcacctggccaattttacatgtttttaatgtcaaatatttcacacatacattctggaataattaatatattcacatatgcaaagataagatataaaaatatacaccatgaaaagtgacccttcactgttgtctcctctatcttaagttttcttgggtagccttgtgtctataattttttaatgcatacacaagaaaaattttacttttttatgcaaattataatatatatggttttacatcaactttcttcccagtactgttccatcttagagatatttccccatcagtatttaaagatctttaatatttttaaaacttacagtattctattgcatgaatacgctgtaacttatttatcagttactacctagtttttcttgatggacatttaggttgtttccattactttgctattataaacagtagtgcagttaataagcttttagacacattgtttcatgtatgtaatttccaagaggtggaattgatggttttatataataattgtataggagtgtctatttccttgtaccctcgtcaacaatttgtcagtgtgatagataaaatggtaggtcagggagtgttgagttacacttcttttattatgtgtgaagttgagcatctcttcaaaagtttagaagtcattttaatttccttttttgtgaaatatattattttatcttagtgaatggatccaactccattacagaggatatcccagttatatcaatgccatgtaagaaataacttgtcttttctacactgatttcaaatgctactttttaaatattctaaatctctgtatgcatttgtgtctgtttctgtttttttaatctgttctgttaatatatgttttcatgatctaatgctatattattttaattcatgaggcttaatgatatgttaggtttataacaaaataatttaacttttgttgttcttataaatatggtctttccttactacatcttctgatgggttactgtttgcatatataaaagctgttgatctgtgtacaataattttgagccccaatcttactaaagtttttctctaacagtttcaccaagaacagtctccaaaaaacaatctttcctgagttctgagaaattacttgtagattctatatttgaagaaaatcttagctgaatatcaaatacttggctcacactttatttctctaaatatcttgtaagtttggtttcagtgttttctgttacagaatgatgctgtgaggagtgtaaagccagtctaatattttctcttcagtatgacttgatcattttccctatatgtccaaggaagttttattttgtaaaatacaaaagttttcctaggatatttctgtctaaagcatcccagggcaagtcttttcaaagtacaatttcaaacatttcatttcacacaaaaatattttttgtattatagtttcaaatacatattctgttccagtgcagtgcagaatcctcctgaagtactccaattatgcatatgttgaatctgctttgattgtttcctttggttattattttctctccctattctttacttttatctgtatcttctttttattttttttttcattttcctcctttccatatcagatgtcctctacagggctttgctatctttattcattcttatgctcctcccattgtgtctttattttagtgattatgttgtttgaacgcacatcttcttttatattttgtcaactcactttctatttcctattttttcttattttgttctgaggcttatgctttatggttttcaaaacactcatggtaatacaagattaagttttcttcttttaaataaaattcaaaatgttttgttattttctttatgttccattgcaattttttttggaaagtatgcttatctcttggtaaattaattgcctcttttccataaattttctgtagtatttttcttttaatgccatgagaatatcttattactcatcatgtaatgagctaactttgcttaattggttatttgcaggatgttcctgcagaggtggttatggtgagggacagagttctctcctttcttgctgccacagggataggacactacttgcaaatatggcttatttgtactggattacttgagtagtttcacctactctgtttttctgaacaaaatcaagttcagaaagctcttggttgctgttgtttcttcccctcaccagcattgctcatctcagttcccatacccatccatttaaagaagaacaaagtgcccttgtatctgataccattcctgggtttcccaagactctaaaatacttatttgcactttctcacctgtagttattgcctgatttcatcagctctggaagctcctaaattacatcagaatataccacttgtatttgttttctgatttcctaaaaaaatgcattttttgatatggctgttgactttaaggagaaatgggaactagcttactagaaaatataagtttaaatattttggtgtcctttccaccaataaaaatttaaatacacatatattcttaaattttaacatttatacattttcttataagtaatcttatatttggtggcccaaagtgatggggagatgagtacagagccaaatgtctatctgattagaaatgaaagataaattctcttgggttgaaataacatgtaggagatcatgaagaaaacaataataagaacaataacagaaccagtataatatacagtttttattctaatgtaataaatatttatccagcgtgagtgttttactaaaagcagacaactttaaatccaaaatcacatatgtttttgaagggaaatatatatacaatgtataataaaataatattgagcataatttcattcaaaaatattttatctttataatttctctgaatgagctaaaaagattatctctaattactgacttgttatcaaaccatattatatctgcatagtatctttgtataattgtataacttctgagaaaacagatatataaaattacttcatatttgaagtttttcctaataaaatattaagatcactaaactgtcaaggctgtatgataaccaaaattatgtccaaaaaggagctactaaaataaaaagttactaactgcagagtctcttctagtttttcccaactcatacatctgatattttgccaattactgatgactcaactctgccctttctctctcatccatcttcttaaattcattcctgctgctactaccaaatcagattttcattaactttcaccttggctacagccttacagaaacacagaaagttattattgaaaggaaccttgtagtcataataagcctactgaatgtcaagtctggatttaagtgcaagcattattaggtgatagtttgagtcaattgtcatagttttggtctggcaatcagaaaaccatactgatagcctcactataatcatggtaaggaatctagatagtgagactaaatatggattcaatcaagcagtcatcatctagaacatctaaccttagaaagtatgactatggaaatcactctggggcttagagtaaatgtctaagacattataagcaaactgacttaaaactaaggtaaaagtggacccagtcaggtagaccgtgttacttacaggcaatttggtgtttgtggatcatctcaatagatactatgtcatgtgtttgataggaagctaaatacttggggaataaacctggatttcctgttatatgattatggttaaaattagtattttgacaatgaggtttagaaatagttactaaaagaaaacactttattaaaaaaaaagagaaatcaagtaaaagtggaatcagaactaggaaagacactgatttctcctataaagacacgcagttttattcactattgaaaggtaagaatacattataataatagctaacacatgttaagcatttgttttatgccaggcattattctaagcattttcgctgtgtgaaatcatttaatcctctcagtcctgtgaggcaaattatatgattattcataattaactttaaaaaaatagaacaaagaattgttaagtaactttttaatcataatcacttggaatggaagactcttagaaactatgtataagcatacggctactgttacctcatttcagtcagagaagattccccttagaagatcctctatagaccctcagtgtcctatattgaatctaaattcgtattatatttgtagtaagtacacccagatcttaattttgttttacatatgttatatctacataattagtaagaagaacaaatctctatatgtcctttgatgttaagcatgttaggctacattaatatttaacatctaagcaaggagctctaaaaaactcctaaatcaagaaggtttatattttcctatgtttgcctacatattgcagtgtaattgaggaagcaatttttagtctttaattaattggaactgtaattattcagcctagagaagtaaatactaaaaatcaatttaataaagattttcagctacataaggagctctcaaggtgatcatgactatttccatttaaaaactggatttatctgatagcacaaaagatgagtgaaatattcctgacagtgagggttagcaaattttagaaaataaaaaggttgtagaaattctttttataaatgcgtttttaaatcttgttcatatttatcatcctacttatgatactatctgtacatgaataagttacttaaaatatgtttctttttctatcttgaatgattttgtggttggaaataacaattagtttgcttaaatctgctcatactacaattaatcatgtatttctctttgataataaaataatattttttcttcacattttagtgaagtcaaaacttggaaaacataaaatcttactggaactgtgttattgtcagaagaataccactgtgtttaacttaaatgataattaagactcgcatatttgaaagtttaatataagaaagggaagtaggaagttccaaaaagtaatgatgaaagacactcttatttttaagccatgaccattcctggaagaaaacagaaactgggacacaggcgaaacactgaggttccatagttggcaaagatttgtatgcctggatagattagaattcaatgtattacctcctgttcttattaacagccccccttgctatagcctcttaaaaggtttcccaactctactctgccatccaccgaggccgacagagtaattctttttccaaatgcaaatctgatcatttcacttcccaacctagctatctaccatctcctgccactgcttcttttctttgttctctcaaaactcagcttgcaggatccctcctccctccacttaggggatgttcccttagaatgcaccctcatagccccttacatttctgcttttcaaagtgtttcattatgtgatgtgttgtactgaatgtctgtctcccaaaggctaggagctcctctagaacaaggactctatcctctttactgtcatatttcaagtgcagctctttccctggcatagaacaggttctccattactccagtagaaaaaggagcaaaactgctaagaacaatgtttcctcttctaatcttgtaatgtattcaatcattcaacaaaacatttagtgaagatttagttttatgctaagacctaaggcaacaatggtcaaaagagatacctaaaccttgctccaattcagtttctaagttattaacaattacgcacacaatttgaaattttcaaattttaaaaaagacatgtttttcccatagattttagtttatgatggtgattatattttcctaaattctgttgatctggagaggagcttgctcataattacaacacccaacttcacaaaagggcattttagaggcaagttaaacaaacagatagaaacatctcataaaccacaaaagaaggaattagtagtccctagggcataactctaatatagattattccaagtttattttcacattctttatcattcctattatgaatattatcagtttacttgttccttgaaaaaaatttaaatcttatctgtttccacagtgaataattcaaggtgtgtatacacacacacacacacacacaggagagcttaaatattagtacttaagatagtaccattcccttcattatattctattatttgtcatataacatgtcacctaactaaaaattgttcaatcataaaatgatagattattcaaatgtctagccacaatagctgcagtgaaaagccttagctctgagtatttgatgagtgttcaattaagacctcaaaccttgtttctctttgggcaccgttattttaagtagctataatttattcatctttatacataaaacatgtacaattttaatagttgtatatgatacaaaatttgaacatttaaggatatgttacaccacattaagtttaacccacatttatgtcttggatgatagatgcaagaattccaactgaggcgattttatgaaccagctaaatgatttgtattcagaacagcattaaaaatccccatgacaaagtgtacttgaacaaaaataccctgcttgtgacacatcctttacaagtaatgtgttttcatttttcacatgttgcatctcatttattttattcaggcacacatacctaaatcggcaagatactgcaagcttccaatacctttgaaataataaatcacttcttgcagatgttttcacccgctgcaaggctgccgttcattaatcaaacattatcattttctatcagtgcccagtgttaaacagaaaaggcacttcattttgagttctgactttcatctttcattcactggttacaccctgaccccacaaaacttactgcttccattctggaaatgtgaaacctcctacagcgtaatagattttgcagcaaaaaatcctaaatggtattatattttctgaattcaatatgctttatcaggagctaaatcaaaccagattttaaaaatgccaaataaatgcagtcataataggcatttaaaattaggtacacaataataataaatttataacataagctctttttctatgaatatatttaatatctaacacatcaaattgctagaacaaagattcagagatatattttttaatttagcttaagctattaaaatcatttcagaagccaaagaaaggcaatttatctacctactataatttttaagcccacaaaaagaaaatggaacaaagtgagagacaactgtaaaatctttctcatttttttttattctctaagtaaataaataatagagaatgatcaatttataatacaagaaatcaagatgatcttacggatcatgagtcactatattcattctataaatagtcatataacctaaaaaaaggacaactgatttaatctagattgctttactgccttaaaaacagctcaagagtacagatgctgcaaaagagaattttagaaatcactttcattttctcttaaaaaattctcatgttattcatcctctttgactaacatctcctaacctataagaacataaagctaacattcacttaaaatctgacctgataatgaattcataaactagaaatggccacgcaattgaataaaaaggaaatagtttataaatattctgtttcatcattatgaattggtatcattactgattattcacaatctgtctcccattaaggtatagtgctaataactttacacatggatatggcccccttcccagtaaatttataataaacattatgtgaatttgtgcaggagaattttccagaaaaagatctgaagaattcagagtaaataagaaaagctaaaagcaaagcatattatcaagatttcattcaggtctcaacaaaacccacataattttaatttgagggcggaagggtgagggacatttctattgcagtattttatatggtgaagatcctgagcatggtaggcctaaggcagtttcctatgatatcaatcaagaaactcagatgctttttcactgtctctaggataaatctaaactctgtaaacttcttaacctcgggtatatgacccataattgtttatttgtctcctaccctcatgtcctatctactgttatttactctctgcctccctcagcatgcttcctaggcatatgccatcccataagtatcacagttttccaaatcgccctcttctttcaagtctccgtgttatggtggacaccactttatctgccagtgatgatcctgcttcaatttttctatctaacatactcccacccctccagattaaagactcaaccccctagatggtcatttatctatcttctctgtcctccctttgtacgtcactacaataatatttttccccttaaacacctatgagcatctctgggaagagagtatgcctaaattctttaccgaaggacaagtatagtgcatggacaaataatacctttcaaaaatctgacaaatcattaaatgaaagaatggaatcaggtaaaagtggcctttcatagtcagaatttcagtttgtttctttctcctttttttttttttttttattttgagacagtctttctctgttgccaggctggagtgcagtggtgccatctcagctcactgcaacctccgactcccgggttcaagcgattctcctgcctcagcctcccgagtagctgggattacaggcacgtgccaacacgtccagctcatttttgtatttttagtagagacagggtttcaccatgttggccaggatggtctctgtctcctgacctcgtgatctgcccgcctcggcctcccaaagtgctgggattacaggtgtgagacaccacgcccagccaaaatgtcaatttcttagttgtcttatattctgttgtctttgtattctcatgataatttttcttgtctttttatattttcatgagaccagtgtcccccttttccttctcttctattctccctaccttctcctctcacctttttatagggaagggtctgcaatatttttgtactaagtgttaaatgagtaataacgataaaattctatccttccagacacacatacataaacacacacacacatttaacaaaggataaacataaggtatggtccttatacgaaataataaggctttaattatgaaactgtgagtatagactgaagagtgatggagaaaaatcagaatcagatctctgttgaagtctgaactttgtatctagcagtgatcaatattgtgcgtgtgctctccatacatgtgcacaataacttatcaaggtgtctctacagtttataacccccaccttatcttagccaacccaacaatctcaaaaattaacgagttaagtaaagatgccattcacagaattgcacagggccaaatagattacagaatatgtagctataaatatacactgtcctgcttccataacgcatttgaaataatctaatatgatggatagataattacaatgattgagcactgaaattaaccctgagattttttgcattgaagtaaaatgaaattattagaaatcaatatctgatgaaagaaagcttactgactcattaggagccaaactattttcctatcactaaattctttaaggaattctatgacatcagccaatatataaagatttactgaccaatataatataatttttatagtgatttcacaaaagatacaagatttcattatgggaccctttaatattcataaaagttcagggagttataataaagtaatatatatttccatatattttcacgattatgtgaggtattctattgtatataatctttctgtatagaatctccaatacatattatttgacataagcagcaaaagcataccaatagaaagaataatttgatcactacattgttctatttgtcagaaatgtcctttataaaaataaagacatactattaaatggtaaataataattaaaaataacgtgaaaatagtcaataaaaatgactatggtattagtctgctttcatgctgccgataaacatatacctgagactgggtaatttataaagaaaaatggaatcgcagttccatgtggactgagctcgcagttccatgtggctggggaggcctcacaatcagcagcagatgaaaagtatgtcttacatggtggtggcaagagagaatgagaacaaagagaaaagggtttcccttataaaaccatcagatcttgtgagacttattcataaccacaagaacagtatggggaaaccgcctccatgattcaattatctcccaccccgtccctctcacaacatgtaggaattatgggaactacaattcaagatgaggtttgggtgaggacacagccaaaccatatcagctaccacaacagaaatagttttctaactgttgtgacctacttgaatatacacaagcatacttgacccttgcatttcctaagaaaaaaactttggcaattaatttagtgaagaggaattctgaaaatgaacaaaatcctctgggatcccacaatgaagtgtcatggatctgatttttaaaattactgcacagctcacacaaaagtatgtacatctttttccttagaggctaagacatggtctcttgaagcttagctctcctactctgttaagcctcaaatagagcgagacacatttgtgactgctgtttcagctctcagaagatgctttttgcaagttccttccactgctgcctgctgaaatacatccagcttcccagatccaaagtaatagaagtaatttcctatggagttaaatttgttttgttttgctttgcttttgcttaaacaagttgatttctaaaattcagcttggacaaggaaattaaaattttggtgacaacaataaaagttaaaatacttaaaaacagtctttttatagcagaagcaatcaaattagaataacaagcataggaatacacaaagcactgctgcagaagactctgcctccaccccgccccaaccaagggaaacaaaaactttaaaaactgtacacatttgatataaatttgaatgaactcatgttagcttgtgttgtgagccagttaacagaaatattgacgttaaaggttctttttgagtcatttagctttcactgttttgggagaaatcaggatgaaaagggttagcatgcctaggaaactaaaaagaaggacacactttactttttactttttaataatataactgctaaagaacatcattatttattacgtagaaataaaggcttagaagacaagagtgacttttcaaaatacctacatttcctgagctctaattttgtcatatttccatttttatttgtaaatctaaatgtaccattttccagtaactagcaatcttataattcacaacaacacatcttatgcaacaaataaccaagccaaactgtcatattctacctacggagcagttgttctggcagcccagcaagaagaaggagaataatgttctccacttgtagcatgcagaaattcactaatccccttcttttcacggaagatctttctgtcttgtgtcctctggtctagacattgggtttatcctctttactgaacaacagaattctcaagctactcaagatgaatgagggaatcaaggggtctagctactttttttaatacactcttcataaattccctattttttggccttgtcttcactcttatttccacagctacctggtactaccaatcttgaaaccttaagtaggttcagtagtacacattatgatacttctccagtctggttaaggatttagctttcttgggtctgctaagtccaacctcatgtagccatctgcttttcaacttccaaaatgttgtcatttctgctcctttctattctttttttccttctgggcttatgatttttgacaaatcctgttgctttcatttttgtgacaatccaggacaggatatagagatacacttgcatttggtctgccatttttaaatgaaatcctcattaaactaattttataaagaagaatttccatcgataaattgtatcatactttgtctcaatgcttaggaattttttatttttttttttttcaaaagactgactggatctatgagatctatttccaggtgtgactttgcttactataaatggtcaatattccaagaatgaacttgggcttgattcaaaactcaactgcaatttcttaactctgctgcatgattgtattttttttttttttttttttggatgcagtttcactttgtagcccaggctggagtgcagcagcatgatctcagctcaccacaacctctatctaccaggttcaagcgattctcctgccttagcctccacagtagctgggattacaggtgcaagccactgcacccagctaatattttgtatttttagtagagatggggtttcaccacgttggccaggctcgccttgaactctcaacctcaggtaatccacccacctcggcctcctaaagtgctaggattacaggcatgagccactgtgcccagcctgtattctttaggaccttcactgttcaattagcctgccagtaagcaaggattagggaaaacaaaatgagttatgactttctgtagatatttattcactaaaaattataaagaatattaaaatttgtatttttaaattaaatttccaaattctaaaacatgcagtcttgcccatcagctgcctcactcttatgacttataaagttgtcaatattttttatgggcaaatgtaatataaagcaaattattttttgacattgttgaatgatctcctctcaatcagtgaaaacacattctcttgccattactgactaagcaactggttttatttttaatacattgtgtgtaaatgaacaaccatccatcttcttgtagtcataaatatatctgataaaagatgattccctaacaaaggaaccacgggcgtctagaaataacagtttatgctgcaatttttatcttaataacggtatcagaaaactgataattcaacatcaataacgtgttccaattagaaatatatttattatataactagcagaaaatgttgaagactggtagtttctgaaattcttctcagagaccatgcactagaaacaatggaaccacagatttgctaattagaattattcctgaataatcattaaagcaaacagcagcttttgcgtttgaatttcacatgaaaattcaaacacttttgagaccaatagatagttgaaatagacctataggaacacaactactgaaattaaaaggtattcagttgcttgtttctgttcatgagtactagttttattctacagatagtacctacagtttgcagcaaataagccaaaacaacaagaaaatatcttgtttggttatactagaattcaatggctgttaatgctctattacacacttaaattagttttatgttttagttttataaattagtcttctctgcatatctaaatatatatttcctaatgaggtttaatattcaaggagataaatatgagaaaatgctttgaaaccaattataggaataatcttacataatctgcaaatgctgatcaaaatacatcatttctacaatgtcaatactgggaaaatatagctttattaggttgaaaataattattttgacttttatgataatggttagatttgattatatgtacatagggataaatacaacattgaaaacactaagccacataaatttaaaacatcgtgtaattcgaacagcttcttactagtggtttattttttaatgttctcattaaagttcctgatattaaattataaggaaaaaagacctaagaatttagacttaaataataattaattacttcagcatttgcccaagttcaatctctaatcatcactctcctgcactgtataacctctgtccagcccatctccacatgtccagtctcatcacttttaaattcatcatctacccagaaagcctacactgcataaaaccttttcatcacttttcgtattcagtagaataaatgcccaacttttctaacctactaacaagccctctatgactgtatgacttgcttcttgccttacacttcagcctaaagactaaaaaattggactgtcacagatccagaaacactagaggtttataatgctagttcactgaacacctggctctctggaaccatctttcagaaaaaaaccttctccctctaacttctcttttcctgttaactcctaatcatctttgcaactcagtaaagacaccacttcttctaggaagttttctatggctccctccctgacccaatacacatcctcacacttaaaagtcatcccaggaatgttggacctacccattgtgcgcccacaactctctgggaatctctctatcactacttatgttattaccatattttgttgtaattatgttactttacacccaatgaatctctgatctttgtgaagtcaagaaaaatgttttccccttcattgaatgcgtaataacaggtacctagacagaccatagtaaatgctggtagaatgaatatataaatttgatataattacatatgtccaaccaggctgcttataaattggcagtctggaaattcaagggaaagctttcaatgataatttttagattataaatacagtctgtacatttgtataagagtggtatcagctcaacatattcagtgatggatattatttgattatctgtattgctctgaacagttacagtttaaaaatatcaatccataatggggagtattttccatgccatgtatattgaactattgttctttaatacatggctaattaagtctttaacagaaatcagtactcacttcttccttcaactaaagttgaaagcttagcttaaaatgaattacttcattcctcaaaacagcaagttaaatttttcaacttgctattttattcatgtaatgctgtgaagtttacctgaaatttttaaaagtgcacatagtataagaactcaaaagtttttgaatgaatgctaaattacattgcccttcatcgagtcatacatacattttcttgctttcttttgtttcttcacattcaccttcatttcttcaatttccaccttactgtatatgagtattgtatattcatatggtcatctgattttgaaataaacccagtgcacatagcataatatgcttacaggtgaattcatcttcaactttcaactcagaaaatgccctatattctttccaatagtaatactctgtaatggcatggtggttggttctatcactatatttaagcaaaataaaagtagctgctaaggactaacaatttgctaaaatgctactgttcttgtatttaacaactaatatgcttgtcacaataatttactaatggggttatttaatgacctgataggattaacttcttttcaaagcaattaattacaacctgagtattatttatagctggataaaactggctcaaaccagctttgtgtgtttgttgattttatttatatatgcttgaaggggtgataattttgtaggtttcctagaatatccatttgataaataatcactaatttcattgtaaaaagtacaaaatatattacttttatcttaattataaacaataaaactaatgttcaataaaggtatcatccctagttgttccctctgttaaaataaaatgctttatttattctttgcttccttccaccccataaatgtaaactagtattaagacccatcataaatgtaaaattaattaacaatgtaatgtcccttgtatatacttctctactatgtcatacagtttcttcacactacttatcactttctgttctgtgtgttcctggagaggactcaaggttctttctctctctctcttcacccctccccaccaacctttagattctagtaaagccttcctactcaaaggagtaaataaaaccttactacttcactaagaagaggctaaagcaaagtgaactcacttggctgacatgttccaccttagaactttttctgtcttcactatttttgtgtcaatgggaaaaaaaatatcctttcaactttcaaaagcgaacatttctgcctatgttcttcttttctggtctcttcctgttttgctcactccccgcttaaatttaattatcatctcaaacatctgttttctactcacttctttatcttgccataaaatgtgtttatatttctatattaggaaaacaaaacccaactgacaaactctcacctcttcttctcccttaagccactgtatcatgatttacctctccataattattgtatgaggtaccatggaagtttgagaaaaccacaggtttgggtttctggttctgtcctattacatattagaggagaaataatttagcataatgccagttatgtttaaaaatatatgctcatttgatttaacatatagcatatatgtaggtatacatattagagttgtaatgaactcattattacaaattcatttgaagagggtaaacataaatcccaagatcaaagacttgcctacagtgttctctccacctccttccccctcattttcttgtgtgtataccaattagcctacaatggtagagaccatatgttcaattattcggcattatggaaacatatagaatcgaggaggactgatgttatgtttccataatgcataatgcatattttcctcccctactttaggagaatacaatatttaactgtgactatgggaaaaagttaattttagagacccatctagttgatacttgccaaaataagataatttttaaatgtgttaagacatatactacgctttgataaaataaaaaaaatatatagaaatccaggaacaaagctctatggaagaagcaaacttaaagtcaatcaaattacaataaatattgaaatttctcttgcagaataactttattggttagtaagaaaaagggaatgaatttacatatcacttttatgatgaacatgcatctatgaaataaatcttcatcagcttttgtaaaacaagctatatgttaattaatgttaaggaaatttgctttttaaaactccccaatctaatatttttaagtaaaagattttcttctcccattcatctctttttaaatatgtatatacatacatacacacgtgtatatacacatatacacacataatatcaagttttattttaaaaagtatatattttcacacataggaaatatttagtatttccaagtcaactttttttttttttttttttttttttacggagtctcgctccgtcgcccaggctggagtgcagtggcatgatcccggctccagctcactgcaacctccgcctcccaggttcacgccattctcctgtctcaatctccctagtagctgggactacaggcaccagccaccacatccggctaattttttgtatttttagtagagatggggtttcaccatgttagccaggatggtctctcgatctcctgacctcatgatccacccgcctcggcctcccaaaatgctgggattacaggtgtcagccaccgcacctggccccaagtcaactctttagcaggctcaatagtattcatgaataccagctgtgtacatcaaacagctgatattaaaacacagtgctcactttgggaggctgaggcgggcaaatgacgaggtccagagatcgagaccatcctggccaacatggagaaactccatctctactaaaaatacaaaaaaattagccaggcgtggtggcacgtgcctgtaatcccagctattcgggaagctgaggcaggagaatggctggaatccaggaggcagagtttgcagtgagctgagatcgcaccactgcactccagcctgggcgacagatcgagactctgtctcaaaacaaaaacaaaaacaaaaaagagtgctaacaaaagttagtcatcatgtggactaacctttttttgccctattatcatgaaaatccctctagccacacagattcatctaatatatgatctggtgaaaataaggatggggcaatggcaacaccaaaacacactatgaataaatcatgttgaaataatattcttagatacggaattagagcctattcatttcagtgtgtgtgaatatcacactctgtggaattggtagtcacacagtttcactgggctataattttttctcgttctgcatagggtggttatgaaaactaaatatgtaatctcgtcaatgccatggcatcttactgtgtgccaatttcagtgaaaaggtagtttatattatttctattactcccaacaatcatgaactataacatactgattgcatttaactagcttcaagattcatactagcaaatagcgaggagatactgccactagcatcatttgccacagccaaggataccaaatctacctctcctgcccacacttctcatattatttccccagaactaatcaggtacacctaagagcttcctggatatttccaccaggttgtcacaaggaatctcaaacgtaagaagtcaggaaagatctcataatctccccttattttattttattgggtaattgtcaccaccatccatttatttggtcaaaagaagtgttgaaaacatcccgacttgtacctatttcttagatctttaccctgccttctccttctgactcctgtccttcactaacagtatctaatcagtaaccaagactcattcattgtatttccttatgtttgtttcctgctctcagctcttgcagccctacctttggtcctcaattttctcttgcttgaattattccaatagccacaatgtaaaaatcacccagtgctggtcttgctcttctccaaaccattttcacagtgcgaccaaacctatctcactaatctcttacctctcacatcaaaatccttcattttccacagcacaaagtaaacactcaataactacagataactaaacacatttgcattgccatgtgaagtctcctgaatctggtcctggtttgtgtttgtccctatttgtcagcacacgtctctggaagtgaaaactctagcaagaatatagagctgttacatatgacattccctgtatctgggtgcactcctaatccctgccccagcatgtctcctgaattatccttttcctacagaggcttatagtctaggatgaatgaatagaaatatatacatgtaagtgagcaaaattttttggatgctcttatattgtgttatatattgtgggaaaaaaggaatagtcaaagtcacagattagaaaatatttacatgtctgtctcccccaaaactgtaagcctcttgataacaaggtcacattaatcacagatcaggaacttggtatttactgaatgagtaaatgaagttatataagcattaatgtgggtgaaatccttagcattattaaaattatgagaatgaagataatttattttattactactttaagcacatgactgttgatattttatcaatgataaagttggattctaaggaaacttataaatattagatttttcaaataggattttaaggtcatgagggcatatatatgtgtgtgtatgtgcatatatatgtgtgtatgtgtgtgtatatatatatagctataggtataaaactattcaaaacatatatatgtgtgtgtgtacatatatatgtatagctatgagtttagtactttaaactatagcttaaagtactatttcaaatagtattttaaggttgtgagggcataattaagtaaaacacacacaaatatacatgcatatattgtatatctacataatatatatataactatacattagttttataccttgggtataaaaactataagtcaaaagttttcttagtcactgccttattttgcttcctcttattagaggtcttagtagtccaaaacctttaacctctttagggaattttgcttctcatataactcgttgattttaggctgctttctgatcctacagaaacaagggtcttcgagtgaaaataactttaagataatgctgcctttatgaattttagtttttccttactctgccacctcaagcttccagttttcagaaaaaatgactataagttgtaaaaggctggaagctagaacacatgcacgcacacacacatacacaggggaaaagagagcatacttaaatatagtggaaagcagttgcagaaaaacataagattgctttaccactaaaagtctaacacatttcggtctctaccactgtaacagaaaacctcacagatggatcaatcactagagattaatactctgtcttttctaagccccatatgatctcgtattatcacccagaatgtttctgtcagaaattctagtaatatagctaccaaaaccacattagaatgggaaaaaaggcacaaacataacattgattcaacttgccctagagtactccattaaccaaatatttctacagtcaacaggagaggaaaacaaacatgcacacaaaatcccaataatgtatttacttgactgtgccagagtggtttgctttagaaaataatttgagtccatatacttaaaatgtttatattttagtaattacaaatagacattaatataataagtgatcatgcctcccataaaataacaatagtatttttcattatcaatcttttttcacattgttgtttttatttttgctttttctttttgtgtttttctaagtatcacaaaggccaatctgaatccagtttaaggcaaaaggaataaaaaattgaattagtcagtcttgaatttaataaatttttacaatagatcaaacagattttgaactaacatgttttgatccaccacaaaagaatgcatttctacctaatcacattatcttctaaatgaagaaaaatcacaaattctattcaatatccaggtatttttcttattcagtattcagatgagtctatctttaattaatttatcagtaatacttttcctatggtttttaacaaattttgctacataacaaatgtgtacttatttgttattcatagcaagatgatgaatatgcttgcataaaaagttaaggacatcttctaaaataattccactgtactgccctgagcaccttgaataaaaggaactatgctctggatggctttttgttatttcctggctgaagtcaataggtgctaattgttagaattcatcatgaagaatccagaggcagaacaataaagtgaaaaggaaaagttaaagaggttttatagaagtcctagcctagaggctaagataaatttttttgtatatgtatattttcttttttcttaagttatcaaaaattgatgtgaaaaataaaaccattcattaatagtgtttaagatatactttcagaaccatcagtcacttcacagaaactaatttcagttctcatttattccttctgtgatttattttattttattttattttcagaaccagaatctcactctgtcacctaggctggagttcagtggcacaatcacggctcattgcagccttgacctcctgggctcaagtgattctcccacttcagcctattgaataggtacatcccactctgcatggcgaattttttctttttgtagagataaggtcttgctatgttgcccaggctggtctggaactcttggcctcaggcgatcctcctgcctcaccctcccaaaatgctgggattacaggcatgaactaccctacctggccccttctgtgttttaattcttggttgtgtgtgtgtgttttttttctttgattacaaaatcaagtataaagttatttattgaagatgtactttaaaaggacaaaacactacactttagaaataaaaacagcagcttgtgttagtaatatttaaaaaaaataacacaagcatggtatcaggaaaacatatttttggatacacctttcaaataagctatttgctaaaacagtaattaaggagtgagaagcaaggttggtttctcaccatggggggtttcacaaaaattcagctattttaaagttctagtacaaaataatcagggatagctatctcttctgctacctatgttgttgttcttaaattccacaaacagatgcatgcatgcaaaacaagtcaggttctattagacaaaagttcacttgatttatatttcaactagatttccacttaaaatgttttttcttaaaacaagaagaaaatataagcaactaatgttcttaagtaattttttggtgcatcatctgctgagcaaatccgccctgctactcatttttttaaataaagttttattggcacatagccatattcatttgtttacatatactctaagactgctttcatactacaaatgtaaagagctgaatatctacaaaagagaccatacagcccacaacatacaaaatatttgatatctgttcatttatagacaaattttgtagacaactcactttattagttagaaatttaaatataagatattttgctatctcttaatagtcctctctataatttgccaattcaaaactggtcttcatgctgaatttggccctctatcttcatccctttggcatataatctaattgaggccctcaaaatatcaaaaaatgtgaatgccatttaatttttataggagaggttcttattttctaattcatcttgttgattaatcatatgtttatatacttaaaaattttttttatctatatattatcactgcaagtttctgttggtaacaagcaggctgcaaatgaaaagcaaatgaaaaatcattatatactacttacatccattaggatagctactatcaaaaaacacacaaaaacaaactagcaaatgttggcgatgatgtgaagaaactggaactttttttcactgttgatgaaatataaaatggtgtagctactttggaaacagtatgttggctcctcaaaaagttaaacagagttgccaaattatctagcaattccacatatggatgtgtggccaaaagagatgaaatcaaggactcaaagaaatatctgtataacctatgtttgtgggagcattattcccaatatccaaaagtcagaaaccatccaatgtccattgattgattaatgttaaacaaaatgtgatatatacataaaaaattattcagtcttaaaaaagaataaaattgtgacacatgctacaacatgaatgaaggttgagacattatgctaagtgaaataagccattcacacacaaaatatataatgtatgattccacccatactaggtacatagaatagtcaaattcatagatttgttgcttaataggtatagtttcagttttgcaagatgaaaagagttctgtggatgaatagtgctgatggttgcacaacgatgtgaatgtacttaatcccactattcacttaaagatgatgaaggtggtatattttatgctatgtgtacttaccacaatttttaaaaaagaattaatttaaaatattttttaagaaagcataaataaattttaaaaaatgattaaattctgccaacttaatgtattagccaagagtagggctttggtttcagagggacctcagttaaatccaggttctagtacttgagaaggttacttaatatctgttagacaccatttacataaatgtaaaatagagatatgaataataccaatccaaaattactttgtgagaattaaacatgactttgcacagaactcaataaatgtagctattctatttattatatttatatgcacaaagttcttatttttaaaatgcattaattacttttctaaatatataataacctctttaatttttctgtaacatataattgctagcacactgctaggtatattgcagaagcttaaaaatatgatcaaccaactttaaaatgtgatcaaccaacagtggcattaaaagagtaagagaagtggaaaaatacctgactgtgatacaatctccaaagacaaaagaagggctattttttcctgtaaaatggaaacttaaccagggagaaattaaatagcaatcagttttaaactacagtattctaggaatgataaatttattagtaaaatataaatgataaggctcaatagacaaaactaccaagtattttttttaaaaaaaggaaagaatagaaacacaaaataagactttaaagatccaaagcagcaattttccaattaaatattactttattctcataatggatgtattaatataatctttgactgattaacccaaataccaatatcttaatctccaaatttaacttatgaattaagagttggatgcacaacgtatctcagtaacaaaagcaaaatgaacatctgttaactttctgccatgtaagtttgtgtatggtgggggtgggtgtgaacagagcctctgatgtgtaatgttctttccatctgcacaccaggtggcactgcatggttaatcagaagatgacaacacacatcaagattccttacatattttgagataggaaagtaaataagtcaaaacgttgttttaaaaataaaactttcttagatgtccacagtattaatgcttaataatgcattttaagagtttatgtttctgacttcatattgtaatcattcttgcagtattgtttttcccataaattcctgacataacttataacagtactaagtaatatgagtttaagaaatagaaaagtaatataaccaaactagattgtatttgggaaggtgggaacaatatgactgttttggacacctcttaagccattcaaaggcaagatctgaagaaaaactgatttgatataaatttcaattgcattgcttctaaaatagatttacttaaaatatttaatgcagtcccttaaaagctttggtcttgctttagagtatacaggtgttaagcacttaaagtcaaaaaagctgtttaaatgacagagaaagagattattagatcactttaatcctgctaacgaaagatggcatagcttaactggaataaacaggaaataaggaacggataaaacataaattatcccccaaaatttcacatttctgtactttggtaagattgttctagaaagaaatatatatcatatatggaaatatgcctagtttcctccaacttgcatcaatccctgccatttccatgccattttccttttctcttactaacccctcttttcttctgtgtatgtcttcttcagttcaccaaactttacatagcagcgattcgtaagataagagctgtgtggtttgtagtgtgaaaatagctatccaacagtacatctcctagctctatttgaaaaccactgtgtactgtgcacatgaatacaatgtagtcttgaattctccacatttagcttcattgaattacagtgggcggaggggaagggttgtgtactgtgatgttccaaaagtcttcttgacaatatccactatctcagtaacttctaattttgttaagtatcctaaaatttatccttcaacatcaatattctacctttagaggacaatgcagacctatagtatgattaccaaacgtaaaacaaaacaaaacatcatgatgatcctaaggacaaatgtcatatgctgaagccctaatctcaaacatgatggtacttggagatggggcctttgggatgtaattagttttagttaaactcatgaaggtggggcccccatcatgggattagtgcccttatagaaagaagaaacgtcagaggtctttctctttccatgcggataaaccaaggaaaggccataggaacacacagggagaaggcagacatcttcaagccaggaagagggccttcaccagaacccagccatgctggcattctgatctcagacttctagcctccagaattgtgagaaaataaatgtttgttattgaagccacccagtctatgctattttggcatagcagcccagcaagactaagataatacccatagtatatgttcactaataaccccttccaggttcaaatgataattatctcccacaaaaaatgtaactggcagccataaatagcagttgaaagacaacatttttcttagttcagtaattttccaattctcttatcaacttcactttaagagttaattaaaccattggaaactactaaaagaaaattaatgcttaaacaatgaaaataccaaaaagaactgttttacttctctaatttaggtaactaccataagtaaaatatgtctttattccatgaaacatatatagaaaaatataataaaaattcctccatgtctccatccaaagaaatacaaagaagataaacacaaagaaggtaaatgcaaagaagataaaatattttaaaatataatttgtgttttataaaaggttttttaaaataaaaagaatataagctgtataatgttaaaataaccttagtgattaataaattatctccttttttacaataatacggaagacatcatgagttaatagggttaattagagttaataattaatcaatacttcaacagatatttattgatcatctacaacatgtaaagacttctacgagtagaaaaagccatgattttaaaaaacatttccttatatcatcatcttcatcacaaaacgctcattaaataccctagcgagtactaccattaaaaattaaccaaaaatacttaaagaaaatatctgatattcagcacagtaatgtaatacttgacataattataaggcatcaaagtaggaatgacttaagagtggctttgagtcattaatcagaactaatgaatatgtctttgcattttgtcaaaaacaaaaaaagataaaagaggatgcttggaaagatgcatgaattttaagcagtgaagtaatcaagtataatctcaaaatttctcaacaagttattacattgcttttcatttcttccattgtttcttttttttctttttccaattacttaacttcaaaaaactttattgatgttgtattatgtgttaagaaatgtgctgaaattatgcaattcaaggataaaaaccaacaccaactctcataaatgtttaatatactgtgtttgtgtgggtgacaggggagggatatatgcacacaaccaaaaatgacaaaaggaaaactatatactataaatgacatatatttcattatatatgaacacagaataaacttttcttttcttttcttttgtcttctttttttgtcttttctttttatttatttatttacgtatttatctattattttttttttttttttgagatggtgcctcactctgtcatccaggctggagtgcagtggaaccatctcacctcacggcaacctccccttcccacgctcatctcccataatcaaactatttaggaatcagtggcagtttggtgagcttggaatcagaacaagaagattcagaggtctctaaaatagacttctctgtctatcttacgacctgggctcaaagaactcccggtccattgattcaggtgccttaaaagagccactgtcaatattgctgatatttctgcaggttccttttcttcctcaatacttctaaagatgaccagcccccattgcctgcttctgcagattaatatgtgctttctatagatatgttaatatgatcaaagaataattgccctacatctattttatctccttctggggctttgcatgaactcattaagtaatgatttaatgaactctcagctggaattctatttccctcatttccaaaatcttgggagccattttacaattacaccgaagtacttacaagtgacagtagattaaacaatattacaaattaaaaaaagtagattggcaaaatactcaagacttgctttttgcttaaaattaagtcaggtttattttttaaaataatctattcatagttgtggatagtgactaaacaatttacatttttatctggggacagaagtaaagcaaatggtctaaaaacttaattgcattttcctctgaataaatagaaagtatacacaactatgtacaatttaaaaattcctgattaagaagccaattaagaataacttttatagagaataattctggctttgtgaaggcatgagagatttaactaaaggccactctgtagcaaatttaataccacaatctctcgatggattttttaaattataattatctgttatttgtctgttataatatttgggaatcttcacatttaaaaaaatattattttctgatggtaactaaaagaaaaccaatttgtgataacaatgagaaaaatgaggctaaatataaagactaattcttcttgagtatcagcttaccctcttcaagaatcttaagtgagatgctgaaatgtagacagagtcatgttggctttgagtcacaattgaagtatggatatttgcacttgttatttttttttttactttctttataaaactcactttccatgctttagttgccatttacttcttttctgttacctttgatagtcttaattttcttacccatcaaagagtgttaagaatatcgacatcaaggaccattttaagagttaaaaggatagatcatgttaagaattgagcctggaatattattcactgttactgctattattaccaatatcaccactgctaatatcactattcctacttggaatagtgtaataccaaaattataataatgtaaaatgtattccccctgggtttgggcaatgttataatactccaaaattgccaactttgttaagcaacctataaatttactttattttggaaaacagtcaaaagagttgcattttaaaatcaataactaaaaatacgtataaagttcctactatgtacccgccactttgctaggcaccaaacatctgtcaatgaagaaagcagacagaatctacagtctttaagaagcttaacttctagtggtggaaacaaacatgtaactagtgaattataataaagaaggtgaagaagtgctatactacagtaaaaagtccagtctgaacatagagagcaggaacacagagtttgtgtggggtggggggtgaggaagatgattcattaatccaggctaaagtatgaaggtagggagtagatcatcacaagtaaaataattgtatcaaatagaaaaaaagcatcgaagtcaagaacacaaatatgaaaacaaagatagctctaggtccatgtccaaaacttgaggttaaaaaacttcagataaggtaaaactaaaaacagttcagaatggctgaatcacataatttaataggagaagtgactagagacatagctgtgaccaaatcaagaagagccttgaaaaccttcgtggggacttttctttatctggaaggaaatatggagctatggaagagttttagtgaggaataatgatcagatctgatttcagcatgattactacttttgttgtgtgaacagtggtggccaaagagactggttgaggccatagcagtatcccagtggcattaagtgaggggagtggtggtagcaagaagtaagttcaaggaaaatcttttgggtggacacaagtaaagcacttggtgttgaaaaagactattcatctctacaacaccttcctgtagttcctgtttcgtagtgtctactgtgactattataattgatttcactgcattttccccttagccccttctttctcatgcattctaaaaacaaaaattcaaagaaagaaaaacttggcagaagaacatataaagtttgatcagttacctaaatgtgtcttactggatgttctttcccttgcatgcttgtttaacctttttggcactatcatgttttatgaggctatgagatgaaaactatcagaagatgaacaatcagaaagagaaaaataaatgggcttctttaaaacaaagacgaagggtccatctcttcagttatctataacagtgactcttaaacctggctctagaataaaattacccacagaactttaaaaaaaaaaaaaggaactatacccatgtccagcccgtctaccacactacgtcccactcctgaaattgtgcaatatggttgttctttttgaatgtcttatgatatttctgactcaatttaataccaacctaaacaacgaattcagatttctttattgttttttaaattcttagcacagtgtttgggacattgattgtagtaattcaatacttatttaactcactaatagctacttattgataggtgttgagtatactatgggaaaaaggtgtttagtccatcagagcccttacattgtatagcattggctatcaaactttaactagagccatatttaaaaaatacattttattttaatgcagtgtgaacgtgcaagcacacacatcaaacacacatacacacaggtgaaaaacatttttcacaaaataacacttgccctaaccatagccaacacactttgatatgttctattctattattttctggttatttttataaaataaaaaggaagaaacaatggttgtaacctattatgtcaatttcaataccaaacaaagagagccatccaatattttttaaaagccttgtatagtagatgttccaattctacgtctcaatattttcagtaacatgctgtccaggtgctctgatttcagtaaaaccaccaaaactttagagtctttaacaatgactcaattactgtgaagataacagactaattttgaataagacatagggctttatctcagtacttagaagaagctaaacttctcatggttcaagagacataagtctttagaagtaacaatgatgtacattcaatgagataatttccttggactgtggtagtattagagaaaactctaaaaatgagagacttttcatgagcaatatcatgcactatagttaaaatcaggaaacatgtgaacagacttgacttaatacaatgggcttaatgagctatcttcattatgtcatagttaattaaaaatattttttattttacacaatctaacgtagaataagatagtagttataaacacataagattaataactatggcatttccaactacagaaagagaaagtatctctttttttttttttttgtagacggagtcttgctctgtcaggaggctggagtgcagtggtgagatctcggctcactgcaacctccacctccccggttgaagcgattctcctgcttcagcctcccaagtagctgggattacaggtgcacaccaccacacccagctaatttttgtatttttagtagagacggggtttcaccatgttggccaggatggtctcgatctcttgacctcatgatccacccgcctcggcctcccaaagtgctgggattacaggtgtgagccaccacgcctggcctaccatctccatttttaaaaactacctatgtaaccaacatgtatgcaccaggtactaagagtgttttctttgctactaagtactttactgatctcctgtgtcaaatactaatgatgatgcacacctgtaacagagactttcatttctatcctctctcaatatctgtcatcccctttccctatgattctagacgtttgatggggattatgtccacccagcaaaaggcaatacttcccagcaccctctgctgttgccatgcttatatgatcaggtaacagacaatgagatgaaagaagaattgatttgtgtaacttccggctcataaatataagactgaaggagctgcttccctctttcccacttctattagcatgaatgtgaacatggtaactacccacagaccaaagacggaattcaggtttgaaaatggcttacattgttacatgagaaagaactaaacgtttatattgttttaccctctattgttttctgaaactgcccaaatgtatatcctaaataatatggaattcctattctacatttcctcctacaaaatcagtgagaaagggtagataaaataagtgagtaatgtttaattacaatatggaagcaaggttaatgaacaaaaacatgtaaggttgtgtggctgtccaagtaaccgccagttatatggtaatacaaaggtcataaattcccaaatcgacactcatgagtgtcaaataaacatttcctagagaatacggctacttgtcttccacagactgaagcttttctttttgacatgatgaaatttttctcgtatatgtttcatacaaaatactgaaatagagcataactgcattcctcacatcactacaccaaaatgtcaaagattcacttctcagcatgaaaatgcacagcacataaatatgaaaggactctacattctaaatgctgtattcacacctcagtgcagagtcaaatggagacaactgtattgtgaaccagtatagcattatcaaataatatacttaaggggacttaatagtataaaattaaattaaaaagctgaaacactattgattatttcagttagaaggtgtttcgtggttataactactcagagtgataaacaatttaattattccacatttttggaataatttgcttatgtaattaatttggatatttcaatgtattggttattttattggtccatattccttcagtacaaagattctttgtagatgaagttcttacagatacatgtattaataattgtattagtatatactcaaataatggaaaacatatcttttagtacattggtgaatttcaaatagttatttgataacattattagtattgcagacctaaagcctgatgaaatttttcacttattactgaccaagcatttttgatcatgtgtttattgagagtaattggaacttacagacacctgcccaatttctttacattaaattatcaatacaaatgtaatgttgaaaagtaaagctaaagtcaaatatagtatgcctaaaaatagaacccagggaaaatatcagatcttgcctccttcctacttttgatatacacaataaatataatattgtaattaagatcatacagacagatactaatgacaatggcacccaaaattttctgaaaggaaggaggttcagttgagacatttaggagctagaagacagtgtaaatttatattgctttccataattttttgcctaaataaaggggctgacaggcatggtcttagaaatggcattttgataagaaaagtttagtagacaaagaagcattaatgatgactgcacttcagaaaggcaatgaaaaaggacagctgcaaaacaaacattactcagtgtgtgatcacttaaagagatattatttcgaacttcatattctgagtgtgaactgccgaagagacagacaaagtaaaatacaggacgatgagtttatattaaaaatgagtaacaatttaacacagtggtccccaacctttttggcaccaaggaccagtttcatggaagaaaatttttccatggaccgggttggagaaagaggatggtatcaggatgaaactgttccacctcagataatcaggcattagttacagattctcataaggagcatgcaacttagatccttcgcatgcccagttcacaatagagtttgcactcctatgataatttaatgccattagattctaatctaatctaatgctgatctgacaggatgcagagctcaggcagtaatgctcgcttgcccactattcacctcctgctgtgtgaccaggttcctaacagtatagtactagttcgtggccccgagtttggggaccccgatttaacatactccatttatatgccgtaattgcccatagtacaaatcatatcagagaatgaatatgacattcatgaggcaaagactaagtcaagccaacttacttgttctctctggtctctcagtaaacactaagtggaagaaaaatgttagaaaactcattctccataacatatttaggcaaaatatgagaaaacagtatacagtgagtgcctcaggagtaatacactgtctatgggactttcagaacactgatgaaacatttaaaaaattcaaccaaataagaaaagtctttagaaaattttggaaaatgaatagcaaagggaacgagccaactccatcctttatgatcactttaatcaattgtttttatcataaaaagaaagctacagcctctagacagattctgagtttctggtggtatgacttgaaaatattttcttcctagagattctcactggtgatgatggtgtggtgaaagaatgggaagataaacatcttgccgaaatctctccataattaaggtgaaacagcactcctacttataaaatagaaatttagttacttggccaatcatttctatctgttattccctgaacaaatataactttcatcacgaaaatgtctgaaggcagtcattcttctggatattgctaggaaataaaaaaatacattataaataaatatatttaagagtaaactactcacctattccaatgaaagcagctttgtagcctttttctttcaaagtgctaagagtcatttcattcactgaaaggcttttaccgcaaattatctataagaaacaatattttgcataagaaaatttggcatatgattaattaaaatcttaatatttaacatcaaaaagaatgaaaagtcagccaaaaattctatgagattccatataaaatgtgacaacatttttgtcttttagtatataggtttacatacacaaaatagtatataaatagaacaggaacatgttctattaagggctaaatgcagaagaaaagccagtgtcattaaaaccatcagtaaacttccatagcttgcataatatgttcaaagcacgatgtggggcatttaaataataagacgataaataagacacatttccagcatcaatgtacagtcaagtaggggcaaaagatatacacaaataaatgtaacataaaacaagctatgatcaccacatgtgtatgagagttcagaggctggggagattcattttagctaagcttagaaggttgagaatacagagaagtgggatttcaatagggcctttaaaaggaaaagacaggattttgataacggacagtgtcaagggaaaatgaataaagtcaggaagcagagggtagtcacccctagtaaaagtcacaatgcttggtcagttcccagacatgagataattttcacttctggaacctgctgaccagggaggtgtcagggtccctaggaagaaagaccctgaaacatccctacaagtaagtactgtgattcccctagtcctttcccaaaggaaactatggtcatttatccaagcaactaagccctggaaaaaggggaatgatcagacatttcaaggactattaagcactggttcttcagtaatactgatacttggaaacataagagtgggtacttacagggtgaggtaaaaaatggagcctgactgaagtctagttcacagtgggcccactgaaaccacaactcagttagtgatcgttctcctagtctctaagagcataattgaaattgttacatttgtcaattgaagtaatccctacattgggtctctggtctgtgaagtaagagctataaaagctatcatagttgggaaggccacatgaaaatatctgaaaatccagccaagagactaaatcaaagataatatcctatcctgggtgcaatgggatggggagagatgttagtggtccctgtcatatccccatttaatccaccagcctgtcccctgccaacaccagagaatttctggaggatgactataaatgtctgcaggcttaactaaagagtagtcctgattgcagtttctgttacagatgtggtattattgctagagaagttttataaggccacacatagactgcatgtggccattgatttggcaaatgcatactccttccactccaattacagaaggagatcagaaatagttcagagtcacagagtatagataagaatattcatttacagttttgccttagggatatgtcaactcttttcagtaataatatatgtaatctgaagcgatctggacatcccacagaacgtcacagtgattcattaccttgacgacatcaggcagatcagacagcatgaaaaagaggtggtgaatatgctggaaactgttaagatatctgcactccagtgggtggaagatgaactctataatcagggactggcctcttgagtgaagtttagagatccagttatcaagtatgtgccagtaagtccccttgaaagtaaaagacaaatagagctgcatctcacatttcctgccatatagaaggaagcacaatgcctggtaggtttctttgtgttctgaaggcaaaatgttcctaaaaacaaagcccttaagctgagtcatagaagaagagcaatgtatacccatgaactggtaattacagctacactgaatagtgcacctaagtgtaaagctctcttctaagtactgcatatactgactcatttaatccccacagcagccccatgaagtgttatcagtattttcattttacagataatgatactaaaggacaagagagcttacataacctttattgcagtcaaatacatagtctaatttcagagccaacatgcataattgctgtgctcttgtgcctcttgaggttagagggcagagctggcaccatcctcaaggacaaagaacagcatattatacgtgaagacctactaaaaaggttgtgtttcaagaatataaagtgcaaagcaagcaatggagcaagaagttggagaggagaatatgactggaactggatcatagagggcaatgttttgtcttcctaaaatagtaattctgtttttatattggcagatatggtaactgtcagaaagtttataataaggggacaaccaaggtgagattaataacgaatattcagaactctggaatgtatcaaaaaacattaaactggaacattaattaaatatgtattattcaaagcattttatagtaagtaatagtattactattagaattagtagaattcgatgctattaaaatcatctaatagtgaggctttagaactttaatttattctaacttttaaataatacatattttattgaaaaagaaaaataatttcgctgtttgttttatgaatcaaatacccttcataccaatatataataaaggttagacataaaagaaaacaccaggtccaaacattctaatagaatattagcaaactgagtaagtatgccattttcaaagttgagcactggaatgccatgccaatgaattaattggtggaggtgattctcaaaatacttaatcttaggtttactttattcagtgcctctgcaggaagattcaagaagacctcccatcctttttgaggtgggtatttgtgggagaaggcacaatagtttagtttaatagtagctttttgtgatttatcaaagaggaataaagacatcccaattcttccaccacagcagagtgaaaatgtctttgattttgtaatatataagaaagatgctcattctgtatttatacagtctgattctactctaatacacaatagtgtgcaaatggggatagaaaacagttgagttttcctttcatgtatggaaagctgcaaagatgagtatcttgatcttggtgtgaatctactgggatggagaccagcaagacttgactttaccatgaacagacattgtgggaaagatggaggatggtcatcactgggcagcagatccctggtagaaatgaggacaaagccataacaagaacattccaagcagtgacaggcacaaggcttccttcctttttgtgaatgggaacctattcaaatttccctttcctaaaagcctgaggccccaaatatttgccatgcaagaaataatctattcttagaaagaattagaagaaagattccttgacaacaaaagtaaagctttgcttacattatgctttgggaaattgaaatgaaatgtgtgttaactaaaactggaattgcaagacaactacagctatcaggaacatcatgttggctgataagctatgaaatctcaatgttatttgttaaatatatatgatgctagaaaaatcatattacgggcattttgtttggtgtttttgtttctttattccttgtacttttacatatgtaatatttccatcttgattttcttagatatacattctaccttcctctaatgactttagtaacatattattagatatttcctacctaaattcggaatacaaattcaatctatttcaagttcagtgtaatagtcactactttattccagcagttctgaatgtcatataccctgagccaaagttccatctaatagtctcttagggatttgatgaaaactttctttatatactataatatgtattcatatacatagtaacatttattatgcaggataaaggctgacaacttttttgtggagtataaatcttcaaataaaataggtgatgcccattatttttaaaaatcaaataaaaacatacatactcttcacagttgtctaatagaaaatttggttaaatagaccaaatatttccagatgctctaagatagaaaataaaatgaagaaattttgaaagtatttagctatctttagaaatgaaaattatttattagctattagtgtacatgtttccttgtgggagagaaataatatgattttatatttattttctaatactatctcataatcacagatattattggttcaaataaccatagtgaaaacaagatgttataagaggttattaagaaaaaggtaatacctctattagatatttcatctaaaactacgaagcagaagaaatgtatagaaattacaaattaaggtaatcaattagaattctatcagaatactttgggaaatgacaaatatacatattttaaatatgcaaaaatgcaatatcttcattcatattttatacttttaactttgaaaaattaggatataaagaccatgaaacaaaaatatgtatttctatttaaattctgagttgcattacaaaaaaaggtataaataaacatcagctaagaagccatttctcctaaagggaatacccaattttattacactataaatgatcctttggtgtaaaatcaattgagagtatgcttgataaatttaaaaaatgcaaatatggctaataaagtgaaaaaataatgaattatatcacaagaatacagaagcaaatgaaaatactatcctacataactgttgtctacacgggggaaaaaaacctactttctgaagaaaaataaaaataataaaataatgaaaacacatggatgctgacaaagatttttctgaaactaataactttaaatgttttcattattcaatctataaaatgaaaatgaagtaagtttacaactcaagattttacagcaaataacaaataagttccactctgatcttgcttatttcttgtcttctgctagctttgtggatatttttctcttgcttgtctagttcttttagttgttatggtagggtgtcaatgtgagacctttctagctttctgaagtggcatttagcgctgtaaatttccctcttaacactgctttagcagcatcccagagattctggtacattgtctctttgttctcactggtttcaaagaacttcctgagttctgccttaatttcattgtttacccaggagtcatacaggagcaagttgttcaatttccaattgcgtggttctgagtgagtttcttaatcttgagttctaatttgattgtgctgtggcctaagagactgttagttattatttcagttgttttgcatttgctgaggagtgttttacttccaattatgtgatcgatttgagagtaagtgccatataactccaagagcggaactgaaggagatagagacacgaaaaatccttcaaaaaaatgaatgaatccgggagctggttttttgaaaaaaaaatatatatatatatacacacacaccaataggtagactaatgaagaaaaaagagaagaatcaaatagaaacaataaaaaatgataaaggggatatcaccactgaacccacagaaatacaaacaagcatcgaagaatattataaacatttctatgcaaataaactagaaagtctagaagaaatggataaattcctggacacatacaccctcccaaggctgaacaaggaagaagttgaatccctgaatagaccaataacaagttctgaaattgaagcagtaataaatagcctaccaaccaaaaaaagctcagggccagatggatttacagctgaattctaccagaattacaaatagaagctggtaccatttcttctgaaactatttcaaacaattgaaaacaagggacttctccctaactcattttatcaggccagcatcatcctgataccaaaacctggcagagatacaacaaaaagagaaaacttcaggccaatatccctgatgaacattgatgcaaaaatcctcaataaaatgctggcaaatgaaattcagcagcatataaaaagcttatccatcacaatcaagttggcttcatccctaggtgcaaggctggttcaacatatgcaaattaataaatgtaactcatcacataaagagaaataaagaaaaaaacacatgattatctcaatagatgcagaaaagtcctttgataaaattcaatatcctttcctgttaaaaaattctcaataaactaggtattgatgaacatacctcaaaataataaaagccatttacaataaacccacagccaatatcataccaaatgggcaaaagctggaagcattccccttgaaaactggcataagacaaggatatcctctctcaccactccatttcaacacagtattggaagctctggccagggcaatcaggcaaaagacagaaataaagagtattcaaataggaaaagaggaagtcgaactgcctgtttgcagatgacatgatcccatatctagaaagccccattgatcagcccaataggttaagttgataagcaacttctgcaaagtctcaggatacaaagtcagcgtgcaaaaaccactagcattcctatacaccaacaataagcagagaaccaaatcatgaatgaactcccattcacaactgctacaaagagaataaaatacctagaaatacaactaacaaggaaagtgaaaaacctcttcaagaagaactacaaatcactgctcaaagaaatcagagagggcacaaacaaaaggaaaaatactccatgctcatgaataagaataattaatatgacaataggcatcctgcccgaagcaatttatacattcaatgctattcccattaaactaccattgacattcctcacagagttagaaaaaactactttaaaattcatatggaaccaaaaaagagcccatatagccaagacaatcctaagccaaaagaacaaaactggaggcatcatgctacccgacttcaaactatactataaggctgcagtaaccaaaacagcatggtactggaaaaaaataaacacatagaccaatggaacagaacagagatctcagaaataagaccacacaatacaaccatctggtctttgacaaacctgacaaaaacaagcaatggggaaaggattccctatttaataaatggtgctgggaaagctggctagccatatgcagaaaattgaaactagaccccttccttacaccttatacaaaaattaactcaagatggattaaagacttacatataggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtagcgggagcctgtagtcccagctactcgggaggctgaggcaggagaatggcgtgaacctgggaggcggagcttgcagtgagccgagatcgcgccactgcactccagcctgggcgacagagcgagactctgtctcaaaaaaaaaaaaaaaaaaaaaaaaaaaagacttacatataaaacccaaaactataaaactctagaagaaaatctaggaaataccattcaggacataggcacgggcaaagatttcatcatgaaaacatcaaaagcacctgcacaaaagcaaaaattgacagatgagatttaattaaacaaaagagcttctgcacagcaaaagaaactatcatcagagtgaagaggcaacctacagaatgggagaaaatttttggaatctatccatctgacaaaggtctaatgtccagaatctacaaggaacttaaacaaatttacaagaaaaaaaccaaccccattaaaaagtggacaaaggaggccaggcacggtggctcatgtctgtaatcccagcaatttgggaggctaaggcaagcgggtcacttgagatcaggagttcaaaaccagcctggccaacatggtaaaatcccatctgtaacacaaataaaaaaattagccacgtgtggtggcagccacctataatcccagctacttgggacactcgggcaggaaaacagcttgaacccaggaggtagaggttgaagtgagccaagatagtgccactgcactccagcctgggtaacagagctagactccatcctccatctcaaacaaacaaacaaacaaacaaaaaacttacgtaaaggacatgaacagacatttctcaaaatgagacatttatgtggccaacaaacaaacatgaaaaaaagctcaaaatcattcaatcattggagaaatgcaaatcaaacccacaatgagataccatttcacaccagtcagaatggtgattattaaaaagtcaagaaacaacagatgctggcgaggctgtggagaaatataaatgcttttacactgttagtggaatataaattagttcaaccatgtggaaaacagtgtggcaattcctcaaagacatagaaccagaaatactatttgacccaacaatcccatttttgggtatatgcccaaaggaatatagatcattctgttataaagatacatgcaggtgtatgttcactgcagcattattcacaatagcaaagacatggaatcaaccaaaatgcccatcaataatatagtggataaagaaaatgtggtacatatacaccatggactactatgcagccattaaaaaaattagatcatgtcctttgcagggacatggacagagctggaagccattatcctcagaaaactaacacagaaatggaaaaccaaacactgcatgatctcacttacaagtggaagctgaacaatgagaatacatggacacagggaggggaacaacacacactggggccagttgagtggggcagggacagggagagaatcaggataattagctaatgcatgtgaggcttaatacctaggtgatgtgttgataggtgcagcaaaccaccatgtcacacgtttacctatgtaacaaatctacgcatcctgcacgtgcatcctggaacgtaaaataaaataaaataaaactaaatttaaaaaagagactaacaaataagaatagcaggggaaagcattaataaatatatagtcagcaattaatgaataagaaaacaaaactttgataactgtttattttaaagaaaatattaactggataggaaaacacaaaggaaatttagagatgcaagagcaaatataatcacaggcacagatgacatatttttattgtatactgaaatagtagacttaaatttttgctaataaattcaaaaacctcaatgaagcagaaatttttctagaaatatattggcaaaattgatacgagaataaaatcagtggaaaaaacttatagacgatatgaagaaaaatggtcatagttctatttcataagagggtttggagaagatgacaacttccaaatttagtaaaaaagatgtctcaagataatattcttaccaatgagaaaataataaaatgcttagaagtttaattttataaggctaatataactctattatcaaaaattcacaaaacaacaaataaaaataaagcaaaacaaaacaaaaagtctttgcacatttaaaacttgtaatggtaacaacattatttgactgttccctgcgatatttctggttttaatatccattacataaataaatgaatgcacaagaaaaattttaaaaatactaaccaattgaatctgaattacatgtacagaaataaacatgatgccaaaattgataaattttagaaattcaatgattagtataattcaacatataaactcaacgtaagtatttacaaaggggaattgaaaaatttaacacacttttgattaactttttaaattaataaaatgtattaatgtaagactagaaaaatatttattcaatatgattaaaaatcccatttcagagacaagaaaaagaattccatgtattatacctctttttttttttaacatactagatattgaaattgtggaagaaaaatatgaataatgtacaaataacaaacaaaattatctttattctcttgtaacatgatatttgactttaaaaaattaatcttagaactaacaaggactgattggctaataagataaattgaaattaaaatattcaataggaaatgcagctaaaaaaagatagttgggagtgaagataaagaaactgaactgggttctggatataatcaggttatgttatttggatgataatacgcttattaaactactaagtatacaggactggagttcaaaagaaggatggctctacatggttctagtcctggcatactacttggcaaaaataagttctgaacaattatttgttgagtaaatgaaataaacctctttgggaagtaaaagagaaagtagaagaataaacaagataatgctaggtcatgaaagtcaaaatacatacatacatatataagagaactcttacatcatatgctacacgggagtcaaacagtatgaacccacaaaaatagttcatttcattgccaggaaattatttttgactttaaaatatatattagttgagagagacaaacagaaggcaaattataaaaagaacctccgtgatgacttttcaaaaggaggtaatgagcacagaccactttgtcaaaatgtacccacttatggctaaagttcgtaaatcataaaagctgcaagagtatctcatcaaaggatacaaatcctcaaagtgaaaaggaatctcactgctatctttcctcagaattgtatatacagtttattgtttacaaagcaaatttgaaaacatcatttccttcacatcttaaaacagcttgagagatggacaagacagtactgttagctttctctttaatttaggttccattttttttcctcaataatgtaacagattcacagtttaaaattcaaatgtacaaaatgttgaaaaaattgtcccacaccttctcaaaggcaatctgttctatcagattcttatatctttctgagatattctttgcatatgtaaacaaatatttttatattttgttcaaatattagtagcatactttttatttgagcagattttgaacaacgttctagatattaatagactttgccaaagatatctgacaaaattaaaaagtggcatgactatagctaagatatatttcttggcactcagtatattgcctactactgcaccttgatgagttttcaaataagagtaatgggtatgctctaatttatgcaatatatctggtcctgtgaaaactgaatgcaattttgcaattttatataagataaatggagaaataaagcctaatttcttttttcattttttattaatatataataattttacatatttatggggtgatacatgcatagaaagtgtaatgatcaaatcaggataattaggatattcatcacctcaaacatttcccatgtctttgtgttgggaacattcatcttcaattcagaataccgaatctaatagttggaaatttcaataatcatttccatatttgatgagatttagagaagaacttgtattcaaaatgaaagacatttaaaaacttttcagaatgtacttctgtaaaataatcacctctaaattatctattttgaacactgtaattttgaacattaagttttataaagttgcccaaatctatactatgtgtttttattcccagacatcttgtttagtcattatgtgtgaatgtttcatcacccggccactgtcaattaaaacgtaattataaatataaaccacaaaatatttttttgagtgttttctcttttattgattcattttaagttttactggtaaatgcaaaaggtatgagtagtttgttaatcacttttcaaagtatcttctgcatatacttacagcatgtattatgtaaatcacagtacattattaatctattgtgttatatctattatgaaaaattaacatttttgaaacaaaaatagcaatatgttcaagtgaagagctagaatataatgctcttaacagaaaagaagaggaatatttaaagctatatgctgaaaataacgatgtgtcaaattttcaaccatctcgaaaagaataacacaatatttatttaacaaaataataaaaaatacgaagctgttgctttctatcccactgatttactgcttgtgttgagaaaggattatcacattcacactactgacatgatgaatataacaaataaaataaatctccataagaaattatgttccaaattgtgaaatactaatgtttcagagtgcacacaacttgcatgaaaaaacatgattaaagaaaccaaatccttctattagctgcactgaacccctaaagcaatttaggaatttgtttcttacagacaattaatcacatgcaggcatgccagatgagaactattgattgcccttttccaggctagtggcattcagacagtagacagacaaatgccctaagcaaggggaagcatctttctgcttctgcctgatgtagcttttaattgttctttcctaaaatgcatgacatttgctgttaatctttagtgtagagcttactcctttctttttgagcagtacacagataggtgtttttttcatttacctttacaccaaggtccttcattagctcaatctcaaaattcactacatcatacggcagccggaactgaggaatttcagaagtactgaaaagaaaggagaaagaaaaacaggcatcagtagaaaaatgaccaatctttgaccaatcttaaaaaaaggtaacatgtctttatggattagtagaaaataaatatctcttccaaggatatttatatatcacacaagatatgcatgaggacatctacattcttattgatataaacatgttacgtggagtgaagatacagtagaaactgatataaaaataactaaattacagcaacagaaaatgataaatataaaactggccaaaagcaatttcaatacttttaagttcaataaagtatttggttgatttatttaataataattctataaattcctaagataaaaaatcttaaaatctattaataaagctagatggagatatagattttaatatatgtatacacatatatatatacactaacattcatatacatagtctataaatgtacttctagcttgttgatatgcaaatgtgtaactgtattaccatactgtttagaatattacaaaatcagttccatgtgatctatagaacattttagtcttctgtgaaagcaatgagtattccaaaagttcagtcattaaaaaacaattctattgtatattaatgcctattgcctgcatttaaaaaaaaaatgaggcctatggcactattatttgagtagtataatagagtattaaaagtaagctaaaaacactttccagtgttttgttaacaattaaaaaagctatgtatgtccatgaatacacagcaatccattcattcattcatttgctgaatcattcattcacctactcattaaaagtgaatagtgccaggcacagtgtttacgaagtgccagctaagtgtaagctgcaatgatttgatggtgaatttcaccaaattctcactgttaataagttctttttctgatcagggaaggatacacaaaagataattacatttagaatgtggtacgcacaatgagagaagtatatccattatatctttaatgtgtatatatacataaaatagcaatcatattttatatattatagagattaatttggaaaataaataattgttgaagatgaatcttctggatcatcaattgaaaaatctcccaaagtacagccttttcattgtttgatgacttaagaacttgattatgcaattaatttttatatatcaatcagcaagacatcatgctcaatgctatagaaaatgcaaggtatccgcggtggctcacgcctgtaattccagcactttgggaggccgaggccagcggatcacgaggtcaggagatcaagaccatcctggctaacacggtgaaaccccgtctctactaaaaatacaaaaaaattagccaggcatagtggcgggcacctgtagtcccagctacttggaaggctgaggcaggagaatagtgtgaacccgggaggtggagcttgcagtgagccaagatcatgccactgcactccagcctgggcgacagagccagactccgtctcaaaaaaaaaaaaaaaaaaaaaaaaaaaccaaaaaagaaaatgcaaggtatcaaacaccataaaatcaaagctgtacactaaaggagcttccctctagttaggaatacaagatgatgtttaagaatgaattcaggcatagggcagggataaaaatctcttaagccaacttgtgaactccagccacattacctcaaggtaacaagaatgtgccagaatgctctgggcaccaagaaggttttcccttcaaagtctaagtagaaagattcttaacaactatggactgtatgtggacacaaacagacacacagacttgatagacatggggctgcatgagagggagattaaatatggactaaaactgggcactgatgcagatcctcaaaaggttgaacaggaaagcaaaagcaatggactatgaacaaagaattccagccaaataaaccaactacaacaagatgagaatcttaaatacatccagacacattgtgaagccgagaaccttccaatgagtcaggcctactcttggatttttatgggatgttaagtagaagcacatggaataaaaggaaaaaaaatggtgtgagtgcaagtcaatggttctgacttaagaaaaaaactctgaaaggcatgttataaaaagcagggacaacttttctgttggtcagaaaaaaataaaggaaggaacacctaacctagcaggaagacacctgagaaaggaggaaggggcagccaccacccttggcagtataactttgaatgcagatgcaggcaccagagaaaatggaagccaggctgctggagttcagcaactctgcttaaaaccccatgctgctctggaaccattgtcaccaacacttagcacagtgttaaacgaataagtgtgagagaatccatttcccagcatctcctgaagcaaatcagagaaatatgaaatactgagaaatgttagatttggttacagtcaagtaggtagggggtaggtggaaattactgattgtgaaaaatgtgacgtttttatattcactaatggatgaagtcagcaaatagacgaaacacatacacacatacatcagcagaacaacatgacaaatgtaaaatactaaatgtgaacaagtgtttcaaaggagggaaggcttattgtgggatgagataagtgggtaggggaaatgtcttaggactttaaaatatcatcagtgtatgatggcttccacatttttcttcttaaattccagacttttatgttcacttgggtgtctaatgggtaactcatatttatcatgcctaacagtaagctttggttcttgcatcccaacactggtcctcagacaaccccattttatgagttgctcaggacctaaactccatcatcacacactattccctttccagccccacaccaagcccagatgcaggcagtaaagtaaaaaggtgtgttctttttagacaatttaaaaaccattataaaacttactaaagtgagtctgttttgtcttattttcatgagctagcaattctaaataatatcactaatatcctaaacaatgtcctctgccaaaataaaaaaaattctctggtgagtctaaattctaaacaatagccatagttgctattgagttttagtaatatatatgtaagctttcaatgatcccatttttattaccaactctttaataaacattgtgttctacaggaaagttaacttgcagaactacagttaaatagaggccatcagcaactgctgattcagctacaggcattcctcattccaattccccataggcgacatatgcctccactcttgtgatactacagattccaatatgtgaaaagttgatttggaatagataaaatgatagcacatgaagcaatattaattacttcaattctgtcattttgtatgatcacatggaatttttgtgtttaaaattgaaaatagctatatccttcacattaaaataatgttttaatcattttttgttttacaggaataaattaaaaaataattattactggttattgtgtgattcttattcaatcttattgtatagaccagaggatagcatgttaaaaaaatctattctgagtatctagtatgctaggtataccactaatccatcattttttaaaaacttcctccttgcatttatcctcacttaacatattctatatttggtttattgttcgtttattgtctgtctccccacgactaaaatatagggcccatgagaaggcactttgccttgtttacttttatgctctaaatagagccagaaataatgaccagcacatagttaagtgatcgatatatatatatactgaaggaaggaagggagggaaggagaaaggggaaaatacaggtaggtatcaggtcgtggaagggtttttatgccaggacagatcctttatctctgaggttaggaggagttgttgaaagatttcaagtggaagagtgatagaatcagatttgaaactaaaggaagaatgaatttgaaaaaacaaatcaggaagccaagataactgcttggaagctactgcagtggtaaagaaagtgagaggtggccgggcgcagtggctcacgcctgtaatcccagccctttgggaggccaaggtgggtagatcgcttgaggtcaggagttcaaaaccagcctggccaacatgatgaaatcccatctttattaaaaatacaaaaattagccaggcatggtggtgcatgcctgtagtcccagctacttgggaggcggaggcagaagaatcacttgaatcccggaggtggaggttgcagtgagccaagatctcgccactgcactccagacttggtgacagagccagactctttcaaaaaaaaaagaaagaaaaaagaaaagaaaaaaagaaaaaaaaaaggaaactgagaggtaaaggatatcagaggacatttttttagagtgttcataaagtggaattgccaggatattaaagagtagcccagataatccccattttggtgatgccatcctctgagatggtaaactcaggaagagaagcaacattgatcattgatatgaagtttatacggagatgtctaggatttgaatgtataaatctgttgcttagaatagagaaagaggtcagggcagatatggatttttaagaaatttgcatgtaggtgataattgaaaccatgagagtaaatgagattattctgaagactgcatggtgagaaaggagataaaaggacagaagacagaatttaataggaatgattattttccaagtttgttgtgcttaggaaaacaaacttttcttctatctgtgctcctgtaacaatctaaggctttgaaaaaaaaaaatttcttgtaatcgtaagtcctttagtatagtcagtggaaagtcagacaacatgaaaaaaatctttcttctattttcatgtttctttcatgtgatgaaatatatctataacaactttccgttctttttaaagcacaattctcatactctgacagaggtatgcttcagtttattactatagagataatagacttaaatttgtaatacatcacacattctcaaaatatttcctattgctataactagttcacctagacctcatttctctttattgtcaatcaacaagaaaaacaataggcctaatgaaaacaatataaaatttgaaagaggtaaagcaaagggcagcattggcctcactatcctaacaataacatcataatccttatatattaatttataagagaaaaatcagaatgtatatatgtacaaacattcttgaaaatctattagcactattttgtttatctttgttataatatcaagcccttttaaccctgttaaactcgtgtcctaaaaacagaagccactgttagaggaaagcaaaactactgattattttataaatttgttgcaacattaaaaataattgatgtgttcaatgcaatggagattaaatcctagatatttttcactgactccagtgatttcttaaaaagtggttgtgatactaattcaccagagataaaagaatctgtttggatgcaaaggagaaggaaagataaaacttgacattacctctttaagcaattgatttcaaatacaaagctaatttaatcttttttagccactttcaagatacaagagaatgagaggcagccgtaagtagaaaataaagtaacaggaaagttttgtggctataattccggctaaattccagcatcagtttttataatcctgtaacagtgacacagaatgcctgtaccatgggacagtacaaaggagattgattaaatatttcatattgtctctacatactgaaaagattcaaaggcaaaagaaagaatttaacaactttaaaagaaaaaccaccatgtttggtctggatccagagaactctgtctcactaaaaaaatgttcagcaaataaatttaaaaaaaacaagtttagtactaatttatatgaattacaaatgcctatcctgcatttgagttaaaaaagagataggctaacaacagtaatctaccaaaattggcaatacatagtaagttacaaatagggttggttccattttaggccttttgtgaaaatgcaatcaagtggcaaacagatttttcctagtttaccagggtacacaattaagttcatattttaaaaattgactcagatattcactgatgtgtataactgaaaacaacatacaatgcttatacatatattgttaatagattatgttttttctaattaataaagctgtggtaaataccattaaaatgatattctaaatctttccagagaaataatatataggacattttactttccagaaaaataaattcataaaatacatgtaatctcttggaattcatagtagtggaacatcagtacagaagaataattatttcttaacaatcaggttatttatgtttcatgcccacactaaagggtcttcctaaaatgtgatatttttgcttgatgattcagtcaaataagattatattaatgatagcttatacatcaatatttatgttaataaatatatcaacatatttatatcaatgatacaaataattgataattgataattttatattatcttgggcttagcatattgttgtttgagtaatattgaaatttatacatttattaacatatattcactggtgccaaaaaacataagaaacttcacaaattttagtaacaaatttgattaaatttatcctctgtgattattgggtatgattaatttatttgttacacatagggcagtagccacaacaaatttaaatgttaagcatagaaacagatattccaaatggatacattttgtaatccatgatttttttgataatatacatagagaaaataaaaatcaattgagtaatattattcagttaccatccaaattctttattttgtataaaatgttttaagcaatatctattccctaattgtaataaattttatttctttatgataatgaaatatgtgtcccgtatagagttctgtttattttcaatatatattcccatttccatgtataaattttcatgggaataatatgatcatgtgattttaaaaatgtatatttaaatacatttctagtacatgctgacaaaattttaatcaaaagtaagacttaagaaattttaaactgaaaatatgtaagacaacatatctatgtagacaacacaatgaatagtccaatattccatggatctaggttttccacatcactaatatccaggattttcagttatatctccattaaaagaaatattcacagggctaaaatcatttttcatatgattggttcttataatcaaaaaataatttgcagagatttctcttaaattcacagaactagagagaaaattttttaaataaatattgcttcaagccaactgcaaattttaaagtgaataatgtaatcaaaacttgaacatttggaaaaagaacatttaaaataccatctgtgagcctgaagttcctatatgattatgaaccaacaatattcataattgttttgctccatcatttctgacactataaacatgaaataaatgtaggcattaccttaaaccaccaacatattcttgtttttcaaatatagtgatgtcagagtaccccaatcgagccaaaaaggaagcacaacttatacttgcaggcccagcaccaaaaagagcaatctttgcagaataggcttcagacattttttctgggggaggcagcgaaggatttctgatctgtgggatactcattgctttgaatacctacggggaaatcaattgtcatggttaaaattttgaaactagcttacatcctcaaacatatttttaatgtttcaaacgaattcttgttttaaatagcaatgagcagtacattttcagtattaatatggtatacttacaacttttattgtgtcaagtagatgaggagttatggctaactttcagtctttcctttctagagtcatgcctcctctaggaaacactcatggggcacattccctactcccacctagagggtacattaagtgcctctcctctaagctcctacagcataatctgtatgtctctaacataaccatctgtggtatgtgttatgatgtcagtcagtagaatgaatgttagttccctgaatcagaaaacatgtcacatgtaaacacattacccttgcattataggagttagcattgcgatggcacacggtagacatttaataaataatttcttgaattctgcttttgattatgacagattaactttgggagaataatgatttaaaaaaatagttgaaacattcaagaactactgacgcaggcatcttggaagggctaacatctcagaggaaagtaagaacaaagttaagtgaccagaagtcacttttcccctgagggatttgcgacttcttaccaaagggaggaaggctaagcatcttgaagagaaccacagctcagaaaagagatgttggcagtcttttgaaaccagagagacacagagttttggaaatgtaggaggccattaacctagagcaaaataaagtacagaagagtgagattaattcttaaagtgcatatgacaaaaacctaaagatctaaacagaaaaccctatggtccaggaaaaacaaaaactggagtgactaaataagaaagagccctagtacacacctcagtgtacggctgaagcttctggagggctacactctacaagtagggcaaatgaggggtaaatagccaacctagccttgagtcaactcagccctggatttaaatgacagtgatcagtcctcactgttatctatgtaccaaacgatagaatgcactttctgtgaataataagtcaaccacagtttctacaaattttttataaaatgcctgggtttttatttttaaaagtccaagcctgcaagaaaaataaacctaaaaaaattgaaagagatacatacataatctcgtaagtgtggttatcaaaaataaattttagaataactatgattgatatgttcaaaaatatgtaagaagaatgtaaacttcattaaaagctggaatttgttaaaaataaaaaattaaatttactaagtacatttagtaaaacatatttagcaaaaaaaataactagctaatgtggaaggagggagtgggattttaaaaacacattattaaaatgtattaattaaaattattataaataggtggtagagggtaggaaacaaagaaacaaatggtaagatggtaaatataaatgtcaacatgagaaattatattaaatgtaaatggactaaaattccaattaaaagacaaaagttatggaagataaatgccttaaatataagagcacagatagataagtgtaaagttaaagactagaaaaagttatacaaagcaaacactaaccaaaagaaagctggtacatatatatattatatatatatatgaaatatatatataccaatattagaaatattacactttaaggcaagatgcattactaaacttaaagaacatttcatagcaaggaaatggtcaatctttcaacaagattttaaaatacaattttaaatatataaagcaaaattgatagaactaaaagtaaaataaataaatcactataatctcattattctactctcatgaaaacttgactaccaatagaagtggccaatgaataaatccatattataggtaagttatttatgctatccaatggattggctcacacagttgcttgcatttaataggtcaaagcagtaactttctctcctggaaacccagacagagatcaatagatataaatgtaagttttcttaagaatgaggaataaaggtgacaggactttacattttcttaacctcatcccacatataccacaaactattgtaaataaagtcaaaacacataaggaacatccaaacaatcttattttaaaaaattgaagagggtattatcaacaagtattatagggtcaatttctaagcatgagatgaaaggtcctcataaatggtctcataatattttgtcattttcattctaatactttgtcacttttactggtttacttatctgtttcctctcttagaccataaaatatttaagggaagacaacatctttgaattcaccttttaatattcagtgtttttatacataagggggaatatatgttaactaatgagtttaaattggtaataaaataatttcttattcccagctacaatttgtataatttacaaattattaatatgtgttcctgctcttccctgtgctatccaaacagtacagattttcttaaatattgtttttgaatcaacatatactgttatcttttattcctttctaagcaatgtgaacaaggaactaaattctggtagttttatatgatcattaattaaaatgtagttaaaatatattttatatttccccaaagaaaggtttcacatacttttcataaatatatattttattagatcattaattaaaatatagttaaaatatattttttatatttccccaaagaaagatttcacatacttttcataaagagatacttaaaacatatgtttaacgtgatcaaggatctctgatcagggaacagagatatagctaattttatttagggattaaataaatgctaatttctttcatatttagttgaataattttagctttgtgaactaataattaaatatttaactttcccatgttaaaatctgctaacatttacaaataacattgtgttttaacaaatcttaaatgaagacatttatgatgtatttaaaagtatcatttattgctgacatcttttacaatggaagcagatttaaatgtactaaggctacagcattcattataatatgaagttacagtgtcataaccaaatggaatataatttgtgctcagcattcactcataagcaagaaataggttagttctgaaacgcctagcatatctgaacaaattctagctaatggcatgcaaataataaagtagcaattaccaaataatacacaatatgtatgtattttcacctaaaatattttaatatttttgaataaaaatttaagccttcttttaaaaaaattatgagatgcaaacattgaattattttaaaaaatgtttacagaatccctattaagtacccaacacagagttaaagactcttaaaaagtgtttgaagaaatgaaagcaagcacactcctcagtacacatagcatatgtgcacatactagaatgtaaattgttagcccgatttgctcaaccccgtgcactgcagcttaagagttgttcaatacatactcattacattgcttggctcaatacactaatctatcaattggtatccctttgcctgctctgttctggaattttttctttacaactttttattgcactaggttttccccgagtttaacaggagtttggattaaccttgatgcaatttttaaggaagtaaataattgaaccacatttttgtgaatttcagcacaacagatggtatatttttagaagtatggcattgaaacgagactcttggggttgagtcttgacttccatcattctcatgatgtatagaattgaacaagtcctttaacatttctatgcctcagtctccttaataaggtgggattaataaaatatatttcatagagatgctttgaggatttaatgagctaattatatgtggaaagtgctttaggaaactgcctgcccatatagcaaatgttatctacttctcatttcacctagtgttcaaattccatgagacagaatgtatctaaactcatagtgtccaagacggaatccactagccacatttgattaagttcaaattaaaattaaaattaaataaaattaaaaatgcaaagacctcagtagcactaattatatttcaagtgctcaataactacatgtggctagtggataatacatcgaacacatccatcactgcaaaaattaaaatttcaaacatataatgcaatagatataaataatctcatgagcatagttaatgggaaataaataatttagaggcagtgagtttgtagtatttgttatagttatttttaatatgatttttatgactacatgttcatatactttaatttttcaaaattactgtgtttcacaacctgtttacaaaattcctaaaaatttaatcagcactagagctggtcctggctggcttcagcacactattgcacctcggcaatacatgagggctcattcaatgtttttttagccactaatattcttctaccatcaaccctaaattctgaaatacataagttacactttccaacttaatagagatctgaaggcataagtggccctctatccctttaaaacatcagcaactaactcttttttaactgaaatacaagtaatggattatttcatatatacacaatatacttccatgaatgtagcctgattatgacaaaatgagggcaaatggataaaaagccaaataaatagctccaaaaatattttgtgggtgaatggggggtagtgatttgtatttaagtatattatgaaactatgaaaattgaaatcaattataaatctagagttggcattatatgaaaaatgtaaattaaaataactaatattgtaacactttaaactgccaatgaatagattgtgtaagttaaaaaaaagagggttaacttaattttgttaaatttaaaaataaaagtttacaaaagttagttaaaacaaattacaaaatttaaaatgtccataaatacgaagaatatttttcaaaaataatatttttcattccttttattaaactacatcagtcttcagagaagtgcaacataaaattacaaacaaattatacataaaagatattattaggtccagttacttacagtatcaaattcctaagagattttttcttagaatatagttccctattgtttcataatgtaacaaaaatattataaaataatttggctctttcggtgagaaagacccctctttttttcgttaaagcaaatgtcagttgtccatcaactgactaatattctatgatttaatttttaagttgaagggtcaactgccgaaacaatgtaataaatgaaataaacttgttaatatcagaagagagtgactgaagtatttaaagatgaatgaaaagtatacttaatatgtatttccccacaataataaggtggccaatatttattgaaatatatcctatgtgccaggctttatgttaaatctctatcatttagtcttcaaccctcctttatggaggtacaattatcagatccatttcctaggtaagaaacctgtggtcaggttcacatacaaaagattttatcttaaggctacttgactccaaagcctgaactctttttttttttaaattatactttaagttttaaggtacatgtgcacaacgtgcaggtttgttacatatgtatacatgtgccatgttggtgtgctgcacccattaactcgtcatctagcattaggtatatctcctaatgctatccctccccgctccccccaaccaacaacagtccccggtgtgtggtgttccccttcctgtgtccatgtgttctcattgttcaattcccacctatgagtgagaacatgcagtgtttggtttttttgtccttgcgatagtttgctgaaaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttccagttctagatccctgaggaatcgccacaccgacttccacaatggttgaactagtttacagtcccaccaacagtgtaaaagtgttcctatttgtccacatcttctccagcacctgttgtttcctgactttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatccttcgcccactttttgatgggttttttttcttgtaaatttgttttttaacgattacattttcacagtaatcgctaaaaaattcactatatttctctaatttttcaataagaaatgtataactgaaaaaattatatgaatttgtcattcctaacccacttagaatatgttatattttaatatattaaattcatacattctgataaaatagattttgatatattctagccactctactaacaaaaatagctggttattataattaataaattaactttacaaaccaagaattgttcatgaagcatttaaaaaacactgaactacatcatctggtttcccaccatgctatcctgccacccgagaactaaggtagttggtgcattaagagaactgcctccctattatcaacatcctctccatagtggtacatttgagtacatttattacaactggtgcaccttcaatgggtttgcacaaatttattatgaaaatagcatcataggactacagcatcatacacaatagtttctttcactgtcctaaaaatcttcttaatctccatatgcatccctctctcaccttctccccagcaatcactggtctttttagtgcctccatagttttgccttttctagaatgccatacagttgaaatcatacaatatacagccttttcagattggcttctttcatttagtaacatatatttaagttttctctgtgtctctccatggcttgatagctcctctctttttaatcctgaataatattgcaatatctgtatgtaccatagtttatttatgcatccacttactgaaggatatctcaaaaattttggtgattatgaataaagctgctataaatatccatgtgcaggtttgcatgttaacgtaagttttcaactctttggggtaaattgccagatcatatgataagagtatgtttaattttgcaagatactgtcaaactgtcttccaaattggctgtaccattttgcatttccaccagggaagaataaagttcctatttctcctaatcctgtcagcatttggtgatatcagtgttctgcattttggctgtttggtctcctctgaatgtttgtgtctacgcccccatttcattcaattcgtatgttgaaaactaaccacaaatgttagaaaggtggggtttttaaaaagtcattaggtcatgacttaggaggtgattaggtcatgaggagccctcctcaattagattagttcccttaaaaacaaccccaggagaaataccttgcccctgtcacatgtaagacaggcacagtaaaaagcctttacctatgaccagaaagcagcttatgagcatatattttttttattatactttaagttttagggtacatgtgcacattgtgcaggtcagttacatacgtatacatgtgccgtgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgggaattcccagcatccagaaccaagagaaataatttttgttgtttataagccatccagtttatggtattttgttgtagcaaactgagcagactaagcattctaatagtatagtggtatcccgttgttgtttcatgttgcatttccctgatgatacatatgaggcatctattcagatgcttattttccatctgtatatctttcttggtgagatatctgctaaggtctttgtatcattttttaaatgggttgttttcatattgttgggttgtaagagacttttggacattttgcataacagttctttatgaagtatgtcttttgcaaatattttctcccagcctgtggcttgtcttttcattttctttcaagacagtttcctgcagagtagaagttttaattttgtttctgtgtttgttttgagatgagagtctcactatgctccccaggctggtctcaaactcctgcattcaagcaaacctccctcagccttctgagtagccaggactacaggtacatgccaccacacccagctcagaattttttatatttgatgaagtctatcttatcaataatttattttataaatcttgcctttgattttgtacctaaaaagtcattgtctaaccgaaggtcatctacatggtctcccatgttatcttcaaagagttctgtagttttgtattttacattgaggtttatgatccatctttaattaatttttaatgggtgtaaggtttgtttctagattcacttttttacatatggaagtagggtggtataaatatcattcgttgaaaggactatcccttctccattatattgcctttgctcttttgtcaaagataagttggctatatttacgtgtgtctatttctgggctctctattctgttccagtgatctattgtctattattttaacaatatcacactgtcttgattactgcagctttacagtaagtcttaaaatcaggtagtccgagtcctccaactttgttgttctatattatgttggttaatcttttgcctctctatataaactttagaatcagtttgtcaatatctataaaatagtttcctgagattttgatttgggattgtactgaatctatagatctaattgggaagacctgacatcttgaaaatactaagtcttctatttggaaacccggaatatgtctctatttatttagctttttttatttatttcatcacagtttcatagtttttctcatatacatattatacctatttcattagatttatatctaagtatttcgtttttaaggatgcaaatgtaaatggtatacttttaatttcaaattctaatcatttattgctattgtaaaggaaagtggctgacttttgtttattaatcttatatccttttttgccaaaattgtgtattagttccaggagtttttctgttgattctttggaattttctacatagacaattctgccacctgctaacaaagacagttttatttcttccttctctgtatacatttcctttccttttcttgtcttataaattgcatttgtattctttttaaggtgttcccttccctacaaatattgtatcacttggactattttaagattattttaataggcactcaacaagattttgatgaatttcaaaattcctggccttcagtgatatgcttaaacaaagtagtaaaagtcaccaaggaaaacagttctaccttagtgataatgaagaattatctgcaagtgaatatccttttttaaattttactttttaatatttttactttgtaagtacatggtatatatttttttaattttactttttaaattttttaatattgtgggtacatagtacattcttgaggaacatttttaatattaattttcttgtgtattcatcctgtgatttctcatctttcattcatctagaaagtgcatgtatttcaccactccaaattgactttaccagcattttctccataattttcacattactttgaagaaagggagagattatattgatatttaaaatggaaagattgcaatgcagagaggagccacaggattttcccccaagtctcctcaccttctggagacagaaatagtataattttctaatcattatatagtgttctataaatgaaaaaagacaaagcattgtaaataaaagtatatttaccaattcaaatttgagggtaactcttgcttgttttaacccttcttgctaagagtatataatgaaaataaacataaatgtttgatagctgtaattattcctcaattactctgtttgttctaattaaccaaacaatagcaaatatataccatagggaagtcatgagaagtaaaatactcttggaaattttagaacatctctactagttgaaggatgaattgtaacagtatgattgtattctacatacctcacaagaggattatactcttgcaagtgtttaccttgatttcattatcaaataaaaataatttctggtaatttctaaaggaatgttatttcatcagtgtaggtctaagataaatcttaataaaaataatacatcagtttttcttttgctcgtttcagtttcttgagttacttaattagtgggatgaatgtctcgttaccttttgaatgcctgaatgaagaaattgctatttgtgcatccaaaagtaagtttcctgaaattacataccttctaggagatgcttctatgtaattttctttgttgtttgtttccttttgtaagacaagtcaaaggaaatactgagtacatactaatcactgcattcattctttgaaaagaaatatacttgggcttcttgacaaatagttttcttcataacaattagaccaggaacaccaaaagtgagtactgtgtttcaaatgtattaaaaatgataaaaacttcatgtaatgtcaaatttttatttatcaaaattattactgtattagtaattctcaaagatttttttccataattttcatattattaaaatagacattgagagaaacaactggcaggttaaaaatactgtgttagctgaaatcagaatattctttcattcaatttccttttcaatttggtaggtattgtttaggtacctcctatgtcctagacaccagtatgaaaaaaaacatagactctccagtaactagctccctggataatagagcactcacatgtcctaaatatttttaataaactatattactatgtagcctgtctggaacagggttaattttcacaaacgttgctctcagagtatttgagaaggtaaacccacctgaaagagaaattgacacctaagccaaaccttaaaaacaacaataaaaaaaacatatatatattagacagtacttcacctttttaaataccaacactgaaaattaaaagagtaatgattacttcagcaatttattgtgaagattagagtcaatggtgataacttcttgtgatgaatgccttttccttacaaggcactctctggggaacttaatatttatatctccaatcctaaaaatcttcgactttaggtatgattgttcattttctatacaaaggaactgactcataagattatagtctgtgttattatgactaaacaaaggttatattggatatttgataaaccaattgaatagagtggttaaaactgaccaaatatagatgaaaacgttaagtgtttatagtttagttataagaaacttatccaaaatcatatgctcaggacacttacattagcccacagataggcaaaataatctaccacaaagcctgttataagataaagtactgaatatttcatgtaatttatcgcatacagtactgaaagttaaaaataaagtaggtgaatgagtatttgaagtaagttttctactaaatgtgcatcacttttacaccattttaaagtcaaaaaatcctaagttgaatcattgtaagtcagggactataagtcactgttttttagtacatggtcagttttgataaatgttctgcaagtgcatgaaaatgatgcattcgttctatgttaggctcagaaaagtatagatttcttaaatcaatccaataaactttatacaaataaaccttacaaattttgagtaaatttatgttgtcatgtgtataaatgtttatgaatattacatcttttaagagttttttattattatttttatcttccaaaacacgtccttgtcaatattataaaacttttttttacatctttatttttaaaactcaaaataagttataattactctgggatcaatatttaattatattcacaaccatatttttacacattgtttcttttatctttctttccacatttgtttccttccttctaaagaataactcttagtagatgcagatgagaaatctaaggtcagagtaattgtcatttggttttccagtaatttgttttccctttatcttgaagttctgattctcattatccttagtattgcacaatattaccacaaccctgtgtctaggtgaagacctttcatctttcctttcttctggaaaattttccaccataactgctttaaggctcctcctgtgccaatctctgtctctctactttaggagctccccttacatgtgtattggagtcttagaagcttctgaacttctctattaaacttttcatttattcgtatctctttattgtgctctggttgaatactcagatcatatttttactttttatttctttagttctgcaatttatgcctctatccagcccaaaactgaccttttctattgagattgtcattatagtgtaaatttacagtcaactattttttatattaaactcaccgttgatttttttattttatctccttttaggatattattttatacatattaattttaaaggcctgattataatattatttgtgtttcattaggataaagtcaggtaccatcaggtaagtctttaaattatcactaatagattatctttcctaacatagtttctacctttttgtttctcatttacgttgagtgaattttattctctttcggggcactccccctatggctttgtatcaggtgtgtgtggccttcaatcaacaatactcctatccctctctcccactgcagaaccaagtttcttaaagtccagggctccagtccaaggtgattagaggcatcacagaaccaaatcactgtaccatagacacatgcccacaatacctgctgtacagctttctctacttttttctgcagctttctataagcctcagctctgtacagcagttgcacctattttttattaaactttctatgaggtggagctgagtccagtcctctaccatgcaagatgtttttggcacttaagtttatcttagaccactccccagcagaagttagcagagaataacctagtccccatgtttttataccatttctggcccaaaaggtatttatatttctttttcagttcacctcttaattttttttctactttcattaaattttacttatcatcattatttgaagataaatgggtggcttaaatgttaacttacagcatcatgccttttacaagtgattcatgttgatacaataatattgctttatactaccctatattatgagtcatcaaatatttttatgaaagtatatacatttttaagttgttgaagcttaaaccaacgaatcctttaaaactgtaaattggcaacgaaatagtataaatttacatttatttttaaaaactaatgtagaaaaaagtaaccgcaaataattttaaccatgcgatttcgttaaatttcaaagttattgcccccaaatcacggtagcttatttttaagtcctagatattaagatacagttttaaaacaaactaaaatattgtaataaaaatcatctagcaattcatctggccccacagttctattataaatcattgtgccagtaaggaatattttaatagatttctaaagatttttggagaagaatgtcagatatttagtgaattctatcaagacattattcttttctattaatcactgcattaagagtaaaaggagagacacaaatcaaatcttcaaagatgttacttgtatttgcattccagacagacacattttaccagggtaaaaaatatttatcttattagtgcttaatgcatatttttcatctatatcttacttctctcagaaataattcacctttgtgtttgagggttgggtattggttaaagacattcacaaataattgaatagtactattttaaatagaagtagtatagagaaatcccatttaaagtgataaaactttgggataatagggcaagtgtgatatatcattaatctaacaaatatagtttaatctatatcctatttataaatgacctgcaaaaagttattagctatatatattagtaatttttcattatcatgataatttatcttagttatagattacaaaatgaactgatagattttattgatcagtttgtcaaactgtatcataaatgtgctaggtttattcctaaatttatttgtataccagctttcacaaaatcatacttaggcattccaaaataaaataaaactgcagataaacacttaacgcttcaaggctcctcgtcacatagaccccccctttttatttatttattttttgagatggagtctcgctctgtcgccaggctggtgtgtagtggcgcaatctcggctcattgcaacctctgcctccaggttcaagtgattctcctgcctcagcctcttgagtagctgggactaaaggtgcacaccaccacagctggctaattttttttatttttagtagagatggggttttaccatgttggccaagatggtcttgatttgaccttgtgatccgcctgcctcggcctcccaaaatgctaggattaaaggcatgacccaccacgcctggcccatatagaccccttctaaggccttgtatttaaatttttcagtagtgctgtaatgtaatttctaaagaaggaacccaacattttgttatctgaagccccataaaacttaagattcattcctggctacagaagttaaaaaagaaaagacaaaaaaaaaaaaaaaaaaacaactaagccgtatgtgttggtcttacccaacctatttcaatgtagtagcttcatatctaacagaaaaacaaggacttgtgaggtatggtgaccaagtatatttggctagcctagaagatgcaacagatactgctgtggccttacagccagaaaaccagggtttacattgagcgcctctgtctttgactagtaacattacctggggcaagtaagagtttgtgaaataatgaaaattaaaccactagctttgtattccagatttgcctctcactacatgtgaggttgtggaagttaattaatttcctggagtttcctgttactcatatgtaaaatggaaataataacattatttggagagttattctgaggattaatcaagctctaaataaagtactcaacattgtgcaggacactgggagtttatttaacattagctgtgattttgtaatcactttgattcttagtttccttatgtccaaaatgggaaaaaaattacctggtttgcatgccctcaagcgttgtttatcagcatttttgagtgagatattacaaaaatgcactgaagcactatgcaaagtacaatataactgcattttctccttgcctgatacttttctttgcactaaggtctaatcacctccaaaaccatgtgacaaaaattaatgaagattggacaataagtccaaggatgccaatgtaaacctatatgtctcattacatttactacattatttcaattgttggctttatttcctgagaaactacaatgttccctaggacttgtagtaaagaagcagtctacaacaacacacagtgctgatcaatgcccaatcaatgttagtttgattaactgaatccttacctagtgggctcttactacactgggtattcacataagccagtttgcctggggtggtgttagtttactcctgctgtactggactgattattaataatgtcctgatcattatctaacctatctcggtcatttgatcatcttacttataaagcaatcaacataatacacagctagagtatttccaacctcacttttcagtttatgcacaaatactcatctttttgatgactgtttttaatacggggcttgcacttaatatttctgtctccactcttctatttgatagatgaaatttatcacagaaatacattatttcagagcacacctgcaatactctattgttcattagaatacatatgtctatgttctcctaaaatagagttgtagaatacaaaagtttaagaatttcagtgactgccataaccaaggtgaagatatggtagaagtaatatttgctctattaaaacaatcatatactaatttgagtgaacaagttccttctccattcccaattcttcaaaactgtttattatcgtttttaagcaaaacataaatgttgatgtaatttaaataattgttaaatgttctctaatgtagtctcataacacttgacatttttaattgtattagtgtatatttaccagactaatttaactcaaactgtgtctacccttgataaaatatagaaataaatgtttacagtcccttggaatatatagtatattctttctttaacccttaagaaatatcccatcatcatgttattaaggcataagaatagttaacaaaattctgaaaatggtaaatcaagaataaaacaccccatcatatataaaaatataaaactgtagcaattaatacattttgtgtcagtgaatggatgcataaatagaccaatgtaaaaaaaatagagctccaaaccctgccaaaaaaacaaaagcagacaaattcatacatatgatcttactgtataaaatcagagttattacaaatcagtgtggaaacaacaaactacacaataaatggaattgagttaactggctttctgtagagaatccagggtgggtgtgttatatccctagatccctccatcaccacacatatgacacaatgtacaaagaataaactttttaaaaaaagatgaggaagatgaatggtcaataaacagatgagaaagtttctaaacttcaacattcatttgagaattccacattctttgtacaattatttcttaggaaacataaaacatagaccatattcatcaatgaatcagagtgcttgacttgggaagggaatatcatggcctttagcattttatctataatatatgttcaatctaaagcaaataaaacaaaatacattttatcaattacatgaaaaaattcaattttttattttttatttttaattattattaatacatattagtgtcaaatgtgtatggtgtacatgtgatgttttgatagatgcatacaatgtgtaatgatcaagtcagggtaacttgagatatccaacacttcaagcatttgtcatttatttgtgttaatgaaaaatccaattcaattccagatagttaatgggtatgaaaatacacttacatggaataagatctactgttcagtagcacaatagtgtaactgtagttaattatttattgtatatttcaaagtatttattgcattactgcaaatagtatatgctgatacgacaaggattgagtaaagtcaaatgagaggtgatagtttagaaacctgctgagagacaaaaagtaaaataaaaaaaatgtttaaaaacataaaaaaggaaaatctacagatacctcttttctgaatgagtcacctgatttcatctacaattgcttgtcagttccattctcttttttggcttaaaaccacagaaatttcttacatttttaaatatttcaatagtttttggggaacaggtgactttttgttacactggtaagttctttagtagtgatttctgagactttggtgcacccatcacccaagtagtgtacactgtacccaatgggttgtctcatccctcatcctcccacccaccatttctcttccccctaagtccacaaagtctattgtatcattcttatgcttttgtgtcctcacaagtcagctcccacttatgagtgagaacatatgatgtttggcttccattcctgagttacttcatttagaaaaatggtctccaactccatctacattgcagcgaatgccattattttgctcctttttatggctgagtagtattccatggtgtgtgtgtgcatgtgtgtgtgtgtgtgtttgtatcacattttcattatccaaccattgactgatgtgtatttgggctggtttcacatttttgcaattgtgaattgtgttgctataaacatgtgtgatcaagtatctttttcatataatgacttcttttcctctgggtagatacgcagtagtaggattgctggatccaacgttagatcaacttttagtgctttaagaaatttccacactgttttccatagtggttgtactagtttacttcccaccagcaatgtgaaagtattcccttttcaacacatccatgccaacatctattattttttgatttttaaattatgatcgttcttgcaggagtaaggtggtagtgcattctggttttaatttgcatttccctgatgactggtgatgttgagtattttttcacatttttggtggccatttgtatatcttattttgagaattgtctatttgtgtccttagcctactttttgatgggattttttttttctcgctgatttgtttgagtttcttgtagattctgggtattagtacaataaaagtataaaatctaaatataagtaaagtgctaagaggtatatatcataagatggtatatttcacagatatcagaaaaatcttataaaatgtttttgtgaaataaattttatatttagatgtcaatatcataatccagtatattcctgaaaattcagaattgaggtggtaattttaagtataaattttccagctctcattcattttgacacacaaatcctggaagactgggattttttaattttaatatttctaaattgcctccataattttttaatcagtagaagagaactgatttgacatgcagctaattttctatgtaaaatcgttttttttcaaactttaggcaatgggtagaaagatgcattctcatttccttctgcttttccaacaattcattaattaaatttcagaggcaatgagagtctaggtggtctattaaatgtaaataatatataattctttcaaaattccaataaatacacaaatattttcaaaataaaattttcaagggttatatttgtgcagagaaattcaaaaaccatcatgtgactgataaaatctatactaaactattatttcccagttattttattgaaacaatgtcatgataggattaaaatattactagggaaaaaaagtgcctcctagagtgagtcacaatcaccccggtagcctgtttactacatgaacacaccagtgtgtgaaggaaggtggctttttcacactgcaaatgtggaaacagcaaaaggctgaataggaatgacaacacaagatccacccccaaccctgccaaaaaaaaaaaaaaaaaaaaaaaagcagctggcctcctgattctacataaggctatgcatcatgtgatttattccttttccactatggtccctccaaatcacatgctcatgttaaactggagaagaataaggtatgtacctaaccaataatggcagactactgagttggtattttaaaaatcacttataagtcacaggaaaaacaattttgaaaaataccatactattgtaatctgctttcctaacctttgcttaatttggttgaaaaaatagatttgtatttctttaaaggtcaaaaaacaatcattgttttatcaaacaatcaaaatataaaattatttgcatcatattacacttcaacttaaatactcatgtcaatagtagtttgaaagaataacatttcgcattttgtacttttttccgtgaatatcagtgaaaacggagttactcgttttgttgtttttttaacttcctaataactttgacagttgggtaaatttaagtaaaccacacactgacctagggaatacaggactttctaaaatcaggcaccctaatcggccaacccaaaaaaaaggacaaaaagcttttctcagtagttcccacgaggacatttttaatttataatttgatattgaaattacaattatacaaactataattggaatgaaataagcagatacattcctattctaaattccttgattcacttaaaatgcatctactgcagtcctaatctatgcataactcttcattaggtgatacttatggcaagacctaagtgtgaccactctcaaattttagtaagtttctaataaattctgttctgaaggcacatgtctctgtcttaaatagactctgctctgggaatgagtggtagaaccaagtaagagttcccagagggacagtgttcccagagaaaagaattaaaaccatgtgagagtttccagaggaataatgtatttccctgtctctctctctctttctctctctctctctcacacacacacacacacacacacaaacacacacacctctcatgaccagatcaattactaatgatatcattttaattcattttgttttaaaatgctgtgttagttgatatacatactatgtgacctttcacttactgcatctgtgaaagcttgccctggtttaatgaagaggcaatgggtccccaaagaaaagtgaggaggaattcaagtgaatcttctccatcaactaaggattttcacaggtagtaaagatcatacttcgtagtggtcaggtaagcctaatgcaattttgaatttggtaagaaaagaaattaaatcccagaatttattgcaacaatccacaacctcgaattgtttttattttcttattcccaggagctcttctttagaattaacctgtcagaaagcaggaagggaataaccctgatttattactaagagcaaagtgagacttaagcttgaggaatattatgggaagggtcccaaaatgaaagaacacattgtgtttatgctgacaaaaccagatcagtaagtcattaactaaaaatctaggttgacgggcacttaatttgaccttctagccaactagtctccaaagattataaaatcttactatacccttcatataagctgatcatttaaatgatacatgggaattaacctgcttgttgactccaaataggagacgtcagagagcccaagagtgtctgaagaatcaaagtctttacaaatgattcattaaagagaaagccaggatcaaagtctatgggataaacagaaaaaaaagtgctctcattttatttccttatacattttttacccaaataaaagacctgcttccaatctataagttcacaaaatctaatgacattattaatgtggttaaataacattacttagtttcagggtttttgaaaattctctaacattattactcaaagaatacaatgaaatatgctgtatttcaagctttaaagattaaggagagcttcagggaaaataatctgttacagaagatagtcttttcataagagggtctccttgccatacttccacataaagttaatgaataagttctattttcggatcatctaatttatataatttcagtcaaagtattttaataacctgctgggattgcaactaatttgacatatggttttatacacttcctttttgtagctaagctgctgaataaaaataaagtttgttgtacaaaacatacttgagctgtgtgtcacactaaaaatgttgggtatcaacagagcaccaaggattaaagttattttaagatatttgtgcatggtgatggtagtggggggatgtcacgtgtatatcatacatacctcagtagcaaattgctgcaatccaccaatattaatgggtccctcttcagtggcatataaattgcatccacctacacaaagatcagaggttggacataccattccacaagtcagaccaagtgggttgtcagaaaatatcatcttagcagctccataatagttctgcaaaattaatacaaaataaaattttactacttaaaaatatactttaaacagccaaattacgacaaacattatttcttctactaggtaatcagattgaagataatgatgtgtataagatgcataggtttcaatactactatcaggaaccatcaattaaaacttagcagagtatttgacacataggaatattcaatgcacagtatgttgataaatgaataactaatcaattttggaaaactgaagtttaaaatataataaatgttctgtaaatggttttcatttacaagtcatctaactatatcttgtcaaaaattattcatttcactttttaacaaatgaaaattagatggcattgtttgaacaaactcaaaacctaaactttaaaacaacaaaaaatggttatactcaggttatcctccatttaactaaattaaaagcagccagagctttcattatttttggaacatattattttctgaaaaaagaatgaataataagctgaatatttgggagaatgttttcctctaatcaaaaggaagaattgcatctgaccagtactcctgaaaacaatcaagtacatcaaaaacaagaaaagtctggcaaattttaacagacaagagaagcctaaggacacatgacaaataaatgtattgtggtgatttttatgatatactggaacagaaaaaaaagtaaaaattaagaaaatctgaataaactagggactttagctaataatcatatatcaatattatttcattaactgcaacaaatgtaccatactaatgtagggtgttaataataggggtaattatgagtgcatatggaaactctctgtactactgtcacaatttttccataaatctaaaactgctctaaaatacattttaagaatagagctgatagaatgcacttaacaatataaacatattgcatttatttttcctttggcttttatttgtaataattttgaaggtctttgaaagcacagacgttgcttccatgaaaagcctcagacataagtacagattcctagtgattacagaatactgatgataacaaaaaggaacaatgacatttactatttattgactctttaatatatccccagcactttaaaagacttttatttactcttagcaccaattattttatttactgttatcatctctcactatataggatgtccattgctcgatcaaaaattcctagatgcaagaagagacaggaccaaacgcctgataataataagaaaacaataaataaaataagcaaactcctaggtaatcaagaaatttaagtcagaataaaagacttttaaaaataaccttgacgaaaattcaggaaaagaaaagacaaaaaaagaaacaattaataatagcaccagaatactggaatctgtttaaaaagaatcaaactgatattttagaagtaaatgaacattttaaaataaaagctaatgcacggctttcacagcattcgtggtggtttaacagtatttgtcttgttcagtgtcccttcagcaatgaaagttatgtctgccatgtaagaatggttcttctacatatattttctgaatatgcagtaagaatgtggtatgaaattaaactcacaagcaataaaactgaaatataaagggtaaataattagcaaaggatcataaagcagataagtggcagagacaggattcatactaaagcatactgttcatggctcaatagattacagaatctagttacagtgatcttattcagctatggtccatatgttgatgtaaacacacacacacacatgcatacacacacacacaaaagttcttttcaatataagctggaggacatatagctagtccattcgattcattacactttatattaagtagtttttattacatagttcttttagttgtggtctttccatcagttcaatgaaaagcttaataagttaaaagtctgtttcttttaatcaagagattaggatctgtttattcccccaaattggatcagatttaccactgtgtttgtcagagtcttcggtagtgtctctaaaagaggttaataataaatcattaagctgtcaaagtataatatccaaaagtcaacacagaaatatcttacacacagagaagaaaaatgtgtgaaagattatatttacctcattaacaaatacagaataaagatagtaaaatctgagtcaagggcatttgaggctgccatggcttaatcggtgaattgtataaaacatataataacaatttatgctaatttctgacaaatacttctagaacatacaagaaggatttatctcaggaatgcaaggttggtttatatcaaaatataccatatcagtagaataaaagacaaaaaatcacacaatcatattaaaagatgcagaaaaggcacttgacaaattcaacatccctcatgacaaaagctatcaacaaactgcaaatagaaagaaacttcaacaccttaataaaaggcctctacaaaaacccacagttaacatctcactttatggtgaaaactgaatgccttcctccaatatcaagaaaagaatgttcactgcattagtcaaggagtcaaaagttctccagagacacagaaagaataggatgtatgtgggggggggggggggtgtgtgtgtgtgtgtgtgtgtgtgtgtgtgtgtgtgtgtgtgtgtgtgtgtgtgtgtatgagatttattataggaaactggtacacaattaagaacctgcaaatttccaagatctgcaatttgagtctgccagctggagacacagaagagccaatgttttagttcaagtctcagttggaaggcctgagaaccagttaagttttagttttagttctagtccaagagtaggggagaaagccaatgtttcatttcaaaggtagtcagacaggaagaattatgtgtttttcagggtagagctagcattttgttttattcagtcctttaactgattagatgaggctcacctacacttgggagggctatctgctttactaaccttactgatttaaatgccaatctaattcaaaaacactctcacagaaacatccaagataaaatttaaccaaatacttgagcacacaaaggttcaatcaatcggacacataaaatcagccatcacactaacttttacaacttctattcaccatagcacttgaaattcttgctagataattaggcataaaaggaaggaggaagtgacagagtggggagggatagagatagagaagaagagagagagagggagagagggagggagggaaggaaagagagagagagagagagagagagagagagagaaagttatccagattggaaagggaaaaattatttctatttccatgtaaaatgatcttgtatatacaaaccctaactaatccactaaaatactatgagaagtaataaaagtacagcaaacttacaggatacaagattaaaatgcaaattaattgtatttcaatatgttagtaatgaacaaacgaaaaataaaatcaagacagtaattccatttacaacagcaacaaacaaaataaattattcagaactatatgtattaaaaactgtaaaaagttcaaatttatactctgaaaactatagaaaactgttgaaaggaactaaataatacctaaataaatgaaaatacatcccatgatcatgggccaaaagactaattattgggatggtgatactatccaaatttatctaaaatttcaatacaatctctactaaaatcccagctgagtttgcaaaaattgacaagctgatcctaaaattcataggaaaatccagaggatccagaatagctaaaatgaaaaataagaatgaagctagaggactaacacttcctgatttcaaaaattactgcaaagctaacataatcaagatagtatggtactgacatgaggataagcatgtagatcaatgtgatataaatatgagtccagataaaagccttcacatttatgttcaattaatttttgaaaaaggtttctaaggcaattcaattggaaagaatattcatttcaatgaatgatgctggaatatctgaatattcacatgcaaaagaatgaagtttgaccctatctcacaccaaacaaaaaaatgaactaaaagtaaatcatagatctgggggtctgagagggaatggacaataactgctaataagtatggaggttttttttagcggtgataaaattgttctcaaattgactgtggtgatggttgaaactgcaaatgtactagacatcagtgaattgtcaacttcacttacatgaacaaatacatgggaagtgaatacatctcataaaagctgttatgttttaaagcatgcatttaaaggagtgggaattatatactcaatttaataaaggaataattgcataaaatagctagattatatacaaaactaggcaatgacctgtagggcaataaaacataacttttggaatcatttttcttctgaatagaaattgcatctctacttgacacaaagctactagttaacatgtacattcataggttgaatttttaagaataaatacagaagtgagccaatggttctttctcctagaaaactaaatagtacttagttgttcccttgtatttaaagaataccttagtatgataataaaaagacacagtcatctccttgacctgactttctggttttggataattttacttaataataatgaaaatgagcaattactaactcagaattaatcagtctattcctaagcaaacatatttagttcctgctgaagcccactgatctcttcacttagtaaaagcaactgagcaggtcatcattgttagaaataatctcaaagtcactgtcagtattctttcctcctcttatatgacatcacagaaacacttgatgtgattcattaacaaatatttgactgactccatgactcaaaattcccattgtataattagaagtgtccttgtaatataaaaacagtatcatgcaaaaaaatgtgatctgcaattggtagaccacttttaaggatacttggggtaaggaagcacagaaaaaaaaaacataatccaattaaacacttaagtatctttccacaagaatattgattgtttcatgggccccaaattagcttcaagattgcacataaaatgatatcacaagaagaaaaagagacacgtttgaaaaattgcaacaaataaaatatttaaagttatacttatggctcatgatttttctatagctgtcaaactatgagtgtctgatctactactgccatgaaattgtctaataattcttaacactctcatgactctaagtaaaaccctttcactaaaataaaatttgtaggaggttaaaaattgttttaagttagtaaggatttattgaatgtcttctaaatataaagcattatgtgtatgtttatttttttgaaaaaaacaagtatatgcttcctgatatcaagatgctttagcatcagagtaagaagtcatttcaggttaaggtgtccagaaacagcattaaatgggtaacagtcaaaatgattctggctgtgacttgtctaagataagagagaatcatagccacatcattcttgattgatatgagtaaatattcaagaaagttcacaatagggtttggtgtaatgacttggcaatttggctgaggtaattcattcacttgggaaagattattagaagatatatttgaaaaatatgcatgaaccaaattatggaggattctgactggcaagctgagggattactatttaattaaagctttttaatagaagggttccagtattaagaaactaactaagaaaaatattgaatagatgatgtggaaattctcagaaaggaaggggaaaggtagggagcccaagagaggttacacaatgatgcctagaaagaggaaagcataggcatgtttcacagaataaagaagcatgattttgaaaatgggttgaaccaatattaagcaatgattcacaagtcacctttgcaatctatctattacaaataactttgaagaaatggtagataactccattgtttagggatcttagtactcagagccaaagacactcagaaacctattaggaggggaacacctcctcaattcttcccacagataatgtcaagatcagtatcaatttattctctcatagcaagtgggaagatttcttgagtcctccttctacataagaggtttgatttctgttctgtgagctcttcattctttttaaaagtaaaggctagaaaatttaaatttagaagggtactttatagacaccccagcagtctccttctagaaaatacacactacttcaactggttcatgttattcaatcagtcacaaacatttcagtgttccatcatgtgaggaaaaaatgtacagagctatgtcaggagggatacaaaatacatatctgatttttttgtgcatagagatattttatgtacaaaacattaagactttcaatccttctcctaacaaaaatctaaagacaaaaataatatttgaaatgtttgctgttttcaaatcaacacattaggcattgaatgttctttggcccactaatttacccacaatttgcaggtgttgaattttctattagtccttggggtatttaaagcatgtctataggcacgacatgtgccacttaggtgagttaattttaaaataatttaatttctatactttgctttttatttaaaattacagcatgaaactgcattagtgtcattcctccacaatttaatgatttccaaagtcattatcaagaaatggaaaactcacaagccgctaccctgtcatatggtataactaatttaacaaatagtcctatcatattcaagtcttcatatcactacaagattatcaatacagctggtggatttattttaaagtgttcttccttcttccaatgacagttttcacagatggaagcacccttccaagataaactccaatctgctgcatttaaaaaaacacttgggctaaacttcaagaagtttgcatgtgtgagaagggtgaattaacattacttttatttctggctcaagctgtaatggtgaatgtactgatgtacattaattgaatagaaaatgtctctagcaccacacacagaaagtacatgcacacagaacactctttttgtcaagctgtcaccatccctcaatgaacaacctgtgggtcctcagatatttggcaaagaagaatgtagatatattgtgaacagaacacatgaaaattcctgccctcatcgtactcatactctcagaaaaaaaaaatggagatagaagaataggtttgactagctttattctgaaaaattctcttttcatatcttagatataccacattttagatcagctttatacaatatgattcatttttagaactacacatttggttcagtgagcctcgtttaagcctatacatgtaaggaaattaataatcattcttgtagaagataacgtttttattgatcctgagatatttaactggaacaaaaacacaggcacatacaagcacgtgcacacatacacacacgtacacgagctttgaagtcatcaactgaatttgaattctgcttatactatgcacaagcaatatgactggggaaatgtcatatctctcagcctcggtttcatcacttgagacatgaagatcaaaattccttcttcgtcaggcatatttatattatgcattttttaactgtgcatggataagatgcctattccattatgtactatacaatagattcagtgaacttaggttcccactctacccctttaggctttttgtcactaaaaagattttgttaaatgttaatactgtgagtttaagattttaatatttactaaataaatattaaataaatattccatgttaggaagtagaataagaaatacagaaagaaagaagcaaaatgtatgtacagaaaatcactaatctaccaaaccataaaatatcaatgacatgggggcatatgaatggtggtaaattttttatatagaacctatataaattttaagtcacttctattactcctattttctgcatcctatcctccctgctctatttaatgaacttgagaacttacaatcttccccatgagttagtcaaaataacttagtctatgtgtgcacatgtattcaattcattattcatcaaatatgtgagagcgcttttggtaagcactagatatgaatgaagaatcaatattgttgcctctatattgttctagctaaatgaaataaaactttcatctgtatcaaaacccattcttttcaggtaacatttcttttaaagacctttatcaatacttcagcttttttccaattggaagcataatgccagaaagcactttgtacaacagccttttgatgattgtgtttgttaatatatatttgcggtagtcttatatttttatgacgtgtcttattttttcttttattaatgtcagagatcatgtctaatcaaccccttttggctgtaagcatataggcaactacatatataatactagaaactgaactactgattactacttatcgtcttctttttagacagagtctggctctgtcacccaggctggagtgcagtggcgatatcttggctcactgcaacctccacctcccaggtttaagcaattctgctgcctcagtctcacaagtagctgggactataggcatgcaccatcacgcccggctaatttttgcatttttttagtagagacaggatttttccatgttggccaggctggtcttgaactcctgactacaagtaatccagccgcctcggcctcccaaattgaggggattacacacgttagtctctgcacctggcctacttatcctttaatattgaaaatgaaaatctctataaaaggcaaaaataagaaagtgctttatagtttttgaattatcaattaaataacatgaatatatattttaaaattataaaagccccactttatccagggaaaataattataaatgcaataaattttataagaaatttagaggcttaagtttttcatttccagtaagttattaaatttgaagagagaaagaaaaagatgaaatactattttatttagtgtgtagtagagtttctacaatttgcttcaaagaggatacttttctacatcgaaacactaatacaaatacaaaaacaaagatgtcaaagctagtcatcattagagttgaaaaaaaaagcattgggtattgaaagaattctacaatttcatttatgaatattacacagcttgcaagcaaatgagaatctttaagtttgagaaattattgaaaggtgaagattattaatcaaagaatctcatattaatgtgaaatatatatatattcaaacatatataacttacatataaaatgctgaaaactttttctttaatgattatttatgccatgccaaaagacacatgattatttatgccattaaatctagactgtaatatcacaccatttgttctatacaaaaaagtcagactattttgtgcgagtttgctctttattgacgagaatatgagcaattccttaattgacagactgttgtgatgcatagtacagtgtgttattatattctacagtggaaataaaagggtttttcaaaaaagcctccattctaagtacataatttaaacccattaatagcttcaaaatataattagtatcgattctaataatttactttaaaaattttaatttttcaaagtagttttcaaaaaaactaaactcaagtttctttaacatgaagtctattacattatactttttactcaacattcaagacgttaatagcacttacaaaatttggtcatgatagcaaatgttccagccttttatattttaataatatttcataatctgcatactttgttaatatcgatagtatagtgtaatacaaaggcacactgaacaagaaatctagaaaattcaattatactatcaagcagctgtgtcattagctttgctgggtttcaaatttcttttctatacaatgagatgcctagttcaattacattttcttttggtctatattctgttacattgacttttacttattaatattaaaaaatacccaaaatagtatcctatgtgtttcttatacagatttttcttgtcttaatattgtaaaagaaaatagttgtgattccaatttaatttatatatatttagtttttatatcattagtgttttttaaaaataatttaaattttatcaaatatttacaaaagcatatgtttaaatttgtctatactatacacaaccacaaacaatatgatgttactcgtttcatataaaactggcttaagatgtataataaaaatcctttctcatttatactaacatgactcttggacttatagttgtttacattttataacttataattgactaacatttgctttgagcttacaggcttttcaaatctgaacttcctctattaaagcaaaagtgaataaaatcagtgactattacacattgtatcagctgtgattaaaagtaaaaatgagccgggagctgtaatcccagcactttgggaggccgaggcaggtggatcatgaggtcaggagatggagaccatcctagctaacacggtgaaacctcgtctttactaaaatacaaaaaattagccgggcatggtggcacacgcctgtagtctcagctactcaggaggctgaggcaggagaatggcttgaacccgggaggaggaggtttcagtgagccgagattgtgccactgcactccagtctggcaacagagcaagactccatctcaaaaaaaaaaaaaaaaaagtaaaaatgtaaccttgtgaagttatatatatatcaaaacagaagcaagatacatcttatataagcattaatgactcaatagataatgttatatccatctatccttttcacaccatacattcaattaagatgtgatattttaacaataataccccagtcctttgtctttaactctagtaaatttagtattccacaatttgccagattcaagactaggaagctatttattaaaattaaagtctggattctggaaaatttagttaatagttacattaactacagtaacattagtaataaatgaatgagtcaaggtgggcatacatttacattaataattagaaattaatattttattatagtctgaacatggtgctcaatatttattctgtagaactctttcagtttacaaagctagttttacacgcagaaaaaagctaggatactttgaaaataactgtaatgtcaaggagatgcttttagttaataacaaaatatactacacagcaaagaaattaaaacagcttggtcctgttacatatagataggtaggacaaagaagatttgaaaatagatctaaataaatatggaatcaaataggcaataaaggtggcattagtatactagagtaattattcaaaaaacatatttggaactattttagcaatctgggaggaaaatcttggtatttttctcactccttataccacaatgaaaacttagaatagggtctgtcatgtgctattgtgaaacctctcagctttactttatttaattttactactgaattttaatatattgtttttattataaaacgtatgttcattataagaagcaaagtcatttagagatttataaggaaaatgttagaaacctaacttcaccctacactaacctcaatcaaatgaagaaactaaattacatcctccccttttttgtttatatacagattaaatttttttctaaaagtagtgtcatactattcacattactatgcaatttgtcctctttcacttactacaaatatccttttagaccaataaatataaaatgcaattttaagaattgcttcttaaccttccataatataaatatagcctaatagattgagctgatactaaagtattcacccgtttttattacttcaaacaatgctataattgctttaaataatatatttgtatatgtgtccctttacattgtaattactttatttctctaggtagaacaaattaataaagcatgctggtgaaacagtacatatatttttaattctcaaatatatatccatcatatcaaagttctttccttcctgctgagtaacacaggggtttacttttcaacttcaacaatttgatgagagaaaactggtatctcattttttcatttacatcttactgactaatatgcaagcaggctaattttaatatgattaatagtcacttatatgacttctataatagtaaaatttttgcctatgcctgcactgagttatccttctcatataaattttcaggagctctttgagtaacaaagatgttaacacttggactgaaacatgcatggcaaataatttttcacttggtttcaagtgtggttagtttttattttaaaatatatttttaaaatgcaggtagtaaaatgtcctctcccatattttatagctgcttgtaattaaacttatccttaaatatgtacttttaatatctaggttagtccacctgaaaagaattctaggagataacctatgaaagattctaaaagtaaagtcaaaattattccagatctacttattgaagaagtaattaattttccactgaattgaaatgtcctccttattatatattacacactcatatttacttggttctatttatagactctcatctgtttgagaaatgtatattccagcaccaatactacattgttttgattacagtagctttgtagtatcagtatctgatataataaatcttttttgtcttcattttttaaagtttctttcttccatatatctccccaattactactcctatattttcctacaaaatctctgggttttttatcagtttagactatccactcattgttaaatatctaccgcacttttccagggcatattgaaaactaattatctgccatgactcttctaattagaaattaaaattataggaaaatagcttttaagtcatgaataggcatgtccaaggactgaaaataacaaggcagtaagtagaccagagaaatcagtgggaatcatcttaaaggcatttgccaaaccatgtaaacaaaggcttctgttttaagggtctccaagcatataggttttagaaaaaaaagctcaaggcccacctaaagtctgagtctaacataagactcaatcataaaactaggattgtgtaagtccacatcaccagaaagagaaattaaaattaaccccacctaggtcccacctggaactgcacagaaacttttcagtcttaaacttgggtacacaagaaaaagagggaaaataatgtccttagcaaattaaatttatatttgtatttttggtctgattcacacaatcttggtgactcgaaaaaaaacattaagtgaggaatttagtttaaggtggtcccagaggactggcggtaaagccactgcctgagggaagcaaatataaatcccttgtaaagaaacatgcatgcttcacagttctcagagaatttcctccaataaggcatcaacacaaatgacagagtaaaaaaataataataaaaattcaatgaacatacaagggaacacaaagcactcagtggaggcaacagatagcacagacagtatcatcagactcgcagagacttttaatagtaaaattgacagaatatgaaaacgaatattttaagttttaagaaataaaaggcggccaggtgcggtggctcacgcctgtaatcccagcactttgggaggccaaagcaggcagatcacgaggtcaggagttggaaagcatcctagctaacacagtgaaaccctgcctctaataaaaatacaaaaaaaaaaaaaaaaaattagccgggcgtggtggcgggtgcctgtagtcccaggtactctggaggctgaggcaggagaatggcgtgaacccgggaggcggagcttgcagtgcgcagagattgcgccactgcacttcagcctgggcgacagagcaagactctgtcataaataaataaataaataaataaataaataaataaataaataaaacaataaaagtcttgaaaagattaataaaaagctggcagattagaaaaaaagcacaaaaaactcttagaaatgaaagatataattgtagctcaaaactcaatggaccattttaacagcatatttgaaactggtgaagaaattattagtaaacttcaaaacagaattgaaggaaattatctataataaaacccccacactgtaaataaaaagacaaatgtatgaaacctaagagtcattgagaacaaagtaaaaagatttaacatgtatctaataagagcttcataaagaaagagagacagtgagatatttcccaacatgatgaaagaaatcaatccagtttcaataattgcaaagaaaaataagtaggacaaataaaaagaaatatggacttagataaatcatggtaaaattgtttaacatcaaaaactaaaagatctttaaaacagcaccccaaaggcatattaacctcaaatgaacaataattagacttccattcatttttcaatagtagcattgtatgataaaaggccccaaaatggtaagttctatgaagtggaaaaataataataatcattgccaaccctgaattctataattagtgaaaaaacttttcaaaagtaaaaaaaatggaaataaaaatagttcagaaacaaaaattaagatagtctggcaacaaaaaaaaaaccctttctgaataaaattttatttattccaagtagaacggcttccacatggaaattgcaacactgaaaaaattgacaaaaatatgaataaagctaatccaatattgactaaataaagcaattataatactctcatcaaattttaaaagagagaattaatatccacagaacgtcttgtaacgtggaaagaggtaattagaattaaacctcattctatgacacaaaacccactcacattgatattctaaatgacacaaaccaacccataatacataggccaaaattggcaggtcatctgtaatgaaaactggcacgagttcagaattacttatttaaatcacatggcatactcaactcagcaactctgcaggattatggcttgtgtaccctctaggaatataacagagatagaggtgggggtgtgtgtgtgtgcatttgtgtgtgtgtgtgtgtgtgtgtgtgtgtgtgtgtgtagggctttattaagatataatctacatagcatatgtacaccaattaatttagaacactgatttttgaatcactcaaaaaagatactccatcaccactagtagtcattacccacttttataaaatactcctcacctatttttgcccaactctccaaaccgagtcccaggaaatcacttatctactttccgtttctatatagttgtctattacggacattttctaaaatattcctcctaactgtaattctataactttggagacatgctggtcaaaggagatagaggttttgttttgttttgttttaaagctttgttctcttgagcactgtcttatggcagatagataagtcaatactctttaaatggatagaggggtaaatacttattatccaacaataaagatgaaggaaatgacctcctgtaccaagggaaacctgaaatcttatcactactttttgttgcatatatctaaatcttcacattttaaaaaattactgggttataaattacggactttccaacattttttcttccacttacttctttaatataatagtgggagaaaccccaatcaacttacataatagattatgtatttggacattagtttctaggcactggggagtaactacagttactgagcaaggaagtcagaatttgagcaaagctttagaaagttattctggaaatgatcaatattttgtttgataagagtataaaccattcagccattgaaactgaaaggcaaactggaaagcagaaagcaccaaatctattggttacatttctgcttttctgctttgtaacagctgtaatatgtgtgtgtgtttgtgtgtgtgtgtacaatatatgtacaatatatatccctctcaaccatatatatatacacacacacatacatgcatacacacaaacacgtatcaatgtaactttcttataaatgcaaacattattatcaataatttctgctgcttcgattttgttgtttctttaacttccagttacttttaataaggatctatcacaaagaaaaacttttcttttacatcgtgtaatttagtcagcttttctgtaacacatagtatacatttatttatctatacacaaaagccacactaatctgattacacagattttataaacacatgcaaaatcatggaaaaatcgatggcttacactttaaaagttttaaggagaatatatctctattgttttaaatacaggatcacgaaatcaaggaacactgtttaaaacagccatttatttcactatatttatagactgatctcatgcattctcatataaagtagtgttttttaaaagaaaacctatcaagaaatataacccaggattcactgtttgatgaatctgaaatgtgtacttccaattgagagatacaattgcaaacaacagcctgcacaaaccaaacagagaaaaactgactgaggggggacaatagaattgagtgtacctttcaaaactagagctgtaatccagtttgtaagaaaataaagaatggaagtattggcctaaactccactgaatcacagaagcctaacacaatacaaaacaagtgacatccttttctcaaagaggcgcaaggctcattgagtctggcgattcaattaccctctcaacctggaaagaacacccctcctgcgttgaggtccactggcaaagcaatgtgggacagcctacattgtacacagctggtaaatatctaaaaagctgcaggctttaaagaacaacagtctttgaccttttatgattgctacagtgatccttcaacaaaaaattaggagagttttttttttttttgaggtttgacaacatattatcttctcaattaatcatcttcaaatctctcatattcatataaaaatcttttaaatagatatctaagcacaacgttccattaggtaaagaatatgaacaaattaatgaaacagaaagtggatttccaaaaatagagatgactgtgatcttgcttagacattttgtaaacctaagaatcctttttgtctttttttctatacatttgtgtagaccttgaataaatgaagtgtgtactcataaaataactactgattctgaaatatctatgaaaaaattggggtagcatggatcttgtaagatagtccgtcataattctcatatttcctcatgcttgatatgaagagtgttaacttagatatatttttagcgaaaatactttagacttcaatctttggattctccttttctgatgagatctttattaaaaaatgtgattttataaatagcagtttacttcaaaaacagcaatcacttctatagtatttaccatattgaatgaatagggaaactaataattccacataaaaaattgttgagtaatcactatattagacattttcacataaaaatattattcagtttatactacaactctgtaagatagatgctacctttccttcataagtgaaagtaaggaggtaattacccccagtttcacaataagcggtttatctaaaaattcaaaccagacttcaaatcctaataaatctgacaatgcagatttaaatctgaccatgcaggaataatttttaaattctttcaagaccctaaatttatataaaagtatttatcatttttctcctaaattatctaagtacttgaaatattaagaaataaactttatacgtaaaaaggcacctggttgttgaagaacgaggagttaaggtatctttacagcattttagaaaattagtgttaaaccttgtgaaaggattctctgtatctttatgggagacattgttcagcctttgctcatccttaaaggattagacacttgggcgagctctcaatgctctcttcacaaaaacaataggtactatcaattattcaatcaatcaaccattcacttagtgaatgaaaactgggcttagacttacattgatttttaaaaaaaaataaagatcaaaattccttttgttctactcatgcccatataagccttttcttctaattttagttgtgtattttttttgctacaactctatgagtcattatgaattatttcaagtcttaaacatattaactgaattttagttaaaaaagtctattaccttgatatatctatgtgctagacttactatcaaagcacactttcatagatatttcacaaatcataaatgtgttttgatgatcaatgacagttcttgtctattagtatttagcaagcataaactaaaatcaatcttttcagtgtcttgaattttaaaaatcattcattttaacacaaactaattttcaaaacaaaaaacaatgaacctggattttcatgataaatcacaacttggaagtgcttaattaataaatgtgccacatttttaaatgcctatagaagtcatatttaatggtttaactggatttgctaagacaagctgtattctgtacccacagataatagagaacaagatcaaatactgttattttcatttgcagagttaaatctgaatttaccttgtttgcaatacttgtgatgaatgatttaatatcaagattagttggacagctcttctgacacggggcatctgcacatttcaggcatctaggaaataaaataactatgttaagaaactacaagataagtgagataatctattttctaccttatactcattcagagtccgtgtctagtaagtataaataaaatcgtatcatttttaggtacaaaacatttttaagcaataaatacaaagtttctgtgtttcatctttggcactcctcttgggatgcataaatgagaatcatgctggctagtaactgtccctcctctcagagttccttcttgattttaagagaatcatacttatttaggacataccattccctcactctatcagttttgtttcatccttcactatgctgacaatacttgcatgcagttttttatgataaggtttgtaattcttttagaccaaaattattaaacaaatgcaaagattaaaggtaaagtcttattttaccacttgaaatatcctttcttccactcttccttcctcccagcttccctctctacctctctctctctttccaattgtctgaagtctttcagcctccatcccattcacaggacaattgagttctgtaacagatgcctcaaagcatagcccagatccatacccttcaggaccaaagctttattcccacagctgccttccctctgctgctgaagagaatgggctccaacaaggtcagcctcctttccagtagcagcacacatacaattcaaggtcagtgagcggggttggaggctctctgcccattcccatatttggggaactagtctgcaaggagccattgaagcatttattgtgactatttgctcagtcccacttccttcactcttctacagatgttaacctgcatataaacttcctgcatattaatctcatctgactctcctctccgggggactggccagagatgtattcaaactttgttgcacctaagaaccacctgggaagcttgataaatggcacagacttcacagaggagcccctactgagtccaagttactgacctgggaatccgcattttgaaaagggcctctgaagtgattctagtgttcatagttggaagcacattgttagaacaacattctataattattcattcaggacaactaaaaccaatggccagactcatcctttatttgcacattaacttatgtgtgtttttcttcatttattcatttatttaatacatatttaataatcctccattacatagcagaccctgggatatgagaatataaaagtgttggaaaaagatcaccatggtcctgccatcatagaacatgcagtttgaatgaagtacagacacagaaaaagccacacactggtcaatgtggtcaatgagaatctgggtgaaatatagcatgctaagggagcacagatgaaagacagtagtcctggagggaggttgtcaggacaggcttcttgggaggaataatattgaaatagaagcttgaagaacgagtggacattaggaaagcaaatgacagtgggattctgagtgcagggtcactcaggataattacccaagaatagaaagagtatgcaccagtgcctggaaagaaaagaacgtgacaaggtaggtgaactaatgaatttggtctagcataaagtgagagtgggagtagaaagaaatgaatgtggagacagacaactaaagaaaatatactactgccacatgtgtcagaaaaacagcattctccaagaatttcactgagcatgaatcctacattgctcagtgacaaaggtgactagctagttcattttctatacacttccatgtgtaaagaccttggttcatttccttcatgaaaacaataccagtctccttgtcattcttttgtgagtaagagagccctcttcattgtctgaaccaatttctcagtgcctaattaatatcttgtttttaaatctgatctcttttctctggtttgtgcccttagccttctctctaaattaaattttacacaatgagtaccaaaggcttttcataatcaattgtcctctctgaaatgtagtcattaaacctcttccctatcatttctctaaatgccattgttagattcacatctatcatttagttgaattcctgtctgctcatacttaacgttttttccccgaaacactattgttgagttcaaaaataatttcttcgaagtataatctgcagcatacattgcaaacaatacaaaaagctccataatgtatggcctatttggtccttgatgttaaaatgaggtgatatttatatgtgtaactgtcatgtggataaatatactgagcattaatagtggtttgaaaggattttcttttatgtcgcaatacaaaatagctaaaaagtaaataatatgccaacttaaatgtcaccttattgttgaaaaaaagtcttttaaacagttgtaaaaatatctgccatcacacaaaagtaagcgcacacacacacatatatggcacatcatatggattctggttatctctatgaagtcacaagttttctgcttttcttttttctaacacccaacttgaataataacacaattaaaaaataaagttataatgtcagcagatataagggaaccaaattaatgtgcagtgtatttttctgttcttccagagaaatcttatattcaacataaacagattcacttaacagtattgacaatgtaaggatttttagttgtggttattaagcctctttaccaaataattctccttttattattgagctagttcacaaataacagctgttgaaaatgtcagatgttaatgaggcagggccacgcaaacctgaattgtagcattcctttttcctttggtgtcatgaatatgccagaatgggcagactctgataataataccatcttgcaattctctaagcgctctgcagactaaagtgcatcaggctgccattaatcccacttatcactctgacagctcagtaattacactactgctatagccaggtagtcctaataaaatatcaaccactgcactggaatgcatactggtgagatgttttattaaactttgagcggtgggggttgatcatcaagtgacattagtgttgacctatttttctatttgacaataaattatcctttgaccatgccataatagatattacagagtgcatttactgcaccaaatcagaaaggtactgcattacaatgatataggcaaatggtgtaaataaaatagcagaaatgcatgtcagaatgttattacctaaattgctttaaatgattgataccatgaaaaatcacagacacagtacttaggggaatatgtcaacaattatcgtaaaccacagttccacataaatttctccttaaaagtaacatttaaattacacttgttttcatctttagtcatttaattccccttttacctttcaaagttactctgttatagtgcagtttatttttaaatgcataagcagcaaaaattaattcagagaaacaattatgtcatacattttcccccaaatagttgttatacataaagaagtatatttgatttttttaaactacaagaaaacaacttagagttttcactaggcatacactttttaaattttcatatttaatacaaagcataacaatgaatttgtcgaagagcaaaatatagaatacttaatcaatgttaattttttataatttgacatgaacataaaaatgtatgaaaacttaagtactgttacttaaaggccaaaaactattaaagatatatttatccatgatatttctctagagaaagagaaacatgattcctcttcccaaatatccgtgaggctagacagtttgactccatagtatgacaccaaaaatattatagtgagtaatgaaacaagcggcatttcattcttcacacatctgagaacagatgcctgcttcttttattggtaaccatccacagcatttggaattgtaacctatgcttgttaaagaattttctagtcaatgagtttaaatggctgaattaatttctttctcagataaaaaataataataaaaaaacacatacacacaaagctatctgaaacccttaaaactcacattgcattgtcttagctttgctagagtttggtttaattgagtcagcatggtttcatcaggctatgtaaatatacgttaatctatatataatggcattaagcaagaaagtattcacattaaaaattaaaatattttcctaatattaacattgcatttccttagatatttaatgttctacatcatcatttggaaagtctacctaatttacatgtatcagatggattcaaaaccttgtttccctaccctataagcaccagtgtaggaaaatacataatttaatatcttcctcagtggtgcaacatgtctactgaaaactgagcagaatcaactatcaggttgaaaagaaatgtgaataaagaaatcaaagttggaagtgtcatacatgtatgagttccacaacttttatcctttgcttccagaccctatcataataaaggagacaagaaagatggctggtatctttaaaacatgataggactaactccatgttctgatccattaagcagtcaaaacagtcaaaagccatcctcagcttccaataattatctgcctatttatacctctgtgcttctcttaataatccattaacagcccttcctatgtacttctgactctgcttttctgattacaccacaggttcttaatagcttagggctatctggaactaactttgaatattcttaaatatgcatcttggctcagcctctattatactgagctggcagctatgataacatcaatgaaaataactgaatttttaatgctgtgcaccatttgccttttaaccacacctgtgatgttcatgttttgaggcttttgatatttatttgtatttacaagttaatgccaaacataattttaaatagctatttatctactagaaatttccttttgcacatgggtgcttcaaaacaattcaagagaagcaaatttagaacagaacacaattcacacaactgatgctcaaaattatttgttggatgataataaccaggaagctgggaataaaacacagttgagaactttcctgtaagtattttctgacgtctatgtcaggggattattggttttaccatataatagctttaaaatgtatagtttatactttttgcatattttgaattaaatgaagggacttacattaaattccatacacattatttatcttcatccataacagattcctaaaaatttataagactacctctatctccacctcatagatgaggctccagtcatctcccgtaagcataaaagaccagtggccaaggcagtggaggaaataactaaaacacatttagtatcttacacccaggactatcccatctacgtacaaaaacaggttagaattttaaaaggtggtgttctagtgaccccatctcttgatgacatcagtgcctccttgccagagtaatttgaagactgagaaaaaagcagttaagaagtcacagctagaaaaagactacagtattatctctcctggagtccaattttagtttaggaaaaaaaaagtgaaaggtagtcttgactgtctcctcaagaggcttctcaagtccagatgaaaaggttggagttttacagtatcacatagttttgaaggcttacccaaccttagtagtcattgaggcactatgactcagagaaggaaagtgacttgtcctaaatcttcctcagagtttatggcaagcttttctaactcaatccattgcctattctagtctgtaacatttattttcttctaattcatatgctattattaggaagctagttttattacaattttaagcaactgtgatttagctgtttgtgctggaaacatacttttattagcatattcttattaaaaattaaatatgctacaaaatcctcaatagcataagaaaccacaaccccaatcaagtactttgtgctgtctcacaagcaaataaaatatcttcataaaaacttagtacatatcaccttttataaaattttaaacaaagcttgtcctattttactatacacgaaaaatatacttatgactattaaagactgttgctcttaaacgtatttgtttcgctttcttaccctggaagatatctggataaagaagaaaaagattaaaaaataggcttttggtatacagtggtggaatacgaaagacgtgatggaaattgtatacattaataactgcaaaggagtcattggaagaaaatacacacatcatgaatacaggtacagacagttataaccaggaatgaaaagagaacagagcccatatgaagaaagtagcgtcagtacttaataatttctgaatctactggggctctcacttattggaaatataaacgatataaaaatgaaaagatttaaatagtaacactaaacaacaatgaccaaaaggccaaaagaaaatgttttttgttttttggattttttttgttgttgttagtggtgtgtgttttttttttgttgctaaacgaatgtactgataattatgctgaaaattatgggattgaatgaaattactgtaggttgcagcatgaaggaaaagtgtcccaattctgactactctctgttagaaatttatttatggagcataagatcatggtttataaactgaattcttaaaactgaacaaaaaataagttattaattacaactattagaagtaattaaatattagctattcaccagtttttatatatcaataatacagaaacagtaacagtaaagacaatgaataccagaaaaaaatacgtaaaagcattcattaaatgttttcctgcccagtagatatgttggcactaaaatagctgatataatttgatccctgtcacctgcagctacaagtgaggtacactttaatcaagaaaaccagagaataccatagataaaagctctgctttatgtcctggagggacgggcttgttggcgacactctcctaggaagccattctttattcaccttaaagatggtggggattgagagtatgtacttaaagggattgaggaagatggcaagattcaagaagatcagagtttcctctgtcttgtagtaatgaggaaaatagtgataagccatgtacctaggacaggatgctttatagaatgtctatatttagcataagtcagtcagataatacatagcatatatgtatgtagctatgtatgtacatagcatatatgcatggacccagactttcgtgtatactaatattaagtgctcaaatgtgcttgctcatccaaggcctttaagtgtattaactcagaaagcgtagcattgaggttaagagtacaagtgctggtgcttgattgcccatatttaatttttgacttcactttactggttttaacacattaggcaaaggacttaaactctctgacatgacttttctcatttgcaaatggggataacttgtacatcaaattgttgcgataatttttaaagattatacccttatatgcatttctttagtaacttaacaggtattctctacaatcttcaatatattctgaaacttatatattgctttctcttctttaatgtggaaggaattagtgaagagtcaatgtataatgttttataattatttatgtacattaaacatagtagacatctgacaaacatatacatatgctttaagggttcattttctccatacgggatttcagaagaaggaaaagttattttcctctcaggagaaccagagacgccttcttagatagagaaacttatgctgaaagttgaggaacaggtaggttttgaccatgtagagattagtataatagatagatagaatgaagatagattatgggttcatccaggacaaagagtataatttggccaggcacggtgactcacacctgtaatcctagcactgtgggaggccacggcgggcggatcacgtggtcaggagatagagaccaccctggctaacacggtgaaaccccatctctactaaaaattcaaaaaaattagccaggcgtggtggcacgcacctgtaatcccagctactcgggaggctgaggcaggagaatcacttgaacctgggaggcggaggttgcaatgagctgagattatgccactgcactccagcctgggcgacagagcaatactccatctcaaattaataaataaaacaaaagactataattcatctttggttctcagtgcgtatcctattagcgggcacatatataagtgctcatacgcgtttaagaaacatttctcagtcactgtacttcaggaaatcaaacaacaaaaatacatgtcaatctcatcagtggtccaatattatttacagtgtactgtatatggaatcctttcttcttgaggcttttggttgtttccccatggtaatggtatgatgtaaaaaatattcttctaaaataattaaattaaaaatgacaggttggacaacacaatgtactgtgaagcttctacttttgaaaatggctacattctagctaaaaatgtaattgatccttattatggttgcatatgtttgaaaagtatctgaaggatgcaactggtaagtatgagaatatatgtgacaaaagacgctttcctttattcctgctccacacattatctctagctattctgtacagcctatctcccttccctttctcaattgttatctaatgagatggcaacaaaatatttctcatgttccagggtaaggcagcaaatttccgtgacaaaataggctatccatgtacaaatatggtctatctttctgtaagttctgaaagttatacattgctttctcttctttaatgtggaaggaattagtgaagagtcaaagagtaatgttttacaattatttatgcacaataaggatagtagatatctgacaaacatatacatatgctttaagtgttcagtccaaccatttttacattttgcactggtcatatgaattgactaggcaaaagcaaaccaacgatactcccatatatgaatttcctttctcaaaatccttccaaagctttacaaagaattcagttaagagttttaatagagaattttaaagagttcagttaacagctttaacagagaaatacctatatcttatataccacattaatttaaataagtttacataaatgcaaccacatatatccataatagagaatagttatgcatttagttaacacgtagccatattctgaagcccaaggttcagagtattttttacagtccaatcattttatagttaccatttttaatttaacaataacaagccatatgtaatttttttttgcaaaccaagatattgttccctgctcaccacaactatggtttccttcatattctagacagctgttacatgatgctcaatacacttttgatccttcacagaccttgatgacagtactaacagtttttattatagcttttctattgcactgtaatcttatttcacctggaccatttccccactagcatcataaactctttgatttatatcaaataattattccaggcttcatagaaaaaaaaaggaattattttgtgttgcatattcacatgctatgcaaattatcttcttaatttttgaaacacctgttgtatgtttatcttaatttcaatgaagctcctttagaaaactttaaaaaactaatatatatttttcatagatgccctagaagtaaacctctcagcaaacttcaaaacagagaaagctctatattttatgacatatttgtgggcaatttcagaaataatatattagtaatagtaatctgacatatagatttagagtgcatgtaccctagaacttaagataaaaataaaaatttttaaaaaagaggtgaaaaaggaactcaaattgttaaatccataaataaaataggttatttgttcctatacaattcctagatgtacggaatatgtttgttatgaaaaaaacagtatgtagacaaatatgtaaacccatcttagggcatgtggactaagatttgggatagattttacttttcacaatgctatattgtttgcgttttttgcaataagtaagtataacttacgttattaaaaacaagacatagatgttgactaaaatcacattatcctaagtaatttttactttttgcactggtcatatgaattgaccaggcaaaagcaaaccaatgatactcccatatatgaaattcctttctcaaaatccctccaaagccttacaaagaattcacttaagagttttcatagagtgaccataatggatattcaatttacacaggtttgaactgctgggctcaagtatacatgggcttttgttttcaaccaaacaaggattgaaagtgtagtatttgtaggatacaaaatttgtctatatggagggccaactgagggacttgagtatgtgcaaattttggtatatgcaagggtcctggcaactctctagcatataccaaaggatgaccatatttctgagtatttggtggctcataaagctaccataaaaaagggctgaggtggatgaaaagaatactgagtgacaatgcaagtgctggaggcactcattcattaagctgaaacaatagtgaaaaaaagtttggccttaaaattaaaagacagtattcatcaataatagaatcttgaagtaaataaatgtctccacatattagctgtgtaggtataattgaacaacagaaataattcaactcaaaattattaaaaggttctgtgttctaagttctgtgctggcaaaagggaggagttactggaacctacttagaagaggatgacttaatatactggacacatacttcatggagagggctttcaaaatatatatatatacacacacatatatatacacatatatacatatatacacacacatatatctatacatatatacatatatataaacacacacatatatatacatatatgtgtgtatatatacatatatacgtgtatatatatatgtatacgtgtgtgtgtgtgtgtgtgtgtgtgtgtgtgtatatatatatatatatatatatatatatatatatggcaggggacagtggctcacgcctgtaacctcaatgctttgggagaattacttcaggcctgggttccatatcagcctgggcaacatagaaagaccttgtctctaccaaaaaacaacaaaaatgaaagaaattagccatgtatgatggtctctactttagtcacagctgtaggctgaggtaggaagattgcttgagcccagaaggtcaaggctgcagtgagctatgatcataccactgcattccagcctcagtgacagaacgctgtctctaaaaacgattttttttttttgagatggagtttctgtcgccctgactggagtgcagtggtgccatctcagctcactgtgacctctgcctcctggattcaagcgattctcatgcctcagcctcccgagtagctgagatcacaggcctgtgccaccacatccagctaatttttgtatttttattagagactttcaccacgttggccgggctggtgtcgaactcctcacctcaggcagtccgcccacctcagcctcccaaagtgctgggattacagctgtgagccactgtgcctggcctaaaaaaagatttttttgtgtgtgtagtttttttctttaaaagtgcaacagtgattgccattattatagaggatgaaatagcacatttggaaagcaatgtccatatatgaattgtcttcctcttagaactgttgagtttcatgtgtgacatccatacaagtttatttggtagttttattccataaaaatggtgtcattctcccttttacaaaaataaaaagtaaacctacttcacacacacacacacacacacacacacacacacatacacacatacattaaatttaaattcaatttaaatttaaatattcattcattttacttagctaaatctatgttgattacgccaagtgaaaggataatttattcagcacgaatttttttctaaagttttaatgcaatcctggtgatctttttaaaatccctgtctgatcacgacattctccttaaggggagaatcttggtacaatattatctctgagcctcggcttctattgcatttccacagctacagctgcaacacctgcctgatgctagaactctgctcatagttccatgtgtaggtcattttcaaactgtgcattccacatgctcttccctttcctgaagagccacacttcaagtcttcatccgaactcagctcagatgtctcctgtgaaaccccctggctatcatgcttggagccattctgatctctctaatagcaccccgtgggttcccttatcaaagcaattatcacattggacagtaacagctgattcacttttctagtctatcttctatttcctcctccagtgagaaaatggttgggttcctctgtctttgaggttagtctacttggaaatagattaatttgaattcagatgaaaaagccagaattttggcaataatccagtttttgtacagttaatgtttggtaaaaattattttttaataaatgttcttcaaatttatgtaaataacaaatctttataatttaaacattatatttaatttatttagtaggtatttatgcaaggggttactatatgctagcactgttctgtgtgttttataaatgttaactcatttaattttcataatcactcaatgaggtagatataaatattaactcctatgtttataaaaacccaatgagatagatactgttgttattctcattctaaagaaaaagatattaaggcacaaaatttgctcctctgatttaggtttgaaatatgttactgcctatttgtatgatcctgataatcatcaagaagttaataaagatctcctaaaaatctataattctggttatctctgccatttcctcagaacagagtatggtgacatcaaggcttgtctcacagtttgtgaaaggcagattcaggactcttatccaggtttgacttgctctacagaccagcctgtggggatcatcatttcatttctgcaatagttctcataatgatagccagtaatcccagagaacttgagaaagtttcctgaaataacacattaaaaccaagcataacatagtcattactatatattttatatatgactgaatttagaaacaagcaaacaaaaattcctcatttatttactaggaactcagcaataatacttgcagatcatgtaattatttacaaagcattttctcgtatgtaaattacctatagaaatcagtaagaccaatctttccagtagaaatactagacaaaataaaagcaattagaaacaacatttataactatcagaaatatgaggcataatagatacaataaaaatatataatggataaaataaaaatacatatctaacttatataactttgactctaaactaattatgtccctatccagtatctggaatattatataaaatgacataaaagtagctcagaacaaaattgtccccattaaaactattgtgtgggaccactataacctcatgcaagcttttgtatgaaatggcttaagacatgacttttgttcttaggcatttaatgcctaagaatcaatgctgatgttgcacataaagaatatgtggaaatttcaggaaattaatgaatatgggtgaaaaacagataagaatataaatgtttaatcttctcagtttaattcatatcataaggtagaccacgttttcgggcaatggcactgcttagaaagtgaactaatatgaagatgacctattcattaagagaagattttttgagaaaattagcctagaagctaaaggacacaatattcagaaataatatcttaaataacatcaataaaattagctgtctacagcttaatatgatttaaactagaaaaacaggaaaataaaaaagctaagggcaaataatatatagttttgtaaaaatggaaaattccctccactatgctcctaatgaaatgcataagagcactgacaatgctgtcacagtacgtggcatgctccattaatttaagaaagctgaatgaaaaatttgagtcaaggtaatagtacttaaatgtgtttgtgttctgcggaatcttaacatgttatttgcgttgttccttcattctttgttttcttctttccttcaatcaacaaatgtctatagagcacttaactattttctgagattttgctaagtgctggagatagcaggatgaataagttataggttcagccctcaagaatcttcacagtggtggagtcagataaataaatgcccatcctcagattatgtacaggtggggtaatagaaagataagagatacagggtgtttatctttttcttcaattaaaaccctagttcagaggtacattcatttgttcattcctctatcttcaaagcctagcatcatgctaaggacacaatgacggttcaatgttcatttgttgattaaatgaatgaggtatttatttgtttcttcgggacgaataagagggagagagagtcttgtggacaggccaagtaacacatggctttaagaagacacagaatgtgaggaattgaaagcacttgttactatcctactgaaagtagcatagaggttgcaggacaattctatggatggccttgcaccaacccggttctcccctctttcctgcttgtaggtctcaagaacaactatagcatgtgctgtaaatgcagcatcttgagctaagaagggacaaggtagaacagatcaagctctgctctagtctcccctagaaacagagattccttcaacactttagcccaatatgtcctatgaccctggggtataaaatccagggcaggctgcttccctgaatcccccagctgtgatgccagtgggatgcccccattagtgataccatccatgcctgggcaactctcctaaaccttggaagactggcccacaatgggtcttaggctcctgttttccctactatctatctgtaagtaataaacctgcttcatgcaacttgttgcatgtaagcatgttttgtctcaccagacccagacaagctggtaactgtgcacaatgagtctgcttcacagagctctctgcccaaccacatttaattcacccccactgtaaacaaatcatcccttctttcaactgatctctcttcttttatccacactccatacatttgatacccaccacaacacaatatcataaaaggcagtatggtttaatggattctggatttaaatccagctctattattagctttgtgatcttgagaaagttatttaaatcctttgtgtcccagtttcctcatctaaattgctaattatagtctagacatcataccattatagggaggattaaataaataatatatgtggaacatttggaacagttcctgccattaatgagtgctcaataatgtaaatcatttgtattataatctaggaacaatgcagaatacaatgtgggaaatgagcactgttttttaatagccacttggaagtatagagctatggtgaaaactgtaaaacagggactaccacatcagttactgtgaaaataaatgaggtaattatgacaagcaccaacatcatatttatagtagctgctcaataaatgttaactagaaaacatgatgaaaaatgtctcaatctcccaagccaaccaagggggaacacagaagggaagtagtatgttgaataaaaataaactgtgtaaccaaagagatcataataaaattgtaaatattacgtgcatctattaggattataatgaaagcagcagccataccacaaagccaaacataaactgatctccatagataccccatttgcacgatgagttacattacacaatgacttggcaatcattatcttatagcgcagggtggtgggagcaggcagggaggccaatgagtctccctttgtcaagggaagatctctgatggaagtttgatttttgcctcgtttattcctcacatctaaaatggatatttttccaaaacatgaatgccttccatatgatgagacaacactaaaatttctgctttaattaaacagaaagaagaagagaaacttattttaaaataatattacagaaatttttcttatgtgccaccttttcattaagctgtgaaatttctcacctgctccctacttggtatttttttaaggtgaacttttcagaacaaccccacagagaggaaattgctttgcaagctaggaagatattaatctgttctcccagcatcatgggtgcataaatcctttcatattgaagaggtgttgttaaagttctatatataagatgacagtacagtattgactttagtaatgctaatacaaaagcagtattttcagttaaatatgctatattctttcaattttcctgcctttacttttgcttttccctcaatagaaatgcgtgctgctcattcccactccctatctggcaggttcctgggcatccttcaagacacagcattaggtgtcatctccgttgagaagctttcctcaactaccccccactcctcctaaatgttatttttttcttattcatatccccatatttttcaaactataatataattaatttgtaagctaactgtatccccaaatatcctgataggtctcaagaggacattcattcattcaacgaatattgtttgagtacctgttaggtccagggtcaagggaaaatgatggcaagtaatacagagacagattctttctgtaactcagaattaaacaagtgaacaaacaaacattgcattgtagactaagcttaaatcatgatagcacagcacagtgagatcaggggatcaggaacgtcttcctgctaagtcaaaaagaagcaggagttagccagggtgaggagacagtggaagaggcagaagagatgtgcaaataccatcagatgcaggaggcccagcatttggaggctctgaaagaaggccctggtgactgaagcaggaggtgagtccagggaggctgatgagggcaaggaaaatgccaggttagtcttgcattttcagcagcagccacaccaggtgttcaacaaatgctttttgaataaataaataataatactaacaaagataacgatgccattgtttggcttttgaggatatgcgttcctatcttgaaaaaactgaaattgttagaaggtaatttacctcccattactataaataggaatatttttgccttgttaagactttccccttttcatatacttaaaaataatgtagacagctataattcagtattaaatacagaatataaagtatttatgatgcaagtaactagaaaaacacacatcttacatacatcagcttccaagacaagtattcacaatatgtaggaagttccactgtggatccaaggggatgtagatggtacaatctctttaggaaaaaaatgatcattattttctacatagtgttaccaaatgaatacccaataaggcagcttggcgctaaccatttcttttgtctgcactactgaattctcataatacgcactgcctgagaaatggagcgcctgcccctttttgattatctcattcatagacatctcccatcacaaaatacttcagtcatagggcaatcaaagatacctataaataaactcttgagggaagacaaataagaaaatctaacccataattgtccctctgcattgaaaaaacactggacaaataatgcaatctggctgccattctgttatcaacaaattatataacctttaacaaactacttaacctctgctaagtgaaacctcatttttagctatgagcaatgggtgtatgattaggtggtctttaaagtgccttccaacacacaagggccattaccccatatcctcttcacatatgtcaaaagtgttatcagattatgagagcaaaaaaaaaaaaaacagtttcattttaggggaaattgataatcaccaaaattttaaactctgaatgtttctttacatgagagacattaatctttcaataagaacatagttgaggcctctcctaaaatttcattagcagtgaaacccttattttaaaaagaatgtgaataacttgaatgaaatccaatccacagcagtaaaaatgataaaatatttgacaactctaatctggtccaaaatatttggctacattaagtgattaggatatagaatgtttccagcttctccaccctgtagttcttggcagtccgactagtaaaattttggaataagtccttaagagagttatttaagttcaattttgagaatcaggcactgaccttcactacagtcagcaatttcccatttatttctatccctatcatgtcattttagcctcctgcacaggaaacatcaagcttctttctagaaagtataagacagaataaccaaaagatctggtctggagccagaaaataagagtttatatcctgtccctgctacttggaggctgcagggcttggctaagccacttaatctttctaacattctccatttgggaaatgagacaatatttaccttagaatcatgagaatccaataaagtacacaaagtgttggggcaagcagctattcaagacacagttatttattcacttatacatggtttgctggtgttcatgcccattccaccaacaacttacctgcagtgtacttctgtgggactaaattttttggcttgtgttttgcttacttgctgcccagtctgtataccagcgttactgcatcctaccaaaacaaagctttgctgcattggtgttcagaaatatttcactaaatatcttaaagttctaagagcccaaggcatttgttgactaatcattaggtcagatttcttattcctcttgtcctacttcccttcatgtttctggttaatgcttcttaaaattgctaaaaccttggcttttgagtctttactgcccatttagcttttaatattatgctcaccgactcttaggcaatccaacaaatttatccatatggctgcttctgacctcacaaccatctttgatatttctttttcctgctagccatcaagttacacataacagtggaaaacagcacttatccaaagtaacattgaaatatttctcttagaagacaagcaaatttttgtttattattgtgtagaaaccattcagtactggtattttttcagctgtgctttgttttagatgaatatttgtaaaacaaataaatattacattgtattgccaccttctacaatcttttatgtattttttgttgtcctaaattgatatactgttactaaaggcatgattctgatttaattcacttaataattacatatttatttattgaacatttcctagatacttacaatgggacaaacactatactatgcaccagagtttcaaagatgatcagaatgtgatccataacttacacaataaccatattattggacagcaaatacttaaatatccatttatggatatatgggacgtgataaactaaaagcatgcgcaaaagactctaaaaacacgcagaaaggaatgggaagaaacaagataaatgtcccatagaaagtggcttttgggatgaatcttaaagaacgatgtcttcaacagagaacggaaggaggtgttttggtggaagaagcagaatgggcagaggcatagaatatagaagtacgtaaagcactcagggaaaatctctgttcctcggaagagttaggataacagatacctgagagagggtagctggaatgaaattctagtctgtattggaactcagttttactagtcctctaagaattttgttgtaaaacttttattggaagcccatcttcattccaaatatacagccatatttgaatctctctctcacacatacacaaacacaccccacatatatacagttgatcctcccgtatcagtgggtttcacatctgcagatccaacaaactgtaaagcaaaatattcaaaaataaatttcaaaaaataaaaaatagcaatacaacaataaaaataacatgaattttaagatacagtatagctatttatatttgtatttacattttttaggtatatgagtaatctagagatgatttaaagtatacaggaggatgtggaaggatgtgtgtaagttacacccaactattaaaccattttatatcagggacttgaacatcagctgatttcagtatcactggggatcatagaaccttggtggacgactataatgtcaaagtacagagggcacctaaagaacaactgagatacttcagggatcagagaagaaacaaagacacagggtagcaagcataactgaaactacaggtctgaagtgctccaggttctgaagcaagcagagatagcctagaatcaactctgctagtgtaattgagaccaaacgtcccctgcctcaggtgggggactgtagttaagctccttgcttcaaatcgtgggccaggtggataggactgatcttcccatgcaaggggttagaacaacactgaaagtcgtgctaattaggataatataaaaccgtatgccaaagagaaaggaggaatccaacacagatgtagcttgaatctaaggtgtaggtccagccacccctcgtgtggtttccatagataaaacatcaacacaattatcaatgggactactcccagagccaccagtttaagacatggttctacatcaggtggcttaaagtccatgttgaggcaatcacagagttgttagttcatcaagataaaaacaaataaacacaacaatcaccgtagatgcacaaattcacaaaatttctaaaatgatacaaggaaaaactaataccaaagaagactgccaattacaagaaacaaatttattacaaagtgaaaaaggagcaatctgaaaacgtctttaaaattactgtttaaaattctcataagaaaagaaaagaaaggaggtactactatcccttaatgacaaaacgagaatatatgaaacaaaatgagcagaaattaaagagaaatggagggtactaaaataagccaagcagaaattctaaagatagaaaatcctgacattacagctattactaaaaagccaaaaagtaacagatgctggcaaggttgctgagaaaagggaattcttacacactgttgctgggagtgtaaattgttccaatcattgtggaaagcagtgtggcaattccgtaactgaaaaccaaactactgttcaatcaagcaatcttattactaggtacataaatcattctaccataaagacacaactatgcatatgttcactgcagcactattcacaatagcagagacgtttaatcagcctaaccaccaacactacactggattttttaaacagtgttatatatacacaccatggaatactatgcagccatgaaaaagaatgaaagcatgtcttttgcagaaatatggatggagctgaaggccattatcctaggcaaacacacacaggaaaagaaaatcaaatactacatgctatcacttataagtgtgagttcaacactgagtatatatgagcacaaggaaggaacacaaggacactagggcccacttgagggtggacagtgggaggagggtgaggatcaaaaaactacctatcatgtactatccttactacttgggtgacaaaataatctgtacaccaaaccccagtttcacacaatttacctaaacaacaaacctgcacatggactcttgaatctaaaataaaagttaaaaaaagaaaaatctgtgattgaaatgaaaaagtaaaagatgaggtacattccagagaggacatagtcagagaaaaatttagtgaattggaatatgttactggagaactcatataaaatgtaccacagagtgacaagattaacacctttatatccgaggataagaattttagatattattgtacagataaaggagagccattaaggttattattcagaggatgctgtagaaactcaattctggtgtcagtataaggaatgagtagcaggttattgtcatagtcctgccaaggaatgataaagtcatgaacaaatagctgatagaaggaatggaaagagaccaattatttccccctgcttttctctgtaactccattaagtcaacctttatattttaaaactgcttagattttgttaaaacttgattagtcattctctaaatcctctccttcttaaccttagattctctctccacatttattcctgtcttcatcctttctttccaatctacttagcagagaacttcagtatttcttgactagaatataattgtctttttttcccaaaaagatgtacacctccaatttgttttaagcatagcagccataacattttcaaagaactgtcaaatcaagctcacactcccgaaatagggtagtagaaatagcagtctcttaaaagtaaaatggacttagattcaaatcctgattattctacatattaaatatgcgtcgtcacaactgctgtgagcctcactttcttaatctgtattaagtggcataaaaagctccttcttcctagagttattatgaggaacaaaggagattaagtctctacagagtctagcaaagtgtttgtaaagtagtaaatgtccaataaatattttgctatcctcattaacacccagcatgaaaggtatttcctaatattcttgactgagaaagaaaagaccaacacctccattgtgccttacttttctgtttatatatttgattaaactaatttatggacacatctatctccccctactaaattgtaaaatcatttcagagcagggcccatattgtattcctttctgtatcattatatttctagcacagtgcccagttaataggaggggattaataaatgttagattaacaaattattgtagataaagtctaatttatcttccactcagtgcctatacatgcaaccaatgtttttttttaattgcacaatacaaacttcttaaattattgttaccttctcttcctcttttttctgtttctctcattccctttagttttcttcttctggcaaaagcacacccaatctaccttcattgtgtccatcaaggctgacctatcccttctctgaactcctccatcaagaaaggaaaatgaaaggattttaactattatatccaacaacatactcttgtttcctagtctagtttgtcatacacagtaggaattcaaatttgttgaactcacctgaataatcttgcctattgattaaaatagttcttgcataggggtaaaatgcaccatataaaaaggtaatgcatcttttaaattattgtgatttattaatttgattatttttgatttatgttagggtatttgaaaagaatattttaaaataaaaaaggcatcaaaattctcaatattcatccaaacatttattatgaatcttatttttctctgaatgtaaagcttcatactagcttaattagtatgcatttattgtgtgtgaaaacatcctcaaggattttcgttttcttccagtcaggtcacaattgtttgcactaacagttactacatattttattaattcagaatgaacataaaagtaggatgtcatcactgtattcaaaaaataataacactgctgacagaaccttttgtggtgagaaggatggcatgagacgggaggaaagacaaagttgataaagaggaaacaagggtcaaagcaaactgaataggaaataaaaccgatgaaggggtaaatataaaacaaaaagtgaaaaaaggagggaagattacataaagtaaagagagaaaaacaagaaaagagaaaattggagaataaagaaggaaacaaattataaatgcatagttagatccataaaattctagcactaggaaattaaaatatagtataaggtaaaatgactgtcttcccaacacagagatttttaatattttcccattccctactcagaaattcttgtataattccaaaacacttaaaaggagatctgtatttagattttaactatctattctggtttagtacaaaggtgacattacatctgcactacatgttcaagttaataataatgaatactttttagcatttgtctttcagttctaagcaaaaaaataaacttttaactttatcactttacacaaagttaattgtccaattttcagttcccatattttatgtgaaaagaagtaaactagttctatttataattaacttacactttaaagaatttttaaactctagggaaaatatctttttcctaagaataaactttaacaatactttattatgatctgaaatgctgatttataaatagcttcaccatattttacgtaccatatttgttttagagatttattacgtacttctccctgtagactgaaaattatttgaaagcgatgttaattttaatttatattatatctctcatcctgtgaacagtgcccaacaatttatacattcaatgaatatttgttgaatgaattaaggaataaatcaatgagatgttatagtttaagtatactttgattaagttctacgtgaactaatattctcatatgtttgacatatttgtatgtatttcttccatttgaatctacctattactaccaggccaatcttctttaaatatttatttcataatggtattgcccatttcctaaacattaagaggaccaactctttctaaagcttaaaaatataaatgccttgacctttttcagtcacagattttaattctatacaacgccttcactcttgagttttacttttagtttcaagcattgtcataaactcattgtgggagttgtttatagagttttggggaaggaaatgcttttctattttatgtttcattgcttggatatctaatccatttatcaacaaagtattttcagaaatttgtgtttaatatatttctttggtctaaggctatatagagaggctactagagcactgtgcccatcagccattactctgaggcagatcactggagctattcaggtataagctcacaggacacagaaccagctatgtaagacagcagctaggacagtcaacacagagaatctaccccaggaattccatattccatttttacttaacagctcacacctcccaggtgggtttaggaaatgaacagaatagtttgacagccttactccttaggaggcactggcaagtcatcagaaaattggctgagatcagttgagcccagtgtagacctgcaggactgtccacctcacccttagacttgtgagcagtaatacatgcacgttgttctaggccactgggttgggagtggtttgatctacaacaacagctagttgatgaaagactgtgtctacaagtacaataatatgtaacacaaacctaaaatatgtggcactggctctaggatcaggtagtaagcaaaggctgataattgatgcaaaagctaaaaagacgataagtgaactattatcaaaggctgaataatgaaatgatcatgtgtgctggaagaatggtgacctgtgttatgcagcagcaaatgtaaaactgttgtggccaggtgcggtggctcacgcctataatcgcagcacttcaggaggccagggcaggcagatcacctgaggtcaggagttcaagaccagcctgaccaacatggagaaactctactaaaaaaacacaaaaaattagccatgcgtggtgacacatgcctgtaatcccagctactcaggagactgaggcaggagaattgcttgaacccaggagatggaggttatggtgagccgagattgcgccattgcactccagcctaggcaacaagagagaaactcagtctcaaaaaaaataaataaataactgttgcctgtggtaaatttaaagtaagataatatacctaatggatttatgaagtatggtaagataagtttttagatattatattcagaatgtcagttggttttattgcatgtgataaggtatattgataaggagagaatcaaaacagcactcacccatttgcaagcagattttagagggaatatagagaggccaaggattgctgagttggaaaataaaattgtttttccttatagtcttcccatttggcaaaagatcatgtaaaatgaggcttaaagactatgatcaaattaaggctgtggccgtaaaaccctttgttaacacctctgaaagaattaagtggtgcccaacaggggaaaggaaaggggaagggtgcttctagaaatcttaaagagtggtcccacaaatgtcaaatccctaaatagcagtagttaagtgtgtacaaagaagcattcttgaaaataattgtagtatggattttgcagcagagagtagagtataaccagacttaaagaaaacacacaaagttttacagtaagtttcataggtaaaatagccatcaactaaattgtctgcaactttctataggaaagaataagtctaagaaaactaatcaggtgccaaatagaacatttcttcagaagtggcccaggaaagtgatagactacgaaggtcatcatagagggtagagcaaaagggtaccatgtgaaaaaataaacagggaagttactcccaaggagcaaaggcaggatttaagaaacatttcctattctgtagatgagggacttggtaacatttttctagcatgatttcagaattactactgatcggtgattgctaggtagctcctgtttttcccctttttggagttacatctgagaagccacatcagaacttcatgtagtataggagaccctggaattaacatgatgttagaactggattcaatttctgggtttggattgggcatattttttcctttaggagagacatgtataactgagaccagggatggtagtctttgatagacttgagacaaaatgagtccatttttttacccttccctgtattcataacctttgcaatgggactttgcagctcttcttatcaaagggtaggctttttccctactctgtgaatttaaactgagacaaactgctttgaccaagagaatgtggcagaaataatggtatgctcattctgaacctcagcctcaagaaactctgcatgttctgtttcctctctggaaccctgccattcctatgtgagcgactcctaatttgtctgacggaggatgagagacgacagggagaagagtccacgtgatggagccaaatctaccagactactctacaggcagcaaatcccaaatgtgtgaaagagttcagtcaagataagcagaacaacctacacaattcagccctgacaggatgcataagtatactcaagtaataatacatgtttattatttgaagccactgagtttggggctggcttttttttttttttttttttgcagcagttaacacatgcaatgatcccctgcaaatatcaactgcagattaactaacatccaaatgttttaaatatctagaattaatttcagcaatcctctctttaaatagagccaaaactagataatcattttaggttctttcaacttgactgtgtttttcctgccaacataccaaggaaatgatgagatttgtcaaagttaatagaaaatccactactgcaatagaagagtatctgatttttacttaaatgtttccatgaataagtttacaatgctcaagtaaagaaggacataacccagagagacagcaatcaggtcctcgaaagttttgggaatctgagtagtattctcataaatatgtacatgtatctcttcctaattatgaaatatcttgagcaagcagcccaaataattcttgatttttttaaatacttggagccatataatatacaggtttctgaaagttgctgtatgtctgtatgtatatctttgtgtgtattaaacaaaaaaattaaaaaatttccttataatgaggccatagacatgggacccaggaaaaacgaactcgtgtcctgaatgtgcccttgccagagtttatttcaacgtgaattgattctaaatacacttttttgcaagcattgcccaacatcattatataggcaagaatttcacacaaatcactgattgacagaaaaagaaattcactcttctcttttattgtcattttagaagatacattaagatctgtgatgataatgtaagaactttaagtattctttcacattccaagcttagtcattttctttgtaatttagataggtgaacagttattgtgatgtgaaaattggaataattcaattataaaagctaaatttctgctacaagatgcataaatgctccacattttttgctgtggctaaaaactgattttcatgcatgtagggcttctaaacccaaaaatattatttcaaaatgcatcttttccaaataagaaaaaacccacattagtctaccaggttaaatgaaaaggctaaatgagagagctcttaaatatagcaaaacaaattttacaaaacacaattttaagatacaataaatatttgtcatattttggcaataaaataaatgggaaataaaattatatttataatattaaccacgatataatcaaaaaatctccacaaaataaagaaaaaaacacataaaaaactcgagtattaaatttaaaagtgaaaatttcatttggttttccatatgagattacaaaaagaaaggcatttactaagatataacttataagaggactttctatagctattcatctttctattgacagaatatcccagattctttacaaactatttagaaattgctgggtttgcctagatttccattaagtagcagtattccacaggaaagaaaaggacattttggaaggaataaagtattctttggcataatgattttcattcccaaagaatacaagaactggatacaattatacatttttttctaaggcaatggaaaagtaatagtcaacaaggtggtaacaggcttcttctttaccttgaaaaaacactatttttaacatttttcaaccagagaataatctctatcatgtatttgagttgtgtaacaccatttaacatatcatgctggaaaacatttgccattatatgatttcattttaaataattataagatgatttgtggtggttaaaacactctgttttttagattagaaaaacagtttcgtttcactctaaacattttcaaagagtaggacaagatctcagaactagccctcaaaatatttggtggaaaatatttcaaagtgaaatgtgaagttgatttagaaatatttctgttaaaatataaatacatgtactatcaaacttgaacatattagctgcttattctacctgtgaaaacagcttaaaaatttgcaaacattatctccataaattattttaaaaatcactgtccaaagaaataaaatagaaaattataggaaacatttaaaagaagttatctttccacttcggaagtaccatttagggtgggaatataaggtggtgaggacatgggaacaaatcagtgaacaaatgaataatcaagatgatttcacctgtgattgtgctgtgaaataaacaaaaaacttggagactgatttatagaagaagagatcctttagattaggtagtgaggcttttgcataggaagccagtatttacactaagcctgaatgatattaaaaagccattcaatgaaagatctgagaggaagggcattttggcagaaggaactgcaaatgcaaagggccagtgctcattaatatgttcatgctgtgcatccacaactaaactgcaacctgcctaagtttgaagctcgcatgtcctagttgtttggtgtaaagattattatcagtatgactttaccatcgcaacaattaattcataaaagtcttatttaattaaaacacaaatttggccactttacaggggtatgatatatgacagcacatactgattttagctgttagaaacaaataagatgttatgatttaggtaatgtaaacaaagaaatgcccaatgtttttcaataaattaattcaataacaaaactcaaagccttttaaaaaaactttccatattttcttttctatgagtaccaagattttccaaataagaaaagggaaaaaaaaattttgaatagtgaatgctctgcatgtaaaggagaaaaactgtttggaatgtaaagatattaataactgtagtgactaacactgtacatgagaacaaactgttttcaaactgttttgagtagctagaaaacatactaagtttgcgtaagtgttttttgatatagattccatacaggctgactagataatataacaattacttttatttcattaaattgggaaacttcataatcctcttgcaaataaaaaatttcattgtaacaatttatttgctgcacacgtctctttcaaatattttattttttaacatttactagttccttaatatatcttattataatcttaaaatgatatgtgcacacatatacacaggatgtgtttgtgcatatgtagctaaaacagacaataatatcataagtattataaactagtcattgtgaaaaaattcaaatgtttatctaacatatgaaaaaatgtgtaatctagttattaaggaaattaaatcaaaatgtacgttttctagcatgaaatttgctaacattaaaaagaaaaataggctggatgcagtggcttatgcctgtaatcccagtactttgtggagctgaggcgggtggatcacctgagctcaggagttcgaggtcagcctggccaacatggtgaaaccccgcctctactaaaaatacaaaaaaaaattagccagttgtggtggcatgcgccagggggtagtggaggttgcagtgagccgcactccagtctaggtgacagaacgagactttgtctcaattacaaagaaaaaagaaaaatattaattttggaaagtaaatgagaaataagtactttaatatgctgttagcggctgcatcaacttcaatgagctatttcacatttctagtaaaaaatacttctgcctttttaaccagaaattgatctctagtaatatatcctatagagacatgcatatatgtgcacaaaaagacatgcatacagatttatttcaaataaatgaaggagatgaaattaacaaaaaagcatatttttactgtaaagcagtatatcttatttaaaagcacacattctaaagaaagaaaattaaatcatggtatgattctgaataataattgtatatgataccatattcccttacatctgattcaaaacagctagatgaatgcattaatcttctttaaaactaattatataacccatatttggggattaagaatgtttctgacttcatctgtcaatatgatagacagtacgttagccccacagattttctaaataattacgaaaacattcatatttaatggataaggaaaaaagccattgctgtttcaaaatgaataacttgtgtgcttgattacatagtctaataatttaaagcaccttttgttttatcttacaaaatatattataaaatattatctgctacatggtcttttcttatgctcaacttatttccatttcttaataaaaggaaaaggctataaaatttagtaagtagaaaaataagtaaaaggtattaatattctttcttgtattctttatcatattatacaaaaataaaagataaatctttatttatcaaagtcctctcactttttctgcccaatgatgttgtcttaaatttttttatctctttaaactactctctgacttcctcattctcatcagggaatacaaggaaaatggagaaaataagacaagactctcaattttgccactcagcatcctctgtattcaataactacttcttgagtgtcctccatagtcttaggcactgcacaaggtcatgaggatacagcaggggatgagtcaaatccatgtttgaccttaaagaactcagaaattgtacttctttctttcttttattaaaggaaaagttagctatccagcctgttcagttaacaacagcagtattccacctctcatcctatcttctctccacagaaaactgtagagaagccacttgaatttggagaactccacagtcatctataaaagtataatttcaatagatcacattgaaggcagaagtgtaatttcacaggttggaagtaagcatttgatgaggaaacagatgcattgtttgtgtgtgcagatttgttcaaaataggctgacttgtgaaagaaagaatttaagtagaatgataactagggagaacaggaaaattgagccaaagcatattcagtatagaagaatctcatacatgcttacaaatggaggaaactggtaagtagaggagaatggagaatctagcataacaacaacaacatacaaacatatacatgagggaacaaggtgctgaaggaggtaaactagtttgattgaaggcataccttaaaagtaaacttacaaagaatagaaatatttcttctaataaagttgaaaagctgagaggccagatttctgaagaggatggatggtctctgatagagctctatacagatgattttccatggcctctatgatttttcatggcctctgcaggagattcacttggagagtagaaaatcaggaatctaaataattagctagctaagaaatttaaaatttgttttgaactaactttttcagagccctatggaagaagtgtgagttttattctatctctaacaatggctctgaaataaacactgagttcttacaatgcctataccccgctaattttcaatagggtaacttatgtattcttacatcaatcctgggaggctaatgctatttatcaaatgactgcacaaatgagacaactgagccagaaagtggttcaagtaaaatttgaatccaggaaatttaattccaacactcttaatcatgaatatatatttcctctgagcttatttccacaagacatattaggatattagtaaataagtttaattcatatttactaatgatacaggagaagggcagggaagtgctggcagagaagggcattgtccccggtgagggttctaccctcgggcctgtggcccacggacctaagtgagaacagcactcctattttcacgtccgaatgttccattttccaagaccactctgacccaccatgctccccccatcctgtgcctataaaaaccccgagacacgaggaggcacacagacacaggcagctggacattgagtggaacacaccagcagaaaaacacactgacagacactgtgtttgccatcgatggcagaacgacacggccatagatggcagaacgaagcggattacatggaatttggctgagggtggttggagaagagcccagccactgagctgcccaactccaggggaagaccaccttcctactccatcccccttctagctccccatccatctgctgacagttacttccaccactcaataaaaaactttgcacccatcttccaagcccacatgtgatctgattttttcagtacactaaggcaagaacccaggatacagaaagaagcccctctgtccttgtgataaggcagaaggtctaattgggctgattaacacaagctgcctgtggacacctaagctgaaagcacactgtaacacacgttcactggagctttgggagccgtaaacacccaaccctagatgctgccgtggggtccacattccccactacctgcccatatgcatgctccccctaggggtttgagctttgggacaatgaagaagcaagccacaccaccgttgcatgccctgtgagggggataagagaacgtttcctgttttacctggggctcatccaggatcctggaaggagagtatgaatgcaaaactgtaggatctgccactcttccaaaacactgccacctctctctctttcctgtgagtaaaaggatctgtttgccctcatggagttttaaccaccctaaccaggctggttaaacaccccagacttcgtctcttgtctctctctcactgtttgaaaggctcttatctcttcctttatgatattaagagttttgctagaggctgtggcaatgttactaggtaaaatgagcatttcactcagctgccaaaggtgcaaatcagaccacctgtagaggtacaccgactcagcctctacctaaaaagccacaggcaagtatggctctgggtatctacccttactctttcccctcccatctcgggtgcctgggcatgtccacagcatgcaaaggccatgcccaacagccacctttaaattgctttgccattttaaggaacacatgaaatcacattctactgagagtttcaagtgtgaaatacgcaataaaaagtatcttctggagagcacacggaaacagcacctaaattgaactaccctgaagtagttggtaactgggaaagaactaggaaaaaaaattcatgtatatcagtactgtgggaaacggtttgacgattttgaacattttaaagaacatctttgaaaacatacaagggaaaaaccttttgaatgtccaaatcatcatcaatgatttgctagaaatagcatcctcaaaggtcacctcactgcatgccaaactggagtagggacaaaaaaaagaaagaagctctatgaatgccaggtttgtgacagtgtctggggtttatatgtagattatcatcattatattgccagactcatattattatctactattttaaaaatatttgtcttttatattcacttgtactctcaatttctaaattgttttccattcaagtgtaaaatattttccaggtttttttcctaataggttagataaatggtatattttctgaacccctgaatgtctaagaatatatttatataccaacatacattaactatcttgcctctacgtgaaactgttagcccacaacataatttcttttaaaattctgcagacaaaatttttctattatcttctgatatatggaagtgaataggtgaagccacctaaatttccccccctgctcttggtaacctatctgtcccttttgcctacatatttattggcaggacttttcttaattgctgtagtataataacttgactagataatagtaaactaggaaaataaatcatttggagttatacattcaggtaaagaaaaaactcttctatgacatctctgattattggttatacttatttaactttctctttggggtatacctatttctgcctccctactctcgattcttaactctgctctgtttttactcaacatgttatcatctcccaacatattatatatattcttgtgtcctaatgtttataatctgtcttcctcctcaggatgtcatctttgtgagagcaggtgcaatgtttgctttgtttattgctgtatttccagaaaattgaatgataccatagctagaatgcaaatagttttttagtgaattcaagaaatcccacattgggtcatcatttatcctgaatattactgagtttgtctcacattactgtatcttaatttacatttagaattttaaaaataattttctatgatgtgtttcattttctgttaattttttcatttttacttacggtgggtgcatattaggtgtatatatgtataggctacatgtgatgtttgataaggttgggagggaaagcaggtggggaaaggtggggatggttaatggttacaaaaacatagaatgaataagatctagcatttgatagtacaacagagtgtctcacataattttaagctttatcattttcatctgctttatcaagagctgatcaaatttcttttttcaccactgattgtatttttctttagctataattctactcatgaatgcctgcaaagtggagtttatttaatgtttttagattcttaattctgtcttacctctttcctttgttttatctcagtctatattttgctcctttttcaaagaagtcatgctttcatgaactgtgctgaagtcctaaaattacgccaaggtgtgtccatatctctgaagttatcacaaaggttaatatttttcagtatgctccaggatgttagaatatagtgcgtagtagttgcaggcactgctaccagggttcatctgtatcatacaacctgcaagtctttattttttgaggtgatcctcttaaaaaggtcttatgattggattattttcccaagacgttctctctagtttttctatgcttttcaacatctgcctgcatgtagaagaagaagtagtggagacccaggaaaaagtcctctgttttgcacagacaatctaaaaaagacagagaaactgatactcagcttcctcattaacacaagtgtaaattctccaggcagaggcagagtattgaagcattttccttccttggtcttaggcagtctacgttttggagcacaacaatttggagcacaacaaaaataggaaacctgcttaaagttttcttatggaaattctttttgatgtatacttagtgtatttttctttaggactttattaattgtcaaaattagttgttactgttattacaagtttagacattttctagggtatttgagaatacataaaggcgcaaagctacaaacgtgagttttaattaaagtagtattcaaacttttcgacaaaagttatatactctaagtgaaattatctaaaaatactataggaagtgtggatatcatttaccatgatggaactactaataactgcaacaattatttatctgtatgtcttttcttctctgagtattcattatttactacctaacacctagttgtaaaaattttaaatgtttcgctttttcacccagatcatttataacattaaaacttttaaaaaattaatatactccaggcttttaaatgttatgtatgtatattttttcacttaccatagagacaagattatttagtcatgaaaatgactatccattcacttatgagcaactacaaagctgtttcttgcaaataaggccaaagagactgcaaatactcaaggccacactaatttctcttccctttgaaaatctactgtatgttgcttacttattagcaaattcataacacaaaatattctgtggataaaagtgccagaagggaccttacagatgatcaagttcaatgtacaaatgagagactggaaccacagaacttttgacacctattcaagatttcaaagccagctaaccctagaacacaggtcttcccatttcttatctagttttattttttcagccaaacagaaaggtatttaaggacagatatcatgtcctctgggtcctagtaacctcctccatgcacataatattggtaggaaatttaaaaatgctttaatgttgatatatggttgatgatgaacaagacatgctttttggttttttgttctagcttgactgtgtggtgaagtagccattatgtactaacctgtcatgtggcaaataaatgcgacaaccctcaagtttttctcttaagattacatcagaaaatagaaataggagccaggtgtagtggctcacacctgtaatcaagcactttgggaggcctaggcaggcagatcacctgaggtcaggagtttgagaccagcctggccaacatggtgcaaccccatctctactaaaaatacaaaaattagccaggcatggtagcacacgtctgtagtcccagctactagggaagctgaggcaccaggacagcttgaacccatgagacggagattgcagtgagtcaaggctccgccactgaactccaatctgggcaacagagtaagaccctgtcaaaaaaaaaaaaaaaaaagaaagaaagaaagaaagagagagagagagagagagagagagagagagggagggagggagggaggaagggagggaaggaagagttaatatattatttggttataataataattagaaaacatctcaaaatttagaaagcatacccataaacatcatctcattaaattcttcaacagtcttgtgtggtaaacattatattatctctaaattattaacaagaaaaaaaatccagagcccaagtaactagctcaagtttgcaaagctaatgagtgagaaggtaagaaattaaacttactctatttcattaaaaagcttaaattctattacttctccatagactaatgctatttattaaatcctgccaaaatacttctgcattcaatgctaccaaagtcaaagttataactattacacaatattcaacaggactataacctaaaatgttatatcttaaaacatgtaaactcacttactacttaaatgtatcaatgaccataacaaaaggcatttattttcattgctgtatcaatatatataggcatagctagggtgaaggaaaaggttttattttatgcagcagtaagtaatactgaaaatcaaaagagtagtatctttgataatttcacacatattacctaagaaatagctgctcaattttcctcaaaaaaaatctacagggaattttcatacagagctcaaactagctaaggaaccacttggttcaacaagctctctttctatactgatggttagcattgaaacatactgccaccttatgacaattctttttatatcttaattttcagaatattctgttataaaaataaaccttcaccaggaatatagccataatgtctagaaattatctggaatttatttgagatttttaagttattagctctattgaaagcaacctgagagaaaaacactacatttaaaagggtatttttagatttggaacaaaataataattttgacatggtttcacaaggatttttaaatccaagaatcaggcatataactgattacatgctggcaagtaacctaaaatttagaatctatttttccaataacagtttaagaagttatattcaagtatttgcccttattgtctctataattttgcaaacacacacacacacatacacacacacacaaagacttacaagctgcaatagcttagatttgaagaaagtacagggaaaataaagactaaaattgaaaaaagactgtaaacataaatacactagtgtgtgaaatttacaagaagacaaaataaaacagtactacaaaattactactactacaaaataaagtacctgtctacatataaccctctttttgagtatccacagtagaaatttccattgcaccatgaaacatgaagtttttatacaggaactgatttattcttctctatggatccagtgattcatgtttgtaatgggttctctgtttccctttttgcattagttgctaaagtacttacagaataatttattttttatctttatcaagtatataagaaatcatggcgtgcattttgtacagtattatcactcctggttgcatctttttttttggccttattttcactttggcctggtagtaccatttactttatgtaacaacttgtttctatggaaagataagaatttagaagttgaacaactagaaccaactctaacttttactagctgtagggccatgatcagttacttcatctctaggataaattatagattgtctattcataagttgtgacaaaaaatacctttagagatatctaatatttattgggtgcctaatatataatggctacttacataacttaatttctacattgtttgatttcagtgaagcttctaaaatcaagttatgttttataattacatttaatgcagttgtgttctcccacaaaagcaatttttaaatcagtgatgtcttggaattgaggaaaaagagtattaacttattgtactgtacttttgtaatcacctttgtgttcttttcgaattaagcagaattactaacaaaaacatttcagtaaaatgctcagttgcagttaaatcataaatggggaaaaattagaaactgatgaacaaataaaggctatgattaagacttcgacattgttgttttgagaaaaaagttgacaattcagtaaacttttccatatgtcatgaacactgaaaattcactaaaacttgtttaaacttcatggacaaaagaacaataaattttttaaaaagtcatgcacaataacataatgcttagtttaattactgatttgctgtttgcccaaagttttaatcaagagagttcttacatgtggataacaatgatgacatctgtaaaagctagtgccacgtttaactcctccaggcactacagcacctggtgacgccacagggaagaaatcatggatacttcttgaacatactgcaacagctgtcaactcagaaggaggtatattctaagttctaccaagcaagtagtactctacaaaacctcattctgtcccttcttttaactgaaaagaagccagatggaaacatgcaacttgtcaaattgcaaatgaagaattactataaactgtattgcatggatctctgggtgttcaccactaaaaatttggtcgctcaatttgcagagtaatttcactgacatttaaagaaaactaaagatgcttgatactatttcagataaagacaatatcatatttttaagagaatacagcaaggtaaagacaatgaaaatatgaacgtatctttaacataacagcagaacaaataactaacaggcattattctagaagcttcataatgtccagaatgactacaactgcaactctcacgacagttaatggggcaatctgcttggagcacacagccacagaaaaccaagaaaacaagctgtattactcatgatacagcagtcttagctacactgctatggttggctaaacctccacctgtatcttcattatagagttctatttccatccactgtatgtgattactataaatgtttaaacattttgaggaaatattcattgtaaatgtatacaaaagtaaaaactaataaatttgctttatacttttggtacaaaaattacctatgattttaagaccaccatttgtttgataaaattagacatatgtagttatctcatatttagagtgtaagcattaccatttctgagatgccccagggaatgttttgatttgctcatccattcttgtatgtctacatatatgcatccattgagcacctactgtataacatgttccatgcatgtttagttacataaagacatcctttcaacatcattaaacccttctttaacaactagagtcttgtttagggtagaaaaaatgccctgcaagttctgaaacaaaatgatttatatcaacctgaatcacatcctaaatgtatatgtgatcctaatgatgtgataaagatcactgagttcctgagagtatccatgaacacaccttccaaaactgtggtacaaataatttcttagcagctttaaatgatagacattatttacctatcttctaaagaaaccctaaaaattatacaaatgattttaacaagtcaactcacattttttctataccaataatgcattttaatgtggttaatcagcactaaataatatttcaaatgcttataaatttagatacagcttagctcaataaccacaccatgcatgtccacagaggagaagactgagtcttagcaaaggttgagaaagctgcttaagatcacacagaaacaggatatggtggttctgactgattcactttagcgtcaggcctgtgtctcattccaatcctttattctttggtaaatctcttagaccgaaaagtgcaacactggaaggtattagtacaaggtaaccatgtagggacagaaagataaattttaagttgttgaggaagtaaactcagacacctttttctgttctctctcttcctcatcctctcacactaatagatacatgattaaaccactgcaaacaaaggtctgtggaggatgctttgtccatactgcctggttcacttcacattacataaatcacggcgcagagctaccagcctaaaccacctctgttatcttcatttctctacagatttgcctttctttcaaacccactatcccattttcttctgtggccccagacagctgtctttgcagcacaacagacagcagtcactgcagctttgctttgagcatgttctacagaagtccacatcccttgcagttgcctttcctggatcatgggaccccatcacagtgagctcttccctatctgcaggtagaggactaagaattatacatttgctgggggcactgccatgtatactcactttacttcccattttactaaactgtattctaattttattcatttccctgtttagatttaaaacgttcagtaaaagcacagaaagtaaaagtagtataaaggcaagaccagtgaatgaaaaacaactcagaaattgaccacaaattcagtgctactttatatgacaatcccttctatctttaatagtattaatcaaatgtcttaaatcatttataaagagtaaattattttcctttgatacctttgacagaataaatggtcaaactcctttgttacttttgtctgtaggagtcaggactgagaaagtattctctggatatcaggtggtggtatcatcagggtgataccatggttcaccctaatgtgagccatgtgagccgacatagtgaaggcacagtcctaggggaatgtgcaatactgtggtgggcactggagaattctgaaagcatggggtaggagtgtgttggagagaagcaccaaatgctagctgttataatccctgtgttactcatctctcaaatgtcccctttctatttcttacagagccaacgctgttgaacagaaaaggataaaaaatggatttttgaaaaaactattattcgaatgatcatgactataaataactggcctcctccaaaatgaaaaagaactccatgccctagttgtacaggaataggtattgatcatcctacttaaagtaatacttttatacaagatgacttacaccacagaaaatcagatgtgctttatcgggtttggcaagtagggactgctttcccagggagatgtttccaaataaggaaagaatacagctttgttattttattttattttttatttatttatttacttatttatttttttgagacagagtcttgctgtcactcatgatggagtatagtggtgtgatctcggctcactgcaacctccacctcctggattcaagtgattctctcacctcagccttctgagtagctgggattacaggcatccaccaccacacccagctaattattgtgttttagagatggggtttcaccatgttggccaagctggtcttgaacttctgacttcaggtgacccacctgtcttggcctcccaaagtgctgagattacaaggtgtgagccaccacacccagccttgttattttatttttaatcaaagtaaggaggcatcatttaccagaggtcatgaaactggaaaagacaaaaaaagttgcagattcggaagacaactcattcagagaaaggctacacctttcttatggtcagtaatttattctaaatcccaagtctaacccaatatcatggtaacagaaagcatcagcttttccctgaaatctctcatgcttccaataaaataatggttcccatgacaatagatgctacctcagcagaggcaagttcagagtacaggcagtacacatatcttggcttaataagcagggaggaaactacactggcagtattatcctctcactttctttttgctgttagtaatagaagtaataggttataagagatatgaatcacattatcagccatctaatatgcaatacttgacttcatttgattttctattccaaagagactgtcagcgttcaacataggaggaatactaaaaagcaaaatgggagacatgacgattcctgctaattgccattcattacctctccaaacaacagtgtttccttagatataagccatgcttttcctttttttaaaaaaaaaaattactcttacagtgtaaataaaaccaatttctcagcgctttataccaacagttgagagtgtaggtatctacttagtaaccaagcttccctggcaagaagctctaggggatatatgaagtagatctctagatgaagaggacataaagaacaagagaacacacttaagtctctaagtgttttaaacaaatgtaaatatatgtagttttataagactaaactatctttctgaagaagtgtagtacaaaatgttctgggtggttctcatttaacaaaataggcgattactttaccaagaaaagaaatccagtttatatttcctattactccacacaggcactatggaagcactctctctcataaatgatctgtgttcaaatctacctacctctctcctatttccttttcagacagtctcttctaactactgtgaaaaacatgtgagggatgcatattaccagattaacctgagttatccaatgtgacattgtcatgagactgtgatttggactgtcatctatatcaacttcttaaggcctccattttttatacagttaaatagacactaacaaaggtagccaatacataaaattttatgtccagaagaattttaatgacaaacagatgctaggaaaacaattcctgccctggttacttttgtgtgaggatataatgtgcttaaaagcaagaaagacaataagctatttgtaaaatataattttttataatttcatggtgttctgattttaataaacacaaataaatttattaatctttgctgtctaatgaaaattattcacatcctgttgtttagtaaaatcattaaatgagaatatagctaatacaaacttttatttgtagaaagagaaaaacatagcagcatagcaaaatatacttgcattttgtataagcttcaaacaccacaaagtccattgaacgtttaataattatgcatatttcatttgttattttcataatgtataacatataaaagtactttactgaatatgagaaaggtaaaaatctatctccctgagatacaacatgcaccacacagatttcttctatctgtgtgttcttcatactgtcatacaaatcagtttggatcactgttttatgttatgcatattattcaatttgaatatatatttaaagtggtatttcacaaatggaagaaaataattacttacacacatatttgtgatttgaagctttcaacaggcaatgacactcatccatcaacagtcttcaatgccgtatgtttttatagcagttctccaaacatgaatagaacctaaatatgcagtgagtttcaagcacatcacacaccctgtgtttattaatagatctttatgctggccacaagagagattatctttttttcttttgggccactgactcttttttttttttttttttttttttttttttagacggagtctcgctctgtcacccaggctggagtgcagtggcacattctccgctcactgcaaactccacctcccgggttcatgccattctcctgcctcagcctccctagtagctgggactacaggtgctggccaccacgcccagctaattttttgtattttgtagtagagatggggtttcactgtgttagccaggacggtctcgatctcctgacctcatgatccgcctgcctcggcctcccaaagtgctgggattacaggcttgagccaccacgtccggccgggccactgactcttgactgcaatgatatcttcccaatttggcctttaaatcttgggtcaacgatatgcctcagccaaattaaaaaaaaaaaaaagaaagaaaagggattcaacttctctcccaaaatacgcaatttaagacaatcagaagatgaatggcaattaaatcacattactctaaaaagaacaagggcaacttttagaaaagcattcctttctcttttacatgtttattattaaccaacactttaccaattctaacaaacttgatgattggtgccctagaaaatttatatttctgatgaaattcatggattcttttaacgtacagatgaaaacaagtgtgatatgtaaaaatgtggacatttgtgacgtgtaattggccttcacttttacgcaaaagacatcttccttacaaatgattttttttaaagcacaaagataaaatgtgcttagtccactctgaattattgtaatgttctcatctaaaaccaccatctatcaaagattatcttattttataccaaaggaccatccattcaatatttatccttctcatcctggaaatgtgctcacacacaagatgagggccctacctgaggagacatttgtataagtcattttattagcttgtctctgaataaaacagaatagacacctgaagtttacacctaaagagcagcactatttttaggctgaagagtgtgatttctgaaggccaatattaaattacacattctgaaggcaatgagttaacttatgttatcttggcaacaaggagttattacttattttgtttgacctaaaaatagcaaaaatttgcaaagggaaagcttgttaaaatatagtatatacctgaaagaatttgggtggaaataaaaagctaattattacataactagtgagggagaaaactgtgtaaattgttctccttttgcatggaagttcctaacttctagactagttagccattgcttcatattttatgctttatttctctggctttgaggaaaaaaaaccacaggtcactgtgaactaagaacagtccttaaaatattcatgcattctcctattttccatacaatagtaatgaaaaaaattgaacatttggtcaattacagaaaatactactacaattttcaagttatatatgcacacaaataatacctaaattcagaaagaaaataaagcctctcatcttgtttcacagatttcccagtaggatacttgatattggcagtgaaaatatttgaaagcataacttaataagccacaattgcatcaacatctaaagtaaaatgaaataagtgagacttttatcctaaacagtgaaatagatcataatgaaaacactttggaaataaagaagtttcaagatgctatatcacaactgctggcttaaattgtcaacctgcatttctagcctgcatttagaataatggcagtcatccatggcaaagttcccctgctagtctgtaatacgtgaagaagaagaaagaggtctatttacaagattcaacttaccgttaggcagagaagtagcaaacactttaaagaataattcttggcaaagactgcaagtctaaggcacaccatttaaaataatgatccttctgcaatttttatgatgtcctccatttgttcataaaaaagaaaaaaaaagctaaatcttaagggaaattctgaacaaacagaagttccgtcgaacaaggctataacaataatagagcacttttgaaaactaagttaaactcaaaatcctcttttctgaaaagaggtgaagatatttacatgtaagtgctaaaatataagcatatataaacattgatattaccataatcaacaacttcaacataaagatcactctaccattgacctttattggtcacctgctgcatacatataagagacaagatttagtaataaagcttcctctagaaaaatcacacggtagtagagaggtagacaggttaaattgccattgcaacacaatgtgaaaactactttatttgtaataagtggcagctttacttcaaagatggtgccaataaaccctcccatccctgtatgtccgtgatatttatcccatgaagatatatagagagctgcaacagcaatccatgaggtatgtgcaggacgtggggcagctttggggaagaaacaaagctacagaggaggcacattaacagagacttgggaccttcattcccttcccttgaatctggactactttgtgagttccaatgacctataaaatgatggcagaagtgatgctgcaccagttttgaacctggttttaaagaagcttggtaacttccacttttgctcctttagaatccagacctctaggctgtaagatattagtttagcctaccaaaggaggagaagccatatgagagagaagaaagatgccagataccttagctgacgatcagtaccaactgtcaactacatgagagaccatcttggtcctgccagcatcagcggcgctcccacatcactgaaatagtttgaatgagctcaagcaagaccaacgaactacccactgagtccagccaattgacacaattgcaaaaaattataagttgttattgcattaggccattgaggtttggaatggttgattatgtagcaattgataactaacatgaagtgagaaaaaagtgatcaaggagtacataggcctatagaatccaacctgattttcccaaggctaatcagctaataaaggacagaaaggcaattcccctgaattctcatccaggattgaataatattgcaaaggcaaaaatacaagctgtattatttttcttattgttgttgttgttgttgttgtttgtttccaagcaaactctggctctatggcccaggcaccatctcggctcactgcaacctccgcctcccaggttcaagtcatcgtcctacctaagcctcctgagtagctaggactacaggcatgcaccaccatgcccggctaatttttgtattttttgtagagatggggtttcaccacgttacccaggctggtctcaaactggtgagctcatgcgatctaccgcccacctaggcttcccaaagtgctgggaacaagctgtttaatgcaaacacctgtggctgaataaaaccttaacccaagaaataacctgcactggggtacacattagtaccttcattcaataataaattcatagtgacccagaatctggctaatgtccacataacagccctaatttgagtataaaattaatctactaattacccagtattaaaatttgaaagcactatccatatattacatatttcagaagcaaatataactaatcacatgagctgaccctccctcagaaatgctttatatgagacacagtttaatgatatggcttctgactatactgggagcatcaatcatttaacagcatttctttcttttgcaaaattgaatcacaagctattatttgcatgtttactattgatcagtaagatacaaaaccctgcatggtgaattctagtagtttaaattctgggaaatagtttatgaaaatgaattttaggctttcaccctcagaaaataagtcatattatttattgtagatgataaggaaaattttaaatagccttgttttttctgtgctttttttctcacctcccacacttccttccaagcccatatgacctcatgctggcctaagttcctttgctacttcataattttctcaaaagcagtatttgaataacaaaattaagaataaaataaatatgtcttcttagatatacctcctgaaagactccgtgtccacaaatcactcagctcccttcctcaaatcaaaatgctcaacctctgagtacagctgatctcagctagttattagcatgcagctttaacacaatatgattaatttatatactgctttaagtctttgatagacttagagattgatggttttgaaaaacaaaaaacgaagcccttcaagattgcaagggagaaatatcaagttaaagaacagagaaaaaccgcaaagcatcacttgaggtatttgtgggaggtggggcagctttggggaaggaacaagtctaatgaggagccacattaacagaaacctgggacctacgttgtaaacttttcatctacctccctcaagaaatcatctggaatccccacactgcttaccattttctaagagcaaactctttctggtattggagaaaaatgatcaattctgtcttaaagttggcctaggttcaaaacgaatactcttcatggacccagctgacttcaagatcacgtgctttttacacagaaaagttgctgctaaaagaggtcacttttcttgcataagaaagagaggaatgatactaatattttagtctctaatagttatttcttaaacatattgaaaaggatgatacaaagcccagaaggattctacaccagacgaccctagagagaactgattttctacagaatttacacatttcaaacaaaaatacaatgttttcatggagggcacagaatagtctgcaacaatgtgatttatatggttctcttacttttctgacatttgtctcagaaaacgtgcttgaatacattctatttttctgcaaaatgtggataataccatatgttgaaaaagtaaaaacagtgtggttattttctgtgttctcaccatttggatattatttcttactctcttcacatctctttttcactcatctttagaattcttcaaaagactaggctcatgttaggtcacatattggaaaaagtagaattactagaaagacattctgttgagttcaaaagattcaattaggaaaaaaaatcaacagatgattttaatcaaatttgtaagcatgattaaagattatctacaattttcacgtccttatttgctttagtataagctgctatcaaaaataaatttccagttatctattaaactattgaaagacattttatgaatagataagttattctgttgagcttatagcttctttattaatttttacatattcagtaagaaaaaaggcagttggttcatccaaagttatgtctaaataacagtttaatacataatgtacataaacacagatttttctcataagacatcaggattacccacagttctcaagtggcatgattcacatttttaagaaatatttaatgcttcccttttattaaatgctttccacaacattgtgggatgtattgtatttccgaccccttcctatcaaatgtcagagaacctaaaaatcattgtgacaatcatttccaaatgtccatacatttccaaatgtcctccaaaagacaggaacacccagtcccccagttaagaactactagactcacaatatgattcaggaaggaaaacatcttcacaaaattaaaaccactgaaacctctgcttaatttggaaaccataatgatgtgcttttgcaactgtagcattagagtattggaacaagttttgtggtctaatgtagattcatactacaggtgtgctaaatttgtaccatgtgtaaattttttgaaggagtaatttgcatttttggtaacacagaatgtctccagagaagccatgcttaagtctagtaactaaatgtgatggtctggttgtgaatcagctggcctcagatacagttctttttactactttaaaaacttctttcttttgagaaaaagaataattaaatgctagtgtattgactaacctaatttatcctattcagtttcccacactgaggacagagaaaaaacaagcattttatacacctgtctaaagctattctgatcactaaaatttgtgcactcaaatatttagctgcaccaatattgtaatggatcttttttatgttacattgtaggaaaagacaaagaagtagaaatatagaaaggaagttagtaatgggtaaaaaagaaaaaaacccaaatattgtcaatatcctattgctctgcgaagcagagtgctcataatattttgagtttgagaaaccaattacaaaaaaaaactatatttttaaatgctttagctgatggaatggattcatacttcttaattgttctaagagaacctttcacctgctaactctattatgcatagtcataatgcagtaccgagtgaagatatttccattaacaactatttttggtatgcccattagacacaaggaaggacagtgcagtaagaagaccttaatcatagatactcctgacgccaaactagtcatatggccttgcccatctcccaaagagaaaaatactgctactgagcttttatttttttattttattttttttttttgagacagagtcttgctctgctgcccaggctggagtgcagtggtgcaagcttggctcactgcaacctccaccccccaggttcaagcaattctctctgcttccaggcagccaacacacccagctaatttttatattttttagtagagacggggtttcaccatgttggtcaggccgatcttgaactattgacctcaggtgatctgtccacctcagcctcccaaactgctgggattacaggcgtgagccaccgcgcctggccgctactgagctctttagtctgcatcagatcttcttaatgctaaatactttacacacatagttttctcacttagtgtttactgcatgccattatcattatctccactttacagatgatgaaactaagcctcaatcacatcaaaacgcccataaaatttcatgaaaataagagaatgacacttcatcttagttcttgtcctcccaaaaccagtaatcccactctaatcatgaggaaaacatcagacgaattctaagtaaggcacattctacaaaatacttgaccaatactcctcaaaactgtcaaggtcatcaaaaacagggtaagttggacaaactgccacagccaagagaagcctcagaagacataacacgtaaatataatttggtatcctggatggaattctaaatcagaaaaagaacattatgtaaaaactgaggaaatacgaataaagtatgcacttcagttaataataatgtatcaatactggttcattaatttgacaaagcacatttatataagatgttaaagataaaggaaactgacttggtgtaggtgggaaatctctatatagtgtactgtctctgctatttttctgtaaccctaaaactattcctaagttttaaaatatgttttaaaaaactaccatgctgagaaaaaaatttaaagtccttacaaaatggaaagttatactatgttcatgggtcagaagactcaattttgttaagatggtgattcacctcaaattgatatatcaagtcaacacagccccaatcaaaatcctagcagatgcttttagtaaaaatagacaaacttattctaaaattcatatggaatttcaggtgacctagaatagccaaacaacttataaaaaggaaaactaactttgagaactataactaactgatttcaagactaactgtgaagacaatatgataccagtgttaatatagaaaaaaagatcaatgccacagaatacaaagtccagaaagagacccacaaatatactgacaactggttttcataaaagtgcaaagtcaattccgtggagaaatgagtcttttccacaatggtgttaaaacaattggatgcccatatgaaaaaaacaaaaacaaaacaaaacgaaaaaaaactttgaccataactcataccatatataaaatttaacgtgaaatgtaacctagagccaaatgtaaaacacaaaactacacaacttctagaggaaaacatggcagaaaatatttgcaaccctagggtagacaaagatttttttagatatgacaccaaaatacacatcatagcacaagaaattgataaatttaacttcatcaaaaataacaatttctgttctttaaaacacctggttgttgtgtttgtttgtttgtttggtttgtttgtttgtttgtttgagacagggtgtcactccagtcgcccaagctagagtgctgtggtgcaatcatggctcactgcagcctcaacttcctgggctcaggtgatcttccttcctcagcctcccaagtagctgggactacaggcatgcgccactatgcccagctaatttttgtatatttagtaaggatagagtttcaccatgttacccagactagcctcaaactcctgggctcaagcaatccatcaacctcagccttcccaaattttgggattacaggcataagccaccaggcaaggccaaaagacattcttaagagaatgaaaagacaacccacatactaggaggaaatattttcaaggcacatatctgataagaacttgaatccataatattgtttaaactctcaaaaataaataataacagaaacaagccgaccaaaaaaaataaacaaatgtcctaaacagacacattaccaaataagacatacagatggcataaaacacatgaaaagatattcagcatcattcaccattatagaaaagcaaattaaaaacgttaaagactgatcatagatgtttacagttaacatatattacttccgttttgtttttaaatctctattttaaaaagcttgtttgacctggattccattcacctaagggtacatattatcaacatgacttactaccattgatatcaatcttgattgcctggctagttagtatttttcaggcttctcttctgtaaagttactcttttccaactctttacatattatacttttcggaaaaaagtcaccacgcttatttcacacttaaaaagtgggaagccatgcttcacttatttcagggcagggtacatagatttttagtacacatatctttcacatctttcacaagtcagatttatccctagtactgtataatttttatgctatcttaaatggtattgctttaagttttaatttttaattgtttgttgttagtgattagaatatatttgatttttgtatatcaatcttgcaatatacctaatcttgtttgttctagtatctttttgtagatcacattagattttctttgtagagaacaaataagagtaggaaataaaaataattttacttatttccaaaataataataatgtgagaaagcagtcttaactaatgggatgagcacagagtccagttaaagtcatacttctttatgtaaagttaccagtgttgggtaacttcaaaatgggtggcagaaaaatttacatgagaaaataattatttttaatttcctaccctctctaaaaagacatttagcaatgggaggcagtttactacatattcaccatatttaattcattcattcaacaaatatgcctagctacaaatttcatcaaattattttattctatcatgtatcaattttctaactgctaaaagtgtataatttatagtgttagaatgataaataaatacataattaactactcaacatttagtaactgatactaactgttagctatatgctgatcttgctaacagaatacataaaatacgttttaaaagcaaaataacatagaatggagactaaagatcataatgcacattgacgcaattaaaaacaaacattcctacataaactcatttctataattttacctttgtcttagcaacttcactttttgacatagtgaacaactcatatttcacatgtactcaccattgtagctttttaaaaaataatggacatactatacacactcctatattattttatatttcaatgctgaaattttaattaacatatacatatactcaataaaaacaataaaaaatatgactcattctctggaaaatttcattattaaaattactgttattttataatgataacatctcattttgttgtgccctaggtataatgaaacactctttttattataataaaatgcaataaaaagtgttcttccctgtgttactgctgttattttgaattatccttataaattttctgataatgagggtaggctatcatcaaaagatgcctccattaaaatataacaatgatggtaatagcttaaaacttgtattgtacagctgaaaattcatttgtacacatatctcttttcatccacataccaattctgttaggtgaatatacttaaccccattttacagatgtatccccatttatatgacaatgatcataatagcttaaaacttttattgtacagtttaaaattcactttcacacatatctcttttaatccacataccaattctgttaggtaggcattattattatcccaattttatagatgtaagtactaaaaagctaagttgttttccttgtcctaagcaacacagctaattagggaagttaatttttctccactgcttttaatcacattaaactgatccttctattcaacacatgaagttaacattctatgaaaataaaactggaatctctgagtctacattgatcacaaattgaatgtatcctctcaatacactgttttagtcctttatatctttgatagaagtgaacatcctaattatgcccatgagttacatatatgagatgccttcaccccacttcaataaaactctttcttaatgccaatataaaaaatactctacattaattggtaattgtgaaaagagactcagggagagagtctgaatcaacaaaagaggaaaatataggaaggaaagggaaagacaaagaaggagggtgagacagagaagagagaacaaacatccaggagtagtgatgtgaattatttgcttagttaccacaaaagtaataattacactaactctgtgggaacaatggtaatttcacagtagctcacgttactgttatcaccttatatcctgataactgtgaaattaatttgtggcactactgtatgtgtcggccataagctgttcccttggtaacagtattatgctaccatagagaaggaatgtttggcagtaaaatgggcagcagcaagctgattacacagggaaaagcttctatctaaatacacatagcataacaatcacccctggaaaaactacatggcttaccaaaagaggtctctctgttcactgtccattatctgttgactgaactagttcaaatgaataacaagtaatgatcaaattgccagtttatattttacaacagagtcttatctttaaaaaaatgcaaggaggaaatacaaaaatgtaatacatttatcttgctttcttttctatttcctcccctgaaattattactatgctattggaagccatacaaacacatatatacacaaatatacatatgcttcaatgaaaagcaggcatgcagctgacagctcggcaaccctgaggtataaacaaagataccagacatattttttgaaataattttgctcaaggaaattcatttcagtaggaagatcagttactctgctgtctcctacctacaaagttacagaaggaaaagttcaacatttggccaaaaggatagtagcttacatttcttttttttccttttttcagcacagaattttgaagagagaatacactaaaagggaagaacataactacatgacatcataagaagtcctgaattagaagcgtatatttgaaaggtcatgcatcctgagctgccaacagcttaacaaccagaggcagaggccagctttgccagctcactgcttctactcatctttcatgatagtagccaggctgaatatagttccaggatgataatgaattggctgggcatactgtttatattagtatgtatgttcctgtactaaaccaagcatcatgaggccagcactattttgccatttttcagaaaaaaaatatgaacccttcaaaacatagtaagccttttttaaagtatatatttgattttgaaataatcaaaatatatgtagggatatgactgcatcctaagatttatgataagttctgatgagtaatattttctttctacatgcaaggcaaagttaatagtaactagaaagtctttatttggcatatcatagatttctgtcaaccaaaacaactaactctggggaacataacgttctgacaacttcagaagagttaagtcacagacaaaagtttattggatcttagttggctcctacccaccaattctttcttttccaagtggaacataatagattttcaatatttgttaaataattgaaaaaatatcctcaaaattcttttttggccatcttcccaacaagaatatggtcctaacctatatgtagagtcctttgctgtgtcatctatttcttcagaattattctcctaattcatatgtctggatagtctctctgaattgttatagaaaattaaaaatgtgaactatgaaattaatttttaaacttttataaccatctagtcatacacagaataaccacaaatataaacatggtttcaaagaattccctgtgacaatcaagcaaatagtgaaatagtttctgctattatgaatttatcacttactcagtgtatgaccatgggcaaatatcttcacctcaatcctgtgaggcaggtactattattctacccattttaagtatagatttgcaatatttgttaaatattcaatatttgttattataaaatgagtatactaatagtacctacctcacagtattgaggtgaagatatttgtccatgtacgtacaatatgggcataataatagtacctacctcacaggattgttattaagaataaataagataatccatacaaagtatttaacacattattgaaaaattaaatgatcaaaataaagcttgttgttattgttatcttttaataaatgcatctaaagtatttttaaatgtattcacttcagttatttaaagtttcatctgctgtatcacagagcacatatatgttcagaaacatttgttaagtatctatgtaccagataataaaggtggtattgaaaaaagaataggcattgtaacaggcagacaggagtataaagtccagccttgccacttatgagactcccatcttcaaattatggaacctttctgaatctccattttatacctataaaaaggggtagacattacgtctctacttgcttcttatcattaaattaaaattcatattcctttctatggcaaggaaacgagtcctgtatagtcttgtaattcatctccctccaccaaacttcatccacactgacttctttaggccaagcttgttcctatatcaaggtgagcctggaagcctgtacactgttccacagtggtacacctcctctagccctatagaatgcaaaatggaagcacagagacattatacaatggttagccagtcacattacatcaagtaaaaacaacaagttaccatgaagtttatttattggagtggcttcagtatttcttgagaaacacaaatgatgaccctgatttgtatgatcaatcagcaagttttcaaaaaggttactgagtatatgacagtaatttctagagccaaagatatacccgcatgaataagctttcatcctgaaaaaaaaatcaccttctgaaactccatgctagttatctgaaataataaaggtgaagtacaaattatgtgatctatcataacctgaaataaacatatgttgctactctgtgatttggtctttatcccagtctgacccatttcttgagactgttacctcaagatgctctcccatggagctttcactgagaatactttaatccattttcttaaaaatccataacaaaattactaagatctcaatgtcttatcaaaacttttttttgtctcaaaaatgatacatgaaaaagataatcttcaataaatgcaggtaaagtattttatacctgcagcattgaattgttccactggagggtagcagggggaaagaaagttcacgttgcctagaacagaaccttgttgttaccttaaagtgtgttctttctgaattttctaattcaatcatcatctcttccaatgcacatctccaaacctcccatttcacttgttcaattcccccattagtagtgatatttatgctcctcaggatctctgtgtagcaaagtcctttagcgaaggcacaagaactagactatagaaacattcaaattccatatttgccatttattttttgtataaaggtagatgtcttcatattaactgtaaaattagagtaataatggtagtttaaatttaagtaataatacctacttcataggagtgtcacaagaattgagtaaatatatgtaaaatatttagaaaagttgtttgcacatagtaggtgagcaacaaattatagctattattattattgacttctcttattttttcttatctatttacttcaagtttttactgttcaaattctatttttcatcacttcaaataactctttataaagagcccccttgcagttcttccatcatgcctttcttagaatatcctaagtctagatgaaaatatccatgtccacggtgaaaacctatgcagaaaactagcctcatggtctaacctctgtcacagatcgagctctcaacactgcacagcaatggaacttaacttctttggtcaaactcccactctcccattccccagaataactcattaaaactttcctctttctcttccaatttccaagccagtcctattccattccttcttcctcaccagataacctttctttctacttctgtgacaaaacaaagttttcaagtggcactcccaaatagtgctgccaccatctctgtggacctatttgtaactgccactgtctttttttctgtctgttatcatgatgctgtttctgaccctcctcccagtaaacaggaatccccacaagtgtaactagattccatctccttccaccttctgtagagtcaaatgcttttaactttcatctcttctgttgtttcttggagcctccttaataccatttaattatttttgattgttccaatctgataacatttctccctgagtcttacatctccttcctcctctgcacagccaaaaagtaggaaaaagtttgtcatctatagtgacaatctccatttcctttctttgcattcatccatccattcattctacaacctattccaattgttatggactgaatgtctgtgcctaccaaaattcacatgttgaagccctaatcccagtgggaagcctttggtgggtaatgaggtcatgatggtggagccaacatgaataggattagtgtccttctaaaaagaggacagaaagctagttaatctcgttccaccatatgaggacacagcaagaagacaatactctgaaagtcagaaagagggccttcaccaagaacctctactggctccttgatctgaaactcctaacctttagaactgtgagaagcaaatgttcgttgtttaagcgatccattgatggcattttgctatagcagccaaaactgaccaaaacaccaatttagcttctgttcctactcctcaaatggatacagcttatgtcactaattatggccctgccacgagcttatattttactgagagagatgcattaaagatttttaaaatgtaagatatatagtatattagatagttgtaagttctcagaagaaaaataaattagaaaaatggataagaagtgttaatgctataagttgaattccaattttatatggtagccaaaaaaggcgaacctgagaaggtaacatttgaggaaagaactgaaggatgagaggaagtatctgggggcatgcaaatatctgagggcagagggatcagcaaatggaaaggcccattatttttctctctcgtgtttcttttttcctgtattctgtgaaactgttttatggtttgcctcctctcccttattgaaatttcaaccatgtgcagtaactattcactgcttagcatgtttttttccaatttctgtagttcttgtctcaattgtttaatttaaaatgtgataaagattatttattttattatttgactagtagtgtctaattttcatacaaacttaacatatctccttttaatattttagaagtaggatataaaatataaataagaaattaaaattaaaattcatcagtatatcaattgagcttttactttgtaaagggcactatgtctaacagaaaaaatgatgcaaagaagccagattgtagtgggttgaggtatgactgggaggtaaagacgtagagtcacgctgttcagactacatattcaaaaagcttggcagtgaaatgccttccagataaatttgtagttggatacagcacaattctgacagttggctctagcaaattctttcaggtttttaaaactatttaattatgaacatatgaacataagccttaattaagacaaatctttcttctgcctgaataagaactgccaaaatgtcagagggcaagactaaaagttcctgtctgaactcattttacagtctccacatttgcagactgtataatgctccatactaccagcaatcactcagcacattctcacactgttttagggtcacctcttctgcagtaggaactttggacttacacaataagaaatatataaggaaccacagagtcagaagcagcttgtactactcaaagcacaattttccttttggggcctcagatctatccctcagatatttattttaccaagactcccaactatatcttttcaagattcactgtcaagagacacctgacttttgagatcttatcctcccttagtatagaagtcccagttctcccacttatccttcttgccttggttgaactttctaaaacctagatctcttgccattaaaagtgtcaaatttccacaaatccacaaaatcaatcctttttctcctatgctatagtccaagatgttgtcctgaagtaatttcagactatttttcaaaagttctattggatcctatgtcaatttttttgtgatgtttgctgttcgtttaattcacaacatcttttcctcaaactaaactgaactggcaagaaacagataccagcaaaaaactgatacaggcaaagtttaaatgattcaaagtttacttcttacatgccttcaacataaaagtttattaatctttcaaaatgaacatattctctcaaactgaaggtatgaaattattacaatgaaaagaaactaaatatattaaatactgtataattatctcatttatatggctaaggttattagcttatatatggtgtctttaaaataattcccatttgcagttacatttcaaactgccgatttgacgcaccagtcaggaggaatgccacgactcctgctgtgctaaacttactgaaacaaataggaaaaacactttattgtgttttgttcctgttttactattttgtaattggactaccctacaggaaatactcttctttataatatatcactaagttactataataatcttgtttcatgctcttcctttacatatattcctgaattatcatttgtcatgggtaaaaatagtatgacagaaaaaaattgagacattaatcaaaaaggtgttttaaaattactgataatggtgattgctcttaattacatgattgaatgtatattcagagaatgaaaatatggacacacatacttctatccaagtatctatgaaatgggactacacaaaaaacagagagatgagaaatattttgaaaaatgtgacttctccaattttttaagaaaaagattaacagcatatatttcattattaaaagactacaaagttccccttctgattattaaatgaaatatggctgaaaagttaaaatttccttgtatataaagcagtcttgaaattcactcctgtaaactatgacttagggttatatttcattatgcttatatattaccatgcgttacatggttagttttaccaaagcaaataacttttatgaaaagtgctgatatctttattgatgaatttaaagtgttaattcagaaaatacttggcaactccacctcatatgtacctggacttaaaatatcaagaccatttttaaagtgaaaataactttgaaaatattttgtcactgaagcagtgcaattcatttaaatggttttaaatcgaagtagttttatgaacaattgtgctaaatagcaatgaaatttcatttctagtgaataatgaaaagtctcatcacagtctattaaaaaaacaaaatttgttgttatattaaacgttatttttcttgacccttattctcatttgttatgaatatctctgagggaaaaacaagagcctatgtagtgggatataatattcaatttagaaatttatataaataatgcctgttctttatgtattatcaccacttactaaggatcaaactacaagaatactaaaagattttactttacataaagacacatatagaattttctcagaaatagacacgcttgtgagtagtgaaacaattgaaaggaattaaacataatcatgcaaattacttcccataatataaagtcctaaaactatttgtgaagtctcaagatgttaagatgctatacaatttcattaagaaaaataaatgaaaacatttatttcataaaacattaattagacaaattctacagtgtattttgagtttatctatccctacagtatgtcattgatatttatcttcctacaccaaagtcaaagtcatttgattgtgttcacccaagtatagcatactcaatgatacagaactctctccagagaaaagagggaattaaagaaattagaagataacaggttgcatattctagctgtaaaaacagacacttcaggataggtaagtgtttaagtggtcacataaaaagctcaattaaaactaatttaacttcatctcttaggatttgtaaacctattcttttgagcattgaactgagttgacaggacaaagttatccttaattattatttaactagaccaattaataactaattcttaccaaagtaataaattatttcatttacatatgaggtagctgcaattctattatggttttataaaaaagataaatactaattttgcacttgataaaatattttgttaaaacaagcaatctagctacattttgattcgtttaaatgaaatataaattgaaaagtaaggatcacagagattcagaggcttactaaaaattacagtcagtcccactgacagagccagatgcagaaccctgggaatgtaggagaccaactaaaaggcaaagcaaatgaatttggggattgaaatgttgagtctgaagtttttgaagaacaatcaaatgtcaaacaaacatttaaaactgtaagtttgagattcaagagggtgactagggcagagaacacagacttgagagacactgatacacacagtggataagagccaaagaatagaacatgaacatagagtgagaacaggaccaggcacgaaactttcttacgtgtccagattttaaagaaaatataggggaaaaaagacagtgggttaaatattttgcttgaaataaacaaaacagaaagtaaattattttaaaaagcacagttttgtcttcctttaaacataatgatatgtagttgcttatattcaatcaatccatgactttgattaccaaaacaatgtgctgaggtagacacagaaaggaatttcaccttctaggcataatgtagtaagtcacaggaggccagtgaatgttctctctgctaaaatctagaaaaagctggataaaccacaacaccatattttttagaggcataagagatctgagaaagcaaggagaagtagacaaacaaaagttcctaagagaggagaactttcttaaaatgggctaaggagaaatcagcaaaacgtttaatgatcaccggcacaggcggaggggtgttataattggaaaattaagagaacaaacacatctgtttccccactggacacatactgaattcaagaggtttgtgggaggctaaaaaagagaggctagaagcttccaaaatacagaaataaacaaaatgaatgagggttcaggagaagcataaaatgtaaactgtcagacctgaaagaaaaaaactgaccaaattcaaatcatagttggagattttagcaaccctctatcagaatcataaataaatgacagtaatgatactgaagagctagataaatctacctattgcctcaatctaactgatatttatagaacactaaatccaacaattgcagaataaacatttttgtcaagttcacacaaaacattcaccaagaatagaccacatgcagggacaaaaatcaagtttcaaaatataatcttacacattttattttcttgccataatggaagaaaattagaagtcaataacagtaaaatctagaagaaaatgcagttgtttcacatcttcaccaaaatttgggttttgccagtgttcttaatattcatcatacaagtgggtataaaatagtatgttactgtcgttttaatttgtgttttcctgatgactaatgatgttgagcacactctcaggtttctactggatgtgtgtatatcatcttttgggacattttttactcaaatattttgactatttttaaaaattgtacatacttccttttttagaatattttaggttcacagcaaaattcaaaggaatgcagagttcccatatttctgctacccccacacaagcaaaaactccctcaccatcaacattctgaatcagagtactacacttattacaatgatgaactaacattgacacatcattatcacacaaagttcatagtttacattagaaatcaattttagtgttgtatatcctaaggcctttgacaaatgtataataatatggatctatcatgatagtatcatacgaagtattctcactctcctaaaaatcctctgtgcctcacctattcatctcttcatcttaaacccctggcaacccctcatattttcactgtcttttagttttgccttttccaggatgtcatacatttggaataatacagtgtgtaatcatttcagattgatttctttcatttagtaataagcatttaactgtactccatgtcttctctgacctgatagctcatttatttttaactctaaataatattcctttgtctggatgtaccacaatttatttaggctttcatcttctaaagaacatattggttagttcaaagtctaacaattatgaataaaactgcagtaaacatccgtgtgcaggtttttgtgtggacataagttttcaattactttgggtaaatgccaaaaatgcaattgctggactggatagtaagagtatgtttaattgtgtaagaaagtgccaaactgccttccaaagtggctttactaattttgcattcccagcaaaaatgaatgacagtcccttttgctccacattctcatcaacatttggttgtgtcagtgttctggattttggccatcctaattgtgtagtggtatctgttgttttaatttgcaattccctaatgacatattttcacatggttatttgccatctgtatatctttcttgatgaggtgtatgttcagatctcttgcccattttaaaatcaggttattttcttattgttggattttagtgcttctttttatatttttatgtcatttatttatctgttatgtttctttcataaaatttttaaccagtctgtagcttatcttttcatttccttgacagtgtcttttgcagagcagaagtatttaattgtaataaagtctaacttatcaattgtttatttcatggatcatgcctttggatttgtatctaaaatgttatcaccaaatccaataacatctatattttctatgttatcttctcagaatatagtaggcatgtgttttctatttagttctacacttcattttgagttaatgtttgtgaaaggtgttagatctgtgtccagtgtgtctagatttttttttagcatgtgtatgtccagtggttccagtatcatttatcgattgaaatgcctttgcacctttgtcaaagacaagttgattatgtaggcctatttctgggctctgtattccagctcattgatcgtgtctatcctttcaataacaccacattgccttgactactgcagctttacagtaagtcttaaatttgggtactgtcaattctcagactttgttctccttcaatatatgttagttattctgagtcttctgcttttctatataaggtttggaatcattttgtccataagcaagatataacctcctgatattttgattgtaattacactgaatctgtggaacaatttggaaagaaccaacatcttgagaattgtgagtattcctgtccagaaacacaaaagatgtttccatttattttgtttctcttcaatttctttcaccatatttttatagatttcctcatatagattttgtacctatgttatgagatttattaaatatttccttttttggtgctaatttaaatgatattatcttttaaatttcaaattcttattgtgcattgctgacatatatgaaaacaattaacttttgtatattaatcttgtatctggcaaccttgcctattagtaaggaactaataattgttgattagttctaggaaattttttggtcaatttttaggatttcctacatggacaatcatgtcatctgtggacaaatgtagtttcatttatttcttcccaaactgtacacctttattttcttttctttctcatcacattagctagtgctgccagtatgatgccaaaaagcactggtcagaacgaacatccttgccttgttcccaatcttaccaggtcttaaattggggtttatatctttttattatttaaaatatttatttatatatccataatctttaaaaaatataataaatatatggagtaattttattttgtaaaaacactgccaaactgtcttccaaagaggccataaactttaagtgactctttcactgcatttgaaaagttttcatgtttaatttcattgttcagttcaaaatatttttttaatttcccattatttattttctgacctatggttattttgaagtgttaatttctcaatgtttagaccagtatggctaaatatgagagataaattgagttctaaaatataaagtcatggaggcagtagaggggatcaggatcacatagggcattgtcagaattttgactttaagtgcagtttgaaatcactagtgggttttgaacagaagagaaatatgatttgaccaaattaaaagatcactcaagctcctgtgtgaagaacagtctttatggataccagttacaagagtaatcttcaaccatgactgcattctgaaattatctgcaatgggatgcttcaaaaacactgatgctaactgctacctctccaacacatacacatacacacacagacacgtgattcatgcatgcctgtgattctcatttaattgatctgaagtttgtattgggattctgttaaccaccctcaccacacctccagcccaagatgtcagctgttacaatagccagcaattacggtggcttggactgaagtggtagtcttagaggctgtcagtcttttaatattttggatatatttttaaaggagagtcaacaatagtttccgattgactgagtgtagaatacgagggatggtttaaaaaagactagaagagtcaaggactacctaaaatttgggagtaagctaacttctgttgaactacaagacaaatcagtggtcacagggagatgcaggatagctgaggtaccatgtagtatacacaatatcacagaattaagtgtctgaggtaactgtgagagtaggtgactgggttaaggtggagaaccaaaaatactggagaagaattgaaggaatagaggccagctactgaacgcctcatctatgtaggttattgaattaacaaagaatcaggacaaaagttggacaaagcgagcccagagacaaactttataaagaatgaggagtgtgaccaaaggatccataggtgtctacaggaaggatgggtaacaggcaatatgatataatgggaatcacattttatagatttccagaagagaaaggtaaaataaacaagcaccggccgggcgtggtggctcatgcctgtaatcacagcactttgggaggccgacgcgggtggatcacgaggtcaggagatcaagaccatcctggctaacatggtgaaaccccgtctctactaaaaatacaaaaaaattagccgggtgtggtggcgggcgcctgtagtcccagctacttgggaggctgaggcaggagaatggtgtgaacccaggaggcagagcttgcagtgagccgagatcatgccactgcactccagcctgggcaacagagtgagactccatctcaaaaaaaaaaaaaaaaaaaagaagcatcaacgggaaataaaaagggcacttacccatctcgcttaatacaacagatgtgaagagaaaacagcatcatgtgttaaataattatatagcatatcatcctattttccctttaattacacattaaagggagtgaatatttaaatttgatattgtcaaataaacctgcaaagaaacattctactaatgtacactctcaccaatacagttccctatccatccagttacaccagagacctgactgttaattctcttctcccatccttcacattttacatcctaaacatctctccaatccctgcacattacttgagctctaatatccatattagagctctcatatccatctcttaccaaaaccagtatgacaggctcccatgcagactctctgtattcattttagatccttctgaacctttttatttcagccagagtgatatttttaaaaattctacaattatggtgatatatctcaaaagcttaattattttacatacttacctagtatacgaaatactcctagtatagagagtatttagtaatacgaaatactcctagtataaagacaaaatttctcaatggggtttcccaaggttggcccctacctatagcttcaacctcatctcccacaatgtaactccgtaccctctgcgtttttcatattggtcttcagttactttcatctaccccatgcccacaaatactttacatcagaaaactctcatttatacactggcctattttcttagcctatatccacttacccttctttcagacttcagcttgattaactctttgttgaagactcccctgtcaaatcttcctataatttgttgaagactcccctgtcaaatcttcctataatttacactcttagcaacacttcttcctctttgtagaattatcttagttacaattttatatacatttgtgtggttatttgatcagtgccacctgcctgcccgttatccaattttcatgaggataaagctcatgaaaatttgctcataactgtatctccagtttctacttgtactttgtatatgtaagaactcaataaatatttgaaagactaaaccaggtgtaagagtatctccacaaatgttcaatgccactgtgccttcaatggccttacactataattcttaaactagagtcatcccttagatataaatgctagtagtattcacaaatacaaacattgctcaaaacaataaatatttcaatgtaataacccctctttcttaaagaaaacctctaaaatgtcatagattagatctcagccccttgcacataaaaaataactttgtttcgaaacttcagttttacaatcaatcagtattcttaattccatcttaatacacatactaaaatttaaaactatattaaaatacataatcatgttgcaaacatacataacttttcccctattataatctccaaattgtaggctgaaattcaaagtgtatatgatagtgcactgtaactcttagctataaatagttcttataaagcctaataccctttaattatcaatcacagataaagagtctgaggtcattaaataaattaatttaaaactataaaaaagtgatacatacacatttgaaggtatcattaagattagaaaatcactataagtggaaattttagaaaacaatacaacagtcatctctttctggtgataacttctttctttcctcatcagttattatatagctgtgactattttcagattttcctttacccactgcttcttccccactggttttgctttaatcttccctcatgattttagaattaataaatgcatgctgatgacttaaaacattttatgcacatcactggcttccatctaaatactttcaaaaaaccacctcttttgacagtaaatctacccctaggcactaagctttgaaagcaggaattgagggctgttcattcttataccttagcacccagccttgtgcctggtatttgacaggcctcataaattaactgaatttaatgatcaagaacagaaaaagatttgcctcatattgtttttagtaactacaatcactttctgtataattagagataaacctgaaatgtgataagccattcaaaaatattcaatctgaatcatggtgcaaggaatgtgtgtgtataatatttatgtatgtcttcaaacactaaggacttttttccaaagtacatttttaagactgagtaccctaacagtaacacaataatctagatttagtcaagtcaaatttatctactatgctatatatttatgaggatacaaaatataaaacttggcttatggagaggtattcatggtcctaaattatttggcattttaaaaaatactctatttctgggcatcatcatatttaaaatgtatttgtttttataaacaagcagaaaaatcataatcacaggcatacaatgattcaggtatgtctagaaattattagtttgctcatattaattataggtttcaaagagtatacgttagtattgatatagtcaagaaacccttctgcaataactatgtcatctatggaaatatgtgtgacaaaaatatttatcatgctctttaaaaacagacaggtactttggtggaagtactgaaagaacaatcaattctcaaaaaatttcagatgaacagattataatcccgagtaaatatgaaatgcaggacaagtcttgtattaatgccaaagaacaatagactttcattttggtggaatgccccatacaaggaacaactttcagactgcagttaatggtagtgactggctcgaactggctacccaatgtatttaaattatttaatatagcttcctcatatgcaatcatctacctttaattatgtgtcaaaactagtaattattttcattcacaggaagaaaattcttatcattttttcactactaaaaagaaaaaaaatctgattccccaaacagctttttcatccaagctgtttaaatttcaacccaattcttacctctgggtgagaaatgtctcaagcaatattccctcccagaatatgaaattataaacatcatctaagaggatgaagaaatgaaatatgaagaaaaaatatgacaatgacaaatataatgccagtaagtaatttaaccttattgtaaatcatttttctttccccatctaaaagaaaaaaaagaattactctaaactctcctgaaagatagagaaagatgctagcaagataattggtttgtaaacatagcacagatatcaactaagagtattacctctgtggtccaatgacaaacacccatttccactaaaaattgatgttatggaagatctctaaataaaattactactattacttctattccccagccaaaataatgtcccttaaagtgggacagagctataagcctgaagttagaaaacatactaaattaaactaaatttcctagaccccttgggaaacattaggaagactgatctttaaatatctgtatataatttcatgatatctattattttattcctgtattcctttaatgaagctttctctaatatgtgcataaagtgtactgacaaagtacttttatcccatggcctagataggaaacacacagacacacacacacacacacacacacacacacacacacacacccctaaaattttctgagaggtaatgagttctgcaagaggaatgagtctgggttcaaattctggctccttcaattttgtgccatatgcccaaattactttacctctttcattcaatttttattcacctaacctttattgatctcttttggaaaagatgacactgaagctgagagctgaatagcaagaagcagcaaggcatggaagagcccatgtaagaaggagcccaggtaagcatcaggtccaagcctggaaagttttagggatggaaagacggttggtcagaagctttgtgagcaaggctgaaagaggttagacatatggttaatgagtcagaggaagatcacaaaggtttttgcaagacaagttaggagtaaggaatttgtcatttattctaagtaaaatagcaagcctttggagagaaaggtcacaatttggttcatcctggtgatctgtggaaaatggatttttaaggaaagaatgtaaaaagggaaattagtagttcagatgagaggtaaggagggtagcaggggagaaacaaaactggacagattccaaggatatagctttaacaggaatttttatacaactttcttactgattagatgcgcatgtgagagagaaaattttttccacgaattccagatttgtagttcaaataactaaagatgatgctactgccatttactcagatagaaagacttgtggatgaattggttcagtggagggttgtggtgagaaatccaggaatctccagcctggccaacatggtgaaaccccgtatccactaaaaatacaaaaactatccaggtgtggtggtacatgcctgtagtcccagctactcagtaggctgaggcatgagaattgcttgaatctgggatggggaggatgcagtgagctgagatcgtgccactgcactacagcctacgcgacagagtgagaccctgtctcaaaaaaaaaaaaaaaaaagaaagagagaggaaagaaagaaagaaagaaagaaaggagagaaagaaagaaagacaaagagagaaaggaaaggaaaagggaaagggaaaaggaaaaggaaaggaggaaggaaggaaggagagagagagaaagagggagaaagaaagaaagaaaagagaagaaagaaaagagaagagaagagaaaagagaagagaagagaaaagaaaagaagtccagatccagatatcacctttggatatgttaaatttgggttgttatttacatactgaagtggctaagtcaagtgtctcattgaagtgtaaagctgaagtttttttaggggagacatcaaaagtagagatgaaagtatggcagttatcatcaaatagatggttatctaaggaaagaaatgataactacctaggaacagaggagaaaatagtagaaacaaggcattccaattttatgtcctataatatgtcaatatttagacattgaaaagaggaggacatagctgccaaggagagttaaaaggagtggccaatgaagcaggggaagaataaaatgatgtaaagtaacttaagcctaggaggaaaaatgtttcaagaaaggatagtcaattgaagcaaatgctgcagaccagtcaagtacaaattacagatttggcaacacagagcactctcactgaacagacagcaagagatgtccaggtggagtggattaaggtgagaccaggagattagaaaatgaaaaacctttattgacaactctttcattaggctttgagggtgaggagcaaaatggagtggcacctggagaggaaaatgtagacaggtttcatttatttgtttgtctttaagatgcacaatatgcaagtatgaagatgtaaataaccatgtaaaagcaaaaattaacgtttcaggagagagagagtaattacacaagggaaacttttgaaaagactagaggaaatgggatccagatcacaagtgaaggtgttggcctttgacaggagcaaggcctttccagccaccatatgaagccattgaaattagggtttattcccagttcactgcatatctgcacatatcacaacagctgtcaccaaataacatcttgcacatcaataaaacaccaagaacatttacatttttaatttttaatttttttttttttaggagatggattctcactacattgcctaggctagagtgcaatggctattcacaggtgtggacactgtacactatagcctcatactccttgtgactcaagtggtactcacaccttagcctcctgagtagctgggactacaggtgccaaacacattttttaaatggagcttagaatatcctatataccatctcctttcactcaaaaaaagagaaaaaaaaaagaaaatacaaaaacaaaaaaccctctttgtagactacaagaaaagtattcaagattcactaatttattaaatatgcattgactaaatttttaataaaagtaattctttagataattccatgggtataaaacttacaaaggcattaaaataatagaccacaatcaatattttttcaatcggtagcagatatcatagatatgccttagtatagataccatgattcatctacttaaaagaatcataaataaactaacacaatgttgtccttttataagtaccatactatacaaagctaattgtccaactaagagcaacattatactgtttcataatgtaaatgattcattggtggttattccacattttaactataaaacataaacatgaataatcaatgctagttaattcagtggcactagtacctatgtctcatgtttgttgcatattggtgatttcacaagctagattgtctgtttaattcctaatcacactaattacttgaaagagtaatccaggaaatgtgacttattcaatttcaaagaacagcctagaaattagtagatagggcacctcagtaatgttatatagtcatgttcattgataaaattggaaggacttcatagtatttgtattaatctatcagagaaaatcacaaattcttaatatatttctccaaacattatttgaaatttcttctaatggacttaagtcatgtttgctctcaaccaggggtctgcaaactacaacacaagggctaaatccagatggctgcctgtctttataaataaaattttattggaacacagccacatcaacacagccacacctatgcattcacatatggtctacagatgcctttgtacaacatcagcacaattgaatagttgtgacagaaattatgtagcccagaaagctaaaaatacatgctatctggccttttacaataaaatgtttccttacttctactcgattttcaaaagaggcaacacattttttaaaaacaacttgtcagaatgggagacttttttccccaaaataaaataaacacaaataccttcaatggaaggtatttagtacacatcataataacctgtagaaatgctggataagaaattgtattaattatcttctaaatggaacaagctgatatatgagaaatgagaaatattataactaaatgtcaatgtctatcttccagaagagatgacttacaaaaaaacatagggccagctattttattatagtatattgtgacatatataccaaataattagaacgagtaataaaaaatgccaacgtgcttataaacaatattatctgtaaatctattctattagtcttctttagttgtagaaaatgacaaatataattacaaaatacttattcaaaacatgtaaaccactaattttccacttgtaaaagcctgattcaaaaagcaatttactttaaggtttacttaagctttgcaactacattaaaatatgatagtatatacacaacagcttgttaacaagattatcataacattaaaatcataatgtggcacttcaattatggatacttaaaattaaagctaatcctcacagtaccaatttttatctcctaaataattttagctattagctgctcattcaaagtctgtatctaaaatgataagcattctagagtaacgacttagctctgcacttttctttggtagcaaaacaaaagctgcatcccttctttcctagtccttaatatacaatcttttgatactaaggggaaaatgcagttttttcctgaccttgcttggctcagagcttcttactcatgttgctgttgccaatgctgttgtttcaaacagatacattctgtatatcaatggtacatatttcttttctggttttatctttccaaaaatatcaaactatcacttgcaatattaatttgatattttctgcaaatactatgtttgaacaaatgtcacctagtacctactaggcaccaggtggaacaaaccaatgcttagattaatgagtattataatgtatttcataaataaataattaataacaattaattgtgttagcctattaactgatttcattttttctactgtttcaccagatttgtacttgataattatgtaatcaatatttctcacctttgaattctaattcaagtttaaagtgaaggaaaagattctaaattgaaagaattctgtatttataaatgacagttaataacaaatccataaataatccagaagcattgttgccgaccatatggttgattttactaaacactggtaacagctaatataattgttttcttctatttccccaattaaattatatttgggccatttgagcagtgagattggaaactgagtgtcaaatcttgctttcactcactcctaaagtgaatgaatggaagtaatattcctaatttacatggcaaacagataataccaaatgtgtgtatccgtgtgtgtgcatgtgtatatatgtgtataaagacatatacacacattcatattacaaaatgtacatgaaactaattatataaattaccaaatgtgtgtatccatgtgtgtgcctgtgtatataggtgtataaagacatatacatacattcatattactcaaggtacacgaaattaatcacatacattacaaaaattacataagactaattacatatattttctgacctgtatttcaatgatatttattagggcaggtgcatgattatgtaaagtaatcatgcacttttgtcttttgatttcaaaaaaatctgaaagtactcatcctgattgacttcctcatgtgttaggtggcataaaccaaatcaaagaacctgctctggacatggtgaaatatgtgtttttctgtaatagaaatgataaagataacatgttctctgtgcatagaagacaagagaatactcttctctgctgatttggggagtagggctttcaggaggttcctgctgatctatttagtgatagaaaacttggaaaaacataattaagatagaattttagaaatgattaaaatagaaaagagttgaaacattgcttctgaatccaatctcactgctcaaacttttcaagtagttaaaatatacccttatacatgggcatttctgattataaaggaatttgtttttcaacactttgaaaattaaaaaaaagttacaaacgttaaatcatgtattactacttccatcattacataacattttcagaatgtttaaaaaattatttactttccatactattaaacaacctgctaatttcactggaagtattttgttaatactttctcattttatttattttatattcttcttcaatgccactttgatttttccctcatagctttatatttactttgtaaactacttaatcaatttgctaatctcaaatacttagcatgccttgtccttccactcttccatttttaactattttaaaagaattccataaaatttccttaaatctttgtaatcctaatgaatacacctgaaaggcaagggaagtccaaactccaaatgctgtcacagtgcaagttttccttgactgcaaagaggagattttatagagaaatatatccatacatatacacacatgtaatatctatataatacataccacatatagaaatatgcatacacatgcacacacacaaatctctaagaataagataaagtagaataatggccatattattatctttaaatcttattcagaggaacaaaattactcggttcatggtttactaatcacagcttcctcggagtcatggttcatgtagaagtatcagttaaagtatcagtgtaattcaaccattatatttagcaacagatgcaatattaacataacccaaatcataaacagctaaaataatacctaggttccagtagtaacacaacccttaggtcagatggtagtcaacaccagtactactgaatactaacagaggagtgaaattaaagacatacattaggctaatacacacagacgggacatacctgaaaagctgaaaaactacctcttttaaatgtcttggtatctcttttcggacctcagcctttcaataaaaagttagattgctatttatattgcttccacctctaaaagtccttgagttgaaggtaaagaaacaatgacattaaagcaattttaaccttttgactcaaataatatttagaaatgttagacctcttaaaagctactttccaagtttacatggctatacttttatatttaactctgtataaatggctgtttatgatgcacctacaaatagtatacacacaccagtaaaaaagccagcacagataaactgtgcaactcaacatcaccatctagtgacaaaattcttaacacgtgataaagccaagcgaaaaagaatacatttcagagacattctgtactggtagttcatctttatagtactaatgtaaatataacagatctcactgaatagacttcgctctgcaaataaaacaatgcctaatggcaatgttggcactccaaaaataatttgtattcttgccatagagatatactcataaatctattaacaatctatattttatgtgtattaagaaatacactgtaaaaaactcccaatagtatttttattttttttattaatgagtatattctatatgtacctcttctttttcagaatctgacgtcaccttttctcaagttattcaattcaagtaccttccaattgcatatatctattacccatagccctctactgcctgtgagactgaaaagggacaaaaagacaacacattggaggccgaggagggcagatcacctgaggtcaggagttcgagagcagccttaccaacatggtgaagccccatctctaataaaaatacacaaattagccaggcatggtggcacatgcctgtaatcccagctacttgggaggctgaggcaggagaatctcttcaacctgggaggcggaagttgcagtgagccgagaccgcaacaatgcactccagcctggacaacaagactgaaactccacctcaaaaaaaaaaaaaaaaaaatacaacacaatgttaaaagtggccccatccttccctttactgttcaggatttatcacaggggctaaaataggtacagaatatgatagtaaagaaatcaaatccctttggcatgattacagagttgaatcaaccaagataaagaaagaatatgatgaaaagaagttgagaattttacctctaaattcattatcatactataaaccagagatttgacctagagatgatgcacttttttcctgtccttaaaatgctttttctttgattatcattttcagaaatgctgtataagatttccacacccatggcactacaatagactatgtagaagttggacaagatatacagcttctagtattctatatgctaagactgcagtgaacttctccattgaattccattatttatacattacacatgtaattcttgtaagcacatacaacattaaaaggaaaaatgtatacaaacattatattttatatcttatttttattaattttcataaattacaaagcattctctcctctatatcctagttcctcatataaatcctaggagattttaaatcccattttacaaaaaagtaagagtaaaataattaatttacctaaaattacagttggagtctcaaatctgattcttactattgattccagtatttatttcatatttttagttttctccatttttccttcactgtttttctaattattcataatatattcccattacagaaaatatagaatggaaaagcatacgcctcaaaaaattatctttacgccaaccagccagatgtaatagccacatttcattcctattttttctctgcattttttatattcagttgagataatattctacaagcaattttgtttctctctctctctctatatatatatacacacacacagatttattttaaatatatgtaaatctgtgtatatatctgtaaatataaatatattatatatctgtatatatacacagattttatatactttataaatttataaatattgtaaaattctaaatatgaatatataaataatatatatttatatgtaatatatacatttatatatatttatgttatatacatataattgccttgtctattgtcttaatggtagacaattagttcctgtaaaatttgttcagggttatattccataatttgagtatcacattcatattatgcataatttctatggcttctgcataatatattcctagaaggtaaattaatacaaaaaaaagtatgtttgttttaagtctcttaatacttagtgacacaatcctttccttaaatgcagcagtaattttcaatcctctgagaatgtgagaatggctgtctcaccattccatctctagccatctgtgagaatggctgtctcgctattccatctctagcactcaaaaacttcccaccaaactgcattagcagcaataagcaagagattggtgtattttttgtgaaatttacactttttgtttgccattagagttgaatatttccaagggttacttaatcatagtttgccaattatctactgagttcccaatttttaaaatctgtcatacatatggcaatatagtacattgatgtcttttaattttgtgattgtccccatttgcataagttttttaaaataagtttgtttttaattggcacataatagttgcacatatttattggatacagtgtgatgtttcaatacatattagattgtgtaatgatcaaatcaaggtaattagcatatctattacctcaaacacttgtctttttttgtttgtttgttttgttttttgttttttgttttttttgagacggagtctcactctgtcacccaggctgaagggcagtggcgtgatctctgctgacttcaagctccacctccccggttcatgccattctcctgcctcagcctccaaaatagctgggactacaggcccccgccaccatacccggctaattttttgcatatttagtagagacggggtttcaccgtgttagccaggatagtctccatctcctgtgacaacactccaaattttctcacgttattttaaagtatacaatatattactgttgactatagtcaccttactgtgctatagaacaccaacctctccccatttccactccacactactctcccaagcttctggtaaccactattctactctctacttctatgagatgaacgtctttaaattccacataaaagtgagatcatgcagtgtttgcccttctgtgattagcttatttcacttaacattaacattttctaggttgatccattttcttgcaaatgacggaagcttttttttttattattggaatcaaagcttagtgatttcttcacctacttgttagcgtatcatctcttcccccatctcaatctcaaaagtcacttctatattccactggactttgactgtttcatttatttcccttagctctttaaaaatgcatgaaatttcctttgggccatgtgaagtgagactacaaagtctttttttttttttttttttttttgtccaaacagcaaaaacaaacaagtaaacaaacaaacaaaaaaaaccttttataccatttactgggtgattgaacatgtcctgaactacttggggtacttcatcatataataacttcatcagatctttatagtatctattatcaattacagacactatttgttttaaataacacgcagaagaacttaagaatttccatcttcattttgaatacaatcacattaaaagatgtcaaattcttagggaggttttgttgttaattctgttgggctttctaggtataaattatgtctttataaaataagagctaccttgtctcctctatatcaaattatactttttagttttggttttacatctattaccaggttatggatctaccttttactattagttttctaagaaagtaagtgtatctatgtgtgatgtgtgtgaacatggtttagcttcactctggcctctccattgttgagaactctgttaagtgagaggcagtcaagtgtcatattagcaacacaaaaacttccctttagggcagcacagaacaaaccacagccactaaccacatataagtatttaaatttaaattaataaaaattaagtaaaattaaacattcggttcttcagttacactcatcgcatttcaggtactcagtggccatatgtggctgagggctctcacactaaatggcacagatggagaacatttctctcatcacagaaaggtctgggcagcattggtctagatgtctctaagagccacagaaaaacggccaggaattccattcccctgtccttttcttcttaggcacattatatttcagtctagtcttactctgttagagaaggttattcagaattttaaatcccaaaatatgttttttctggcacgtattttcctaagccctgtattttcgtagacatctggctggactctccttctttcttatcccaatgcactattcttggaaatcatatgccttcccttggctacaacaagtatcaaaatactaacaagtctcaaatgcgcacatcaactctcagtcttttccttgagttgttgcattgtattttccctctgcctattgcacatttacacgagttaacctcagctatctcacagtcacctgaaaacccaaatcttcactaatcctctttttttctctctctctacatcaattaatgtatttatttaacgttttatttagctagcatattccagagaaggttgtaacccctcgtcctttttacacaccagggctacaggctcagggcatcctcaagactgggatcaggaggaagcatgggagggatctaaagtgatttgtaaactcggatactgacaagaaaccagattcaagactgcacagcaaagactggccagaaagagagactggatgaggtggctaagaatcctctcttttctgttctaagctcatagaaatagtaaaacctaaataaataaggaggtacccaagatggtgaaaggccccccaacactgcagccacaataggacaatcttcagatgtgggtccaactctgttccagttactcctggctagacacactcaggacaagaacaccactgtggggacctggagccacttaggggctgctaaagagatcaagctaataagaaaaagggatgctccatgttctcacccacaggtgggaattgaacaatgagaacacttggacacaggaaggggaacatcacacaccagggcctgtcatggggtggggggagggggggagggatagcattaggagatatacctaatgtgaatgacgagttaatgggtgcagcacaccaacatggcgcatgtatacatatgtaactaacctgcacgttgtgcacatgtaccctagaacttaaagtataataaaaaaaaaagaaagaaagaaaaacggatggtcccatagccaagctatgccaggccaatggactaacagagaagctaccatgaaatattctgggccagggaaaagactgaaatactcagtctctgggtcttcacctcaagcatattccgaacacattttaaaaagcacctgacccaccatatactaaattgttgtatgctattaattactaaattattccactgtgtttaatgaatccagacattaccaataatgtgtgtctgtgtgtgtgtgtaagtaaaatgtataacttaagcaaacaagtacatttcatgccataaaattaaattctcacttaaattatccagactactgctttgtctcatagaatgggtggttggcaagttattccaggcaggtaatacttgtttttatcatcagttcatctctagttttttaaaaaacaggacatcctggtatgttctaaaatgttatgtataacgaaatttggcagaatttaatcatctcttcatttgaagttaattcttataattcaatttgtttttttcttgaggacaaatttcctacactgattacatatcctttccttgttccttgtattttcctcattcacatcatttttcattcacattgcctcttttcagttctttctgtcttttggtcttcagttcttttattcaaagcataagagttgccaccctctttgtcttcctgtttgtctatgtatttacttcaaaataaatagatataaaaatatagagaataactgcagttttccaagtaaatattggcatgcatgtttactgtatttaaacttatcataataagcatttacaaaaaatgttaaatttatagcagtggtaattttaggataaaccactatgtatggtgaaaattagaaattcattcataatttctgcattagctttttccaaaacaaatattttacaacttatttttaatttgctaaaattttcaataacttaaactttctgagaatatctgattgcattttatatagatacaaattctctattgtgtactcagttttatttttccctcttttttttattagtaaagacattaacaataaaataggctcacttgctccagctggtaatttctcatactagtaatatattattcctctttttgtgacatcataatcatctatacagaagtaccatgtatctttgtgtagaagctactgtttccattaaatttaattacctccccctgtggttttaaatagaagtggcttcaaaatgagggcagcttctattaaatttaattactttctcctgctgcttgcatggtaaaaggaaggttactaaatgagagcagcttctaaactaaagtatatggtaactgtgtgctagcaataacaaaattgtatctaaactacctttctaggaagctcttaggtttatcctttctctcattttaatctctttagccttaacatccttgaaaaatgagcattaagatagaagaaggcgtattttaaaaacatattttaattttataggctaaataaatataaatacactttctttacaaagatattggaaattatgctactcaaatattcaagctcagaacttttaagactactaacatttgttgttttctcactctgtggatgatgagttttatttcccacaaattttcaatgtctaataaaaagcctttcttgattctgatcaaatagatttgaaaaatgcttcactaaaagttatttaaaaggcatcaaatttggggcaatttcatataaatattcagaattactgatgttaagaaatgaaaaaagaaaaaaagtcaggctcattatagaccactatagttgaaaggaagttaattatatgctttgtaatagtgtaaaaatgtaaatcactaaaaatactataatataatataatcctataaaatgttatagaagatgaaaatgtaagtacctctctttaaattaaatattaattaggaggaaatactactcaattaaagcaccattgtacaatgtttatttctttatatacaggcagaatttagatgaacaatattttcattcaatcacacagtttagtataagtataaaacaagacaccccttaagcattttaagtaacaaattaaacatttacattttttactgtgcactgaggcttaacatttatgcagcttcaaaaccaaagtacagcctcaagggaagtctctccactgacaaattaataccttagagaacagagctgaatggtggcaatgaactcatttgttccccaaataatgaagaatgactttttctttaccacatctgtgactgttgctatggtgacccagacttacctcattgcttctcggagagctcctcgctcaccaagagtcgtgtgcttgatgtcatcaaaattattctccagcttctcacaattctgcaacatatttaaaaattgcattaattctctaagatcctgagaaaaattgtatctatgcagttatgcaaaaatgtaattgattatattgatcatggactcatgaaaaatatgcataccactttaattgggtagcattcattaaaattgacagttaaatccaacagtaacaaaataaaaacattttatgatacagctgtcacagaagtctcattatcaatttttcaaagtggagtttcgttatcaatttttcaaagtggataaacagaagaaatgaatttataaaagtaggaaaacttcttaagtttggaggaataaaaattagttctctaaaataatcttaagtatagaaaatccaatttaaactcaaaagagaaaaccattaagtttttgatcaccataaacagtatacaataaataccaagttctaaataagctagcattgactaagatgaagggatagagcacagatataataataaaagtttcaaaatttttgaatcaaaattttataatcagatctttaaataacaattttatgtgtaatatttacaactgcacatatatatttatatacttgaaactaaagttaaaatcttaaaattaggtgaaaattagattagatcaggttcttagaagaattttaagattgagtaaatatgacataagcagtttaaatttcataagtgtttctactttttggtaaaatagcaatactagactgaattttctaaaagtactttaaaaaatttttactacaattctaaatataattatacgtacttaaaactcacttaatctgagagaacccgaataggttttgagggcataaattgtagaaattttcaatttatatacatatatatatgaatcttttggcaccctagatttcttatggaatttactagtatttagttgataaaataactagatttagtgtattacttatttttacagaaagaaaaactaaatgacaaaattttagtattaatatgttctttctattcttgaataagtatcctgaattttacaaaattacagaaattatattaataatgtccaatgtataagaatgaattgatttgaaatatattggtatataaaccactatttttaaccttgatattttttaaaactaagtcaaattaaggcaaagatccttttaacaaacacacacagttatatgttgttataattaaaatctttgaaattaccaaaatgaatctacaataattaaaattatatatttttcaaaaagtccattttgggtatatacattaaaagtatcctcttctgtcttatcttcccacatttttagaagtgtctttcaataaagagaactgcttagctgagatcaaatttgttagttttctaatttaagtacagtgtttttgtgtgctgtttaagaaatttaaaaactttctcaaagttataaatgttgttgattgagaccattaagaaaaaatacacataattttttgtttgtttctttttggccctgaaattcctcatcagcttcctcctctttgccaatcctactgcaatcttttttttatttcttttttttttaattatactttaagttctagggtacaggaacgtgcagttttgttacataggtatatatgtgccatgttggcttgctgcacccgtcagctcgtcatttacattaggtatttctcctaatgccatccctccctcagccccccacccccagacaggctccagtgtgggatgttccccaccctgtgtccatgtgttctcattggtcaattctcacctatgagtgagaacatgctgtgttcggttttctctccttgtgatagtttgctgagaatgatggtttccagctttatccatgtcccttcaaaggacatgaattcatccttttttatggctgcaaagtattccatggtgtatatgggccacattttcttaatccagtttatcattgatggacatttgggctggttccaagtctttgccattgtgaatagtgcctcaataaacatatgtgtgtatcctactgcaatttttaactttacttgggcctccaccactgtagaggaacaagttcataaaagaattaaagaaataacaaaattattggacataaattttttaaggtccattcctagcataaacagcagggttggaagattacttgactatctagtttttctagccacagagacaggagataaacacattcttggattaaaataagagacagaagcctgggcagagtggctcatgcctgtaatcccagcactttgggaggccgaggtgggcggatcatgaggtcaagagatggagaccatcctggccaacatggtgaactctgtctctactaaaaatacaaaaattagctgggcatggtgggtgcacctgtagtcccagctactcaggaggctgaggcaggagaattccttgaacctgggaggtggaggctgcagtgagctgagttcgcgccacggcactccagccggggacagagtgagactccatctcaaaaaaaaaaaaaaagagagagagagaaagtggacacgtggacactgagagactgtagtagccacactgagtagccacactgagcgctcagtgatgccaggaattgaagacagccaaatttctgatttagctgaaataccgtgtttcagagtaccttcactataatgagtagaagcggcaaccttaataataattttatcaggaagtggttaaaatggcatattctgccttgatgtggaatgggaaacccaaaatgagtattaggctaactaacagaagaacaaatgctccatgttttacactttgtgtctgcatgaagtttattatacccaacagaacaacaaaggaaataagtaagcactgtagcatttaaacagttaactattaccttgactaaaaatacttctgtatacagaaattgaaatcaaatctattttttatgcttcaagaaccatatgtagaagcactaagtaacagacacatgatttgaattatatttcagacaatattaggctcttgccatatagaataagtatttcaagcaactaacatctttatctgctcaaacttctcataaataaaagtaagcattaaatatccactgagtaaagggcaaacagattcactgtcacgtttaccaccaataacacttctctaacattaaagacaactgcaggtaaaattgagccagcggcctccaatcaaaatctgttctcagcccactttatatgaacatggatctgagaaaaactgtaaattatttgtaatcaacaagttattcattcttggggattctgtaagttagtataggactgtcccagaatacgatttcagtggtaagtatcacataggggacttactttacaggataggaaagttcataaaaattcaaaaaaattatccatggtagtggcttgtgatttccaccctccaagtgcctcctaatttcctttgaccaatataatggcatgagaaacctacaaccatcacagcagaagaaaggaaaaggcaacagataaaaagagaaaaggggacagagagaatgaatgaacaaactactcctgagaacagcaagcagaagaacaaaaataatcagtgattagtaataaaatactggaacaaaacgcaggcctgctagcctagacaatgtggagcaagaaagtgggaatacacaggaaaaatggaaggtcacaaaggtactaaatttaatgccgaccagacatgccatgtaatataacaggcacaggttagctctaattaattggtagaaaactgaaaattcggaacaatttgtatcagcaaccatggtacacattatagctttaatatataatgtattgtgtgtgtgtgtgtgtgtgtgtgtgtgtgtgtgtgtgtgtgtattaattatagtaaaccagttaacattgagtagtgactctgggttaggtactttttctaggaagtctaaccatttaatctgcatgacaaccatatgtattcctattttacaaatgaggaaacaaccacaggggagattaagataaagcttgcccagggttatacagctagcaagggataaagcagggatttgaacccaagcagtctagcctcagagccagactcaaactcctcgcgagtccgcttctaaagagtaaactgcataagtgaatataataaagttctgaataggccttcctctaggtgtcatcaaatttaaatactgagctggatggaaaatagtttactagcagagtcaaatgtagcagaagctcttgcaggattctgtctacatctgtctggaagtgctatactttataatgtagaaaaatatggaatccaatatacacatttaggccaaattaatacccataaatattttgcatgcaacagtctttatttgggtctgtgacaccaccgtgacaaatataatgagcaattaaattcccaagtgttcagattttggcagcaattgaagtagaaactggaaactaagcatcaaaaagaactggttttggtggcctcctgccaaatgaatccccatgggttgagggaaggtctagagtttcaactgtgatagatttcatagtgttttatatctcatctgtgttaaggattctataaaagtataatgaaacaagtagaacaccaacagtcacatgaaagaaaataatatacaaggagatttcagaacgctgaggattttaaataaaattcactgagttatctttgctcaaattataccaaaaaaaatcacaaaattcaaccaaacacctactgattctggatggaggtggaaagaggcaaagaaaaaaaaaaaaaaaagaacagctagcaaattacattattaaataaaacaaatcactgataattccacaggactttatttccatgggactgaatttttatgttataattatgataactaaaactaaatcagatctaaaatttatatacaaacctaaattgaataaattaggaaaccaattttaacaaatgaaaagtcacaaagagttaatggcatagctactggagtttaagtctcagaattactaagtaacaaaggctcgagttaatgaattaaatttcagtgcagaaaaaaaaatcttgaaaatctattacatgtcaggaataatactatgcacagggatatgaaggtaaataagacaagacttcaacttgctcacatgtagtaagaatacagaggagagaaaggaaataattctcttggaacaagagatgactatgagtttgttacttccaaacctgtctttgaaatgatttacaattttccagattaagagaaaaaaagggggaaggctaaggtaataaaattggctctagcctcagaccttaccattactgtctacaggctaagtccttaggcaagttaattaactcagtttcctcatcgtgaaatatacttaccttctagagctatcaacaagattaaatgaggtaatatatgtaaatccattagtacattcagcaacgacgttttcaataaaggtggaaaaagaggaaagaataaacagaagaagagtatccatgaaccccaactcaatcctaatggatcagattttatatggtgaaatagaaaaaaatgtgcatttttcatgtttaaccaggtgatttttatgaataataaagtaaaagaaagtctttatggatttttttaaactttttggtcataagactcctatgagagtataatgaaaaccatgatccttttccttaaaaaattacattttcacaaaagtacatatgcacaagtacacaatatgctatgctatatacaatttcagtgggccaatacagctcctgaagcccatctatggcccaacgtctatgtgcaacaaattttagtatcagggaggatgatttcacaatggacctagacagcttagaaacggaagttacaaatataatcagtagtccaagaaccttgtgaaacaaggggtccaaaagttggcaaatttctattgctgtttgacaataaagcatcttaagttcaaacatcaaatttctaatttaaaaaaagacacaaaagtcaatcctgttgccaagctagaaatgaaaaccagtcattcattcattcattcaatatttatttagaacataatgggtgctagatagtatgctaatcattgagacaccaaggtttaaaaccttttttttaactccttattttgaaaaaaaaaagccaattcaatagggtaactgttataaggtaaataggcctcacatccattgccatgtattagtgatatatcagcaataattacaaatctcagctggttgaaaacctgcaggatactaaattttgaaggaacctcagagaattatcacaagggaaaccaccactcttatgaaggcaatgataaatttcatattttaaaatatgaggaatatttaaataaaatggcacactccaacatgtactgctacaattctaaggcagttcaatgttggttactacaaagcttttctttaggacataaagtaaattgggaaaaggtaatacaagtacatgcatttctcatgtagttagaatttcctaaggtctaggttcctctaaaaaaaaaaaaatgagtcaattaggtgaacttactctttctggaaaatgttgtatcttaatttttgcactcaacaagaagtctcaaaactagccctgctgaagttctttataagtacaagtaagaaataattactatattcatatttttttaattctagatgaacattctactgtcaatatatgatttccagttctaatcaagagattcatatttcaatagataattgcttttccctttggtgtgtcttaactagtctaatcctttcagggaacattaagaggtaatcatatttagctaatgtcatttcactaattgtggccagcttacaatcaggccctgtctaggagaatcttatatgagtcacagtgaaatacaatataatgcagtaggagaggtaggagctatgcagagagaaaatttgtttttgagtttcatctctacaactaaacagcttatgtgttcttacaaaaatgcttaacatctcaatctgcaaatagtccttcataaaatgaaggtatcaatgaagatgatgaaagtaatattatccactcaaagtgttattgtaaagattaaagtaaataaaaacatgtatgtgaaaatatatacattgttcaaacattattacatatttttaaaagatagaatgaatctcatttctgccttcatagtctgaaagtatgttaattttatttgaaatattttaagatttcatctctcatacacagtaagaattaagtaatattttagtacttttttgagataaattaaaagtttagctacagtatcctacctgctgataattcattcctatatctatgagaggtcaacaaagttcaggataaagtatttgctttttaatcataatttcatatttaaaattacaatgcgtttgtttgcataatgtatggttatattttgattgagtctcatatggtttacatgataatcaaatgaaacacagtatcattatttcaatatatattgtggagttctatgtcccatgtactgccaaccacaaactattatacaaatattgatatttactattttggaagccattataatttacttactcacttaatcttgacaagagggaaggctctccaagagcaatttaaaaatgaaaatctactatttcaaccagggaagcctgctcacctttaagctctgaacaatctgacccatctccactaaattaattaccaccacagggaaaccacagctacacaactgctctctaggatattatccctataaggataaaaaatttgatgtaatctagaggctttaaacttaaaacaatcccttgtccttgatggagtttttgctgaagcatctggcaatccctgctagactaagtggtgtctaagcaaatgaggaaaactttggtatcagggatggggtgcgggtggcaaagtcaaataaatccactgttactacttgaacatcagtggtgttcctctgtctcaattttggatggttaattttttcatctatgtttataggactatcactcacttaagaatgttaaatgtctcatttactcaatccagtgattttgttcatgcatttattagtaacacagaaaacacgttattcttagtctttggaaatcaagttttaatgtatgcttaatctagttaaaatatagaaaagtctatttagatggtatggctgtgtaatgcagtgcatgatgtactgtaataacaccacccagtgtgtgtaagattaaagttagacaccaggtaaactcacagatgtaaacagtcttttctctagaacatacttagaaggatcacttattttaaaaatacgttgtttaaaaaacaattaacatatgaatatgtattaccttaagctacctcaattctctgattggaaaaaaaaaccttgagatcacaatggagtgggtcagttcaaacagaaacaaggaatttactagattagggctctaaaaattaacaatctttggtgtatcatgaattttaaatgtacattacaaagaaaaatatgcaagccaatttaacataagtctcaataaatagtgcctaaattgataaactgatttttgtttacaaagaaaaaatatgcctaagatttccatatactgtacacagttatggaatggttggtactagatagatatcaaataaaaaacctaaaatagtattcatgatcatttatctttaaaagcacatgtgtgcattttaatacatgaggaaagattaatagaaccatttaagtttttgtgttaagttaaaattcagagaagcaatcatttttaagtcacaaaagataaagccttccaatatccttctggttttggaggaataaaggcttttacttgacagttacttacatgaatttgtatcaaaaagagaatttggcagagacttctaaattcataacaattgtctattagtctgtttttaataatttttctttggcatgtaatcctctttaattagattccactctctgttgtttcaagactccataaacgggtgtcttatgtaccagctgctaaagcaggagttactgtctaaatgatattcacaatgagtatttagaaggtttacaattatacccttgctaataaattgtgctattttccccaacaattttaagtgctaatcttcagaaggcattttaaaattagctaaaattctgtcaagagatttacaaaaattgttagcatgaagataattatgtcacagtccttggactccatctctgattgtgtgcataaatcagaaaatgtcagctgtgttttcccttaataattatccttgcagcaatatattatagtctaaactcctattataatttctgtttctggtttctaaaacaccagacagttatttcaaaagtttggaaccgaataaataattcatatttcccagaataataagtgattatcaattctaaaattgtaagtattagcaataaatagatcaatatggaaaagataaactctgttttcataaactctccatcctgaaaaaccaaatgcttgaatgtgataatgactttttaaaaatattaattaggtaaaaatctaacatagcagatagtaggcaaatagaagcagggatctgaatagaattctaaggcacccactattttttattccaacagcacagacacttgaaacacagatgtctgaaatacatatcaagttgcttatcatctgatactatccaattttctatatttcttattaagtatataaaattttgaccctcattttagaagatacaaaataaaaaagaattttttgactttcatccaaatatcaaaaattataagtatgcttttattttctctggttaaacagattagaccagaaatataatttttatgcaagctcagtaatcatgttaaaaacaagtctcagacagcagtctttataataaattagctaagcattttgtttagtatgtttctaatactatcaagcatttcagaattcacaaagataaaaaaatccagttctctaaatactttaatgctgtagcatatcaaactcaggtttattatataaaccatataaatccagatataatagcaacggtatgtggctcagagttgtgggtattcaaagacaagtgaaaaacagaatatattttcctagaacattaggttcacggaaactattttggaaaaaggttttaaaattttgctcatcaactgtaatcaacagagtcagatttttcaagttactcaatattgtgttctttccaattgtgtgtttcctcggagtagaaacagtcatgtaacttaaaaataaaagaacttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccaggtacttgggaggctgaggcaggagaatggcgtgaacccgggaggcggagcttgcagtgagccgagattgcgccactgcagtccgcagtccggcctgggcgacagagcgagactccgtctcaaaaaaaaaaataaataaaaaaataaaagaacttgagtattactactgaagttaacataaacttttcaatcacatcaaatgaacagggccaatgctagaacaacagggactataggaactagaatccgtgatttccgcagatcctcatgaatcaattttctgaaaaataagtttatagccttaaatcagacttccttacaccttggttaaaccaaccagcaaacaaaactttctcctacaaaatacatccacttctttccaaaaccacttcctttaaaaaacgttttagtaacaaacatactattaaccttccttcctttcacagtatactccccaatatataaagcatgttgaaaattacgcatattgtaaatggtttaattttttaacttcaaatcttaatatattcaattacaaaagtaatatatgcccttttataagaactgaatacaaagttatgtaacaataattttctgtctccaacctaacatctaattctactccagtgagctagattactacctttctatagttttccatgctcacacaacacgttttatgttgcagctttttgtgtggggtatgtgtgtgtacttcttgtttctcagtggggtctacttacttaaaaacatcagtcagcaattctttgtgtgtgtgtgtgtgtgtaccacaaacaggtggatctaccaccaggtcaataaatatgactataaaattccaaaaacttctcaatattacatattttacttaacaattttcttaatgatggaatcatagttttatttccctagaattttgctgttaggaataatgctataatatatccttgtacatgtgtgatggtgacttctcttactaggggataaattatggtgaaaatgacaggatctttttttaaccattttgatatacattactagacaattcaccacaagtttgtagtaattcacaatccactagcaatgtatgaaagagcttagttgcctgaaactttgccagtgctagacattattaatctcctacatatgccagttggagactgaaaagcattttataattccctggatactaatgaggtggagcatcttttcatgtgtttatcggctatttacattttatttttagatattgcctattcatatcctttgccatttttgtcatttatgtcataaatatattctcaataattttcccttcacttgtgtagagtaactttggccacacaatagtttgttgtttctctttaaaggatattaagaataaccaaaaaatgacataatgtttgagataaagctatagtggatttttagaggaaaatgtatagcatcaaaatataaatcaggagacaacaataaagtattgaaaattataaagtgtttttttaaatgcacgacaaaaaaaaacccagaacaccctctcccttaatcaacgaaataggagtaattttttaagcccagtgctgtaatattttggttgaatctgctttgggccaaagtgaagcatccaagcggaaaatggggttgttattcatctaagtctaaaccataaaatgtaatacatagaaataatttctgaataactggttgaaaatggaggttaactagatactgtatttttctgggattaaaggatgaatatcaacaatattccttattctttgccacattcaccatttcatcccattattttttatgatgtcttcatttcccaaatatttaaaattaaaatatgtgaagaaaacatcagtagggtaagttttttgtcttatttctttttaattattaaaaaatatgacattaattggaaaaatgaatggagttatgtgcacaaatgatgtgaaatccatgaaaggcagaagcatgaggggatttcactgcatctaggcctggccactttccaaattcaaggaacaacagcctcactctcaaattatactttgtctccaagagtttattttttctcaataggtttatttcagtgataaaacagttgaattatatacatacgaagtttccaaaattataacttttagtccattttaatcaaatgggcatgaatgtggacagtttgctcttctgaccttcactggaagaaagtgtaggtgtaagaatttttctccatgaagaaaaaatgatgctgtatcagaggttaaaaactacaagtaaaacaacttaagttaattgttcaccctaacacagacatttgcacatttggcccattaaagtattcttacaactttgggcatgattcattttttaaaaaatgtaaagaaacagtatatttatggtacatgaccaaaatgctgcaatgaaaatgaaatttgaaaattgaatgaagagagttgattatgtagattgcaaggctcagataatttacatgtgatgaaaattacagtatcagttttaaaattaatggcattatcactcatcattattccctgaactgatccttttatgagattatcacagagacaagagaagattgaccaaaagattagtgaccctttcatctcatcataatccacaagtggcttaacttgtcatcaaaaaatatacttatcaaaatttctatcaacacagcctggaaatattgcactgtactgcttctttgacttaattctgagtatctcttactagtgattatgttgatgtattttacaagcagtgaaaaaggaaactgatggcatctctccccacatgactgtatgcaatcttcaatgctatgacagctcaagaatgataatcgcctcattgctgaaatgaatatctgacataagtatttaatttaaaccagtttcctgaacctgacaggatcatagaaacagtatcccaccaatttacctaaagggagtagcaggggaaaaaaaaaatgtttgttcccagatatggaaaattcatatatcattttaatgtcaaaatgagcaaatcttataggaatctaacatactcaacattatgcttattttttgtttgtttttattattaattttattaaaatagaatgcaatctctaggagacaagaaattttcctgtatttcattcactactgtatctgaagggcttaaacagagtctgacccattctagaagttcaaggaataaataaaaaatatattatatgtagaataaaaatttgcattattattaaaattaaataaagacttcatagatattgccttttgtgggctaagggcctggatcttctctagtagtcagaggcttctttttttactattagtggaatttcactggaaaatttgatatgtagtcccttgttgataaaattcttaaaaactgacttgctacacagggaaagatgttaagcatattttaattttatttttaatcaactttggcgatatataaagtaacatttttatcaaacatattaaatatttcaacttgaactgaatagctatattgttatccttgttagaataattaaatattggctacaatcatcaatagaataacaagtataataaaattaaattgtcagtgcatatgttaattgcagagaggaaaatattctagagcttaattttcaaatggtctttcaaaggaagatcatactaggtggcattcaagttgattttctctctcactaatatatatttatttctatcagaagacattttaatacaattgagtaatccaaatatttcaatgctttctacaattcatacaggaacttatgttgcataatgattctactaaatgcaactattaataccttttactcttctactgatttcattaattattataactaacatcacgattattattttaaacagcttaaatgttgactagttctacaaagttatcagccctctattcactgacacattgctgaaatcattaaactggaaggggctttaagaatgcaataaacgtttgttaaggtgaattgacactagtgcctatttataaagttatgaagagaaaatctatattgtttaaaagatctctaaaaaacaaaattcataacctctcaaggatttaaaatcttcatcttagtacattttttagttctcatctaaagcacttatacttcccatcctcttgttctgcacttggtggagatgttcaataaatatttgttaaatcccatcttcttgttctgtactcactggagatggaaaacagctagtcttctttctcttataagaacccttcatccttaaagactgttattaactccccactcttctagtctcaagcctgaacaatccaatcttttagccttccttcatcatcctgacttctcttaagtctcaatttatacagacgcctatctcagaaaacctactcagggtctcaatttcccttcttattaattgagcttaaaattggaaaagttacccaatgcatttaaccaatttttaccataatcaacaaaatattgctttacagcttctcactatagcaataactcacccctacacctatctatatgttcttttgaatataaataacacttcaactcactagaacattcagatttagtagaagaggctattttacctcatagcaaataatatgtttctcttcagtataggcaacaggattttatcttaacttcccttagcataatctgattgtctggcccaaagccatcatctatggagccttctgaacaatccccagtggacattacaatattgactgtgtgagaaattttattttcctagacaagttagaaatgtgaacttggttttctttaacacttatttatagcattcaatcagactgaccttgtttgatggaatacctaaaggatactcatgtttctttccataagaagtcaaatgttcattaatttagtaagcaatactctaaacactccataattattttcatatgtacagcatttgtatgaatttgatctgtatgaatttcctagaaaaaaatttacaatacttttagagtttattctaaatatttattctaaatattctaggcatctgccctcataagcttacattttaatgaataggggagagatgatacaaatatatacttaaaatatctttttaaaatatgaaaaaatatacatacttcaaatgtttacatttaacactatgtgataacctcagatactatcagagtttatcagatagtgttaaacactacagggaaagaaaggagaataaagtgatagggaaataaagatctattacaaacagaatggtcagggaagacattttcaagatcttaacaaagggaaaggaactgcaaagaccctaaaagagagtcagtatgcctaaaatatgataataaggtacataatggtagaaggaaaaataggagacaggtttcagatcacagagaatcttgccaaaccatggtgatactgcaatataataaaaaatacatattttggttttcatccctgttttctggcacacagctcctataagctttgtaatctcagaagtcgtaagtgtctttttgtatgctgatgagatgactgatgcctggaggctcctgtacagcttcagaatgggggctggttgccagtcaatcaaccgtgtgattacagagttggaacttttagccccatcccctatcctaggagaagggagaggggctgaagtttgagttaaaaatgaccaataatttgatcaatcatgcctacataatgtaacccttataaaaacaaaagaaaggggctcacagagctttgggtcagtgaacatgtggaggtgctggtgataacagcggtggtctatctggagtggctgctgtgaagacaccagctgcagctggggaggtatggctggaggaagcatggccagcgctacaccctccatagggccagcaggagccaggtacaggtgggagccccacacacttctgagttggcagggtgggagccttgccctcttgggtgcggctgcagccacccagctgtggctccagacctgggcaaccctgccttctcaggggcctgggaaaccccccactgcccctgcagtctcagaagtgcctgctcccactacctggtctctccccacccaggcacctgctctgattttggagcaaagttgtgcctgagcccaggtgctgtcgcaacctggctgggtgtgcacacatttgcagcagtgctgacaggccagctgtctctcaccttgtgcccctctggactttgggtaccgatgaacaacagtggaaagcagggggtgctgaggggtgctcagcatgggcctgcaggcactcttggcacaaatagcctgggcactgtagattacctgatcaatggcagcaatacgcagacagcctcaagcatggaaaggggcgggtccccagtgaagccccaccttcaagccagggacttcctgaagcatgagggctggactgtcagttccaggtggagtccctggagttagaacttacagtgctttttctggacctgcccacagccacctatagaccaatcagcacacacttactcccttctgaagcccatacaaactctggactcagccagactcagagacatcaggacaaccagctgtggaaaggagctacccaatttgggtcttcaccactagttgggacgacctgcctacagaaagaagctacccactccaggtctcctttctgctgagagctggacactcattaggacgacctgcctgtggaaagctgctaaccactatgggtctctcgagtactgttctgtcacacagtgaagctcctttctaccttgctctccctccagtagcctgcgtacctcattcttcctggacatgggacaagaactcaggacccaccaaatggtgggaatgaaagagcagtaacaaaaatagggctgaaacagaatcctcctactgctcgccaggttgtgggagacatgaaggagaggagagctgtggcccttcagggaggccagacctaggggttacctgatccagggctgtcacatcctctttggggctctgtggctcctgacatttccaagcttccgggcaccatcacattcccctcatccacgtgtgggtgcatacagcagatgccgcatgtggtacatctgatccagctgcagcctcacatggagccgggacctgtaccagtgcctggagctgcccaccctgctgcagcagcaagcatccctggctgtgtgcaatgggtggaccccacactcactcactcacacacctcttgccactctgcaactggcttgccctgggcaggtatgggatccagactggtggtgcgagccgagaacagcctgctgggccgagtgggcagaatgagcccaggtggcatgggcaatactcaggcagaaggcgttgttgaacacagaggtttccggctggtgaagtgacacctcaaggatcacgtgacactgggatggtggcacaaccaagacaggacatggaagctccgtgtcttttttccccataccttgctctatgcatctcctccaattggttgttcctatgttgcattcctttatttaaaaaaaactgggaatctaataaataaactgttttcctgagttctctgagccattccagcaaatgattgaacctaaggagggtgctcttgcaacatctgatttatagatagttgttcagagacacaagagacagcctggacttgtgtttggcatctgactcgggggaagtcttgtgggactgagcccataacccccaggatgtgatgctacatccaggtagatcgtgtcagaattaagttgcagaacacctagttggtgtcctcagagaactggagaattacttggggtgggaaaaccccacacatctggtattagaagtgaagtactgagattggtatgaatataaagaagaaacaatatttgtttattttgttcaacaatgataatgtttgcatttattcaaattacagtatgaagtctttacagggaaatagttatgtagcatcattgtcttaaaatcataggaaaacaatcacatcatactttctattttttaatgactattatttgttcacctatgtttaacttctcaaaatgtacaactaataaaacattagttcatcgtatgttttcataacagaaatattcagtaagaagtacagattttcaaaaaaacagcacttttcagttgtgaaattcaaaaccataaagtggagggagggatggctgccccaggtatcatttttagctattcaccttcaaatcccacttacactttggaacttttacctaagaatcagtcatttatttccaacggattgccatgaatttagaactggactatgtgaatttagaactggactatgtgaatttagaactggacatggagttttatatttttcctcaaaataactgtctttcttcccaggaaccacaaaataaatttggaatacagtgactgctaaagaataagaatataatctctacaaaaacacgtcaaataattactcaaacaaaaactctctccatttacataatttcttaaatagaaggaatatgtaacatacaaactgaaaataaatgaaaaataaaagtgttacaaacttaagcaaatggtattatgtcttcaacatacctatgaagcttaataaaaatatttaaaatcattctttgaaaaaggattcctagtgccaaaaaataaaaagtagaacacatttcaaacacaggcatattctaacaaaataacagaaggtattgtcaggcagggaataaaggcatgctaattttatctgcttaaatgaagggactcaatggagcctgactctatttattgactctgatacttattgacaattataaaaaacaattcaattatgtttaaaatttaatattaagtacttacagaattaaaatatagtgtatgacattaatcaggagaaaaacttaaaatttcagcaaaaacaacaaaagaaagaaatactatatacattgtaggggtgggctgcgagctaatacagcatttgaatgcaagtccaaatatgtaaattaaaaataaggttaaacttttctattaaaggaaaagattctcagaatcaaaaataaccaaataaagcttactctgtcatacacaagctatatctctatatcaaatgccagaatttaaaaataaaaggatgggctatgtgaatgcaaagcacatgattgttttatattcataaatggtgaaacccacaaagaacatacaataataggaaactaaggtgaaaatatagcatttaaaatattaaaatattcaatgttaatgaaaattgttatacccctctaacgaacaagagaaaatatcacttctttttttttgagacggagtctcgctctatcacccaggctggagtgcagtggcgtgatcttggctcactgcaagctccgcctcccgggttcatgccattctcctgcctcagcctccctagtacctccaactataggcgcctgccaccacggccggctaactttttgtatttttagtagagacggggtttcaccgtgttagccaggatggtctcaatctcctgacctcgtgatccacccacctcggcttccaaaagtgctgggattgcaggctgcacaaataccacttctatttaaaaacatttaagaaacttttagtgactattttccaaaaatgtcatattgagtgaagtgaagtaaattcagttcatcttttaagaggatgtgaaagtgttactttagagtattcaggaagttggactgtgaaatgcaattatattttatgttattagggcaacagatgtattagttttcttttatgcgtatctagcatgaaaatatcaagcacaattattatatacaataatgcttaatttgatatgaatcagtgctattgcatcacacttataaaggaaagattatgttgtataattaagtataagcagaatctccctctgcatggcaccattaaccagcatcttgagtattacacttgttttagagaagctcaaataaagaacaaaggttttcagaggaaaacaatgaagaaaggtttcgggatttttttctgtgtattataaggagattaggagtcatatgtctccaaacatttgaaattggatcaatttaagcttgtctgagttgtaagtaatgactgaaatctaaatattagaaagaaaatctgtatatatcctaaggaaatactcttaaatacgtgaaatgatagtgattacaattacaccaattgaggcattggttatgatagcaaaaaacaaaacaaacaaaaaaagccctgtataaaaatttaatgattagctctagagcattagataaccaaattaccatattattgtgatactgaagtcacttaaataatgtgtagtataatacaagattatgcaaaacatttgcatattattttaaatgaacaaagttacaaactaggaatatacactacaatctcatttttaaataaaaatatagacatatagaataagattaaatgaacacacttcaaaatgttattgacttatttctaggtggtaggatttcaagtgattctatttgcttttgttctatgtatatgtatttcctgaattctgtacactaaaaatcctttagtagttaactcttactgagttcttactctatatatggcattgttctaagcaagtgctttatatgtcttaatttgtaaacacttcaacagccctgtaaaagagccatttctacattcatttttttttttttcgccagctgagaaaacggaagcccggagcttaaatgacttgcctaggtttcctgagtagaaactgacagagcctagatgtgaaccttagaagtttggcaccagaaccagcacactccaagcactccacaaataagaactgtattatctttcataattttcaaagaaccttaataataatgataaaaataaaggaagatatttgattaattttaagtttgccacacttgccattcatcacaaagatcagttctatctttatttctacaaatttacaaattttatttctacaaaattacaggaaacaatactggccaatattcctcagcagtgtttgaatagagcttttcctgaagacatgagtgtcttctaaacttttaattttgtgactttaacaaaaacaaaatatcacatgttgttgttgtcctcaggagcactaagaaatttcctgcctgagaagtaaatgactgaggggaaaaaattatagaccattatggcatgctaataatccaaattagataaacaaacacaagcaatggaaaggaagaaagagcaaatgcattcagcagagaatggtgataaaaaataatggacagctcattctccacagctaaaattgcacaagctgagctgtctaagggaaatgagtcatctgtttctcaagttataagggaatcttacagaatattttgagtttgaatagctaacaccgcaggcaattgaaataggtctccaaatatctgattaaagtcatgcatgattacagctggtatagaatatttttgtacctttcttgcaaatggtaaaatgtaggttaaatctctaattttctctgttacttaacttctaaagtaggtattaattaaagaaataaattaagatatgcttaactaaattcttagatatgaaaatgaagtatgaaactttttattagtacattattcacttttacaatgcttcttaatgaactatttggtcctttgattcaacagtccttttatctcatatgaattctttaaaacaaatggattttctggagtagaatccggttttaaatatctaaaatatcagcctcagaatgccagagtgactgaatagaaggaaaaatgagaagaagaagaatataaagggtgctgtgcaatcatgacagataaaaacacaggagatcacagtaaaaataaaactaccaatagtgtcatctatagaattcggtcacctattttttccaacttaatttgatcgagcaaattgcctacaaaaaaaccatccagcaaggtgatttttgtacttcattgcttataactataactccaccatctgttctataaatgatatattaaaaatcaaatcaatggtgatttttaaaacacatgtcctttttaagaatatgatatattatctcccatgattccttaccaatttgctacttcacagaaaaaaatgaattgtcctctggtttcttaaattgtctatgtaataaaacacagtaacacatactatgaaaagctgagggtaaaacagaactttaggatctttcataagttaaatatgtcataatattttgtcatttcacaaagcaatgatgctcaaggagatattatttgaagaacagatagccataatctctattaatacaaaaatatatagggaaggacattttcatttagacttttatacactatgataagtttctaacaatttataattttggaacataaattatcattgtctaattaccatatatatatatatatatgtcacttctgttgccctttatttaatactcttattcaaataagtaagtggaaagtattgcttatgatgaggtcagattaggattctccttatttttatgttagtgtaatatgtcacttcattctttattcctttcaccaactatatgtattaaatctcctagatgcacatagtgcatgtaaggtcaaggtcaaataaaggtaaaacacatgaatggcatacagcatcacggaaattcaagaaaatatagttataatttaaatatgcaggtgcattcggacctcccctatgtagtcttttcaaatctctacataatcataacattttacagaaagtttctgtcccgaagtccaaatatgatatttaaccctagtcctccaaactcagcaaataccaggccaacttttgaaatttctaccttggctaatggtgacagtagcaaagaaaaaaaaaaaaagaaactgggctctaggctctaaacaaatatatgtgaaagttttctatcaattataatgcactatacatgaggattttctgtctacatttgtctacatgtttgtgtttgtgtttaattcaggaaaaccaggactgtaaaaaagaaaatgcttaaagcttgcatctttgaaccaggcagaaagtgcagcaaaccaacatgacacatgtatacctatgtatcaaacctgcatgttgtgcacatgtaccctagagtttaaagtatagaaaaaaaaaaagacataccagagactgtgcaatttacaaaaaaaaaaaaaaagaaagaaagaaaaagaaagtgcagctacctgatgcctgaaggaaaccaaatgaaagaatgtggaaattaagccattcaagcattcaaggaccagcactaggaaatttcaagtagctattacctagatttaaaaaatcagaaatccttacattaaaaactaatcatttgaattctgttttaatttactttctattttctcttaggtgggataatcatacctgattagtgctattataacataacagtgcttattatgtgccagacctaaggagtcacatacataagagttattatttactgttattactaatattagtatatattactttcatcctcattttataaatgaggaaactgaggactagacagttgaagtaacctcctcaacatcacagagctggtagttttccaaaattcagttttcccatctttaaactgaagaataaaacataataacatggaatctattacagtaattcttattgtattaatgatgatgttatccaaattgtacaagtggagtgtagccattgagcaatgaacactgcatttttatcagtgatttccattgttaaactgctttgtataatgccaactatttttcgtcttactcaaattcaactgatctgatgctcatatagcaactttctgaatacaatttgactcccaatagattttcttcttcaaggatgatgatttctcaggttaaatcaacaacatatttataatgatgatgtgttaccccatgaagctgaaacacaggcaaaaaatgatgttcgtcacaattcaaatactcatacacattttcctcattataatttagtaagctggcacactggaagctactttagcaagacttattcagatgtatttccctcagggatacttcaccaatttattattgaaaatcaattggctgtcaatatccaaacccctttgtatcatgacatcacttctaggcagaagtctcccctgatacccagggagcccattctgagtaatggttgcacagaagggcatcctagcacttgggcatgtgtcaagttgtttctcttgttttactgtagcattctgtaggtctccctcctgcactaaacattatgagggcaggaactgtcctctatgtataaatgtctgttgcataacccagtgcttgttctatcatagtttattatatggtaatatcagtttcctgaattaacgctcaatatcaatgtactgaattaattattgatttatatttaaatcaatccttcagaaacttctatgctgttagttcagttatgcacagtcttaagcatatcttcattcaataaactctctgggtattgtcatactaagtttctgaagcaggtgaactgctctgataaaaacaattaagcttgtgttgccaaatgtgggcttacttgataaacatcagtctttatgatattgctgagcacaaccttaaggctgattttgttcctaaccaagtgtgatacatattacactacatgtggcctagagtctataactagaatattacccaaatgaagattttcagtaaatctattaaaccatatgaataaattaacagctacagtttatttaaaatttagtattttccaaaatgttttacacatcatcttcaattatcttcagactaacacttttactaggaagtagacatgaaggacatgatcagataacaagagatcatcagataatgcacagaagtcaagtgacttgtctaagattgcgtagttaacataaatagtgttctcccactttccagtattgttttgctttacaaaactatactcagacaattaaaagaaaatgttataataaaccagtccatgtggaggcaaatctgtctcatccttgcaaaaaatacttatggccaaaaaagaatctcatataagaaaaaaaatgaaaagacatttcttataggaacagaattaaaatattgctttgtctcatcttcctgtctgttgctcacacatttgactgctgattatattgttaactcttcagaataaaaaggaaataccaattcaccatttctattatccagaaaatatatacataaaaagaaaacattcatattatttaattgtttgcctttttttcttgatttttcaagcctctatgcaaataaattttggagcaaagacagagatgtgcaagattctctgataaatttagaaacacaagagatttctgcaaaggaattcatgaaaatatctgtatttgcagatttttttacagatgttgagactttaataagcagcatctttaatatcatacatcaatttccaaaagtttatttagcttactgcatattctcaatctgatactcaatagtagctaaaaataacatataatacatttatgtaatacatggttatagttcaaagagccatccactacactgggaagaagctcaggtgccccaacactcctaccatgggagcagagagagttctattcagtatcaaatgcccccagtttaagattctgaacactagcatgtagaaaggcttttgtgtcagaaaacattttatcacattcaggaagagtttaaaatcaacttagatagcacattgctgatacgtgaaaagtttgaaaattctactgaatacttctcttccttagttttgaaagctggtattagtgaagtaagttgaaactcttggttcagccttccaaaccactcccataccccctgcttatgtacattcaagaccagccaaatacaaacaaaagagggtacagggtcaggagattcttgtgcccatcatgagcagggtgagatgtccatggccacagaacgaaaagtttattaagagaaggaggagcactggccaagcctaggagatgcaaatccaacgcagtttatgcttcccaacagagaacccatgaatgctttatgggtatgacaagaccttgatcccatcagctaagcccatcacctcagcctcctgcatatctcaggggccaggtgattctattatagtctctgagtgtcaggatgtgaaggaggtgggaaagctgtgttctactgtttgcttccccttcccaacctccactgaggtctgtcctcattgccaggcacttgttcggttcagagaagaattgtatacgtgtgttctcgaaagttcatagtggtaggcaggcttctggcgacctgagatagctcagcagtggcctcgggagtcacagagaacgtgttgttggccatggtgctctgtgtcaagctggtcctggaactgctatgacaggtgacggtagtgctgccagaggccctaagcccaggcacaggtccctgcagatttctggatgcaagtagggacaaagaacagactactggagtttttgtcactttagaagaaaaaacatatttatgagatttgtctcattcaaaaaaaaatggccttaaatcaactttggtagaagacaaacttaagaacaaattattagaaattcacaaactggaaatctttaataaagcactagaaagccccaactctttacttgggcttatattaaagactctcagaaaaggaccaaaaaaaatctaaatgtttagaacaatttaggttggtagcttaaagacagaatgtttcagtttttaggagattcatcgaaacacaattcacgtagctgcaaccaaaacagccttcgaaatacatcagaacaatgaagaacaacttcagacagcattgaaagacacttcggataaaaattccaatcttcagggaaacacagagctgctttcacaagaagctgaagagtggaaaagggaagagggagcaaacatactaagcagaataaaatgctagaaaattctaaaatgtgtaggaaacaagttctaaaatatgacaagtctgatcaagcttctgtgtgaacacaagttaaaggtgagagactgggctactgttcttggagacgacgacatggatgctaagaacttggatataaaaatgcaacagaaacggagacatcttagaagatgaatcaaaattttgaagaatcttactaatggagctgagttatttagaaaatcttgattcaaaaaacatgaatgctcactaaattaactgaaagaggggaggtcatattaaaagtctgcaaactgggaaagcttcaccgcactcagaaacaaactaacaggaaaacgcacacagaaaggagaggcaaaattgctggtggaaatttcaagtccttcttgaactgaatcaaagaaatgaaatatattttcacaaaatatcctatttagactgtgtttaccccataaagatagaggagaatcttcccaagggaggtgaaaagatcagtcatgcatgtgaagagatggacacctataaaatataagcctaaaagtttttagaaaaaaaaaggtcattggcctattatcaaagccagattattttcaatgagcaaaatactcaaataacaggttgacagttctgttgtgtgagtgaaaccttaatcatgtaagaaaacaaaatgcctgcacataagacaaattattaacaatttacatgtttcaaaaaatatcctaatatccttgatattccaagtgaaacatttagcagagacttctgaggaccaccagggcacactctggctaaccagatctctgatgaaggaggagtatcaagttgtgaaggtgtgcaaatgcaaggcctcatgcgtgatatggaccggatgccacccactacccagcccaggctcaggactgcataagcagggtccttccaacagaccactccctcctgacataggaggtcctccataagcgcaaaactgagtttctcctggtatctctggcattggcagatgctgcagacctcctttgggctcaactctcccactgatgtggagtttctggttcaggttctggtgctctgaatctatcctatcattcattctgttaaacggcagctattacaaagggatccccagtagcaggtactgagaagaggatcctctccccaacctcctattctataaagatgaacctctccaagaaccctatttcccagaaacttgccttgcccagtacatcttcccctgacaacaagaagggtctcaataccagcactggattttgtcttcagaccccatagcctgaaaaatagaagtgagtcaatttcctagctatcatggagtatatgtcttaaaagacatacactgaaaatagcctaaacatagaagtgagtcaatttcctagctatcatggagtatatatcttcctccatgtttcctggcatacaactcctaaaatccttggaatctccaaagtgctttctttttgtatattaatgttgactgatagcatcaggataaggctggttaccaaaaagaccaagccatgattaaaggattggaactttgagccccatcccccaacttccaaggatgggaaaaggagctgaaggacaagctgattaccaatggccatggtttaatcagtcacgcctatgtaatgaagcctccataaaaacccaaaacgagaggattcagagagcttctacatagctgaccacatacagtttcatggagggtggtgttcccgagggcatggaagctccacaccccttcttccgtagctcaccctatgcatctcttcatctgtatcctttgtaatatcatttacaagaaacaggcaagtgtaaacaagtgtttctctgagtcctgtgagctgcttcaacaaattagtcaaacccaaagaggtggtcatgggaatctcaatttgaagctagctggtctgaagttctggagacccgacttgatactagtgtctgaaaggggtgcagtctcgaggcctgagccttcagcttgtgcaatctaacactatctccaggtaaataatgttagtctgactaggaagagactcaactggtgtctactgcttggtgtatggggcttcttggtcaaacaagtcttctgtgtgaatgattgctgtgttgtatgagagcagaggaaaaacaaatgttggtttgggagtttttctgaaacataagttgatcctcttccaatgagtctgtttctaaagattcagaattatagcaaaatgcttttctcgtctctttacttaaggaattttaacttcttcccttttatttcttctgctattaagtgattatacagtggctcaaatggaagcttgataggactggaatctgtaagataatattttataactttagattattatttatatatgaagtgcataactaaattgcttcaatcttatttgatttgtaggccacgaattcaagtgtttttgttaagtctgctaaaataatccagaaacacaacaagtgtcttcaaaattatgattttttgttttattgtgttatggctatttaagtaattaggaaaccttgataggattacaattctaggatagtgttttaataaatgcagcttatttaaaagtgaatttcatgaataaattgcttcctttcttctacttccagatattataaagatagtacatctgtttttcctgtttgactagtcccattaacattggctgtaatcagaattttgtcagggaaatcttcagttaagatgcttgaaactcaaactttatttctgtataccaaagactaaatttaatcaagttatgatactaatatatttaccaaaataaactggtttaaaaaaaatgaaactacgtaaacatacaagcctttggggaaaaaataggcattactacctagtacttcattcaattaagtattatcaaatctttgctactgtcaaaacaattttaatagtagtcataatatatgcttaatgaatatatacatgaaatctttaatcccaaatgcagaatgtgtttgacaaatattatgtagcagtagtacttaattttgattcagcataacatgtcatgttacagttctatgaatttacaattcatagaacttaatttaactactacttaattttactcggttttcaaatttttactcaactttttctcctctgttatttctagtggtaatttttgataatttccctcctttttgaatcatttccttctttgttcttaaaaataagtgatttttctgtgttatgttttattcttcagctttaagatttctgtctgtttgcctattacacaaataactctaagcaatactctttttaaatataaaatatgtaagcttaaaaaaaagaatctctatggtatgattgtgttgtctagcaacaccattcaccacccttttcaataaagagcagcgtatggcagatgcatctgaaagcaataactaatatttatttggagttctgagctaaggaatccaggaatgatcaacctggagattcattccttatctataaagaacatctgaacctggcccctcatggggaacatgggctgtacaggggatcaaggccctttgtttcgggttaaaagttgtcagatggaggatgctaaggggagaacgctaagtgaaaatgctatataaactgcatgttttttacaagcggtagcagttctcctgtacagcccaccaccactggaccaccctatatgtaagttctcttggtaaaccctatgtgtccttcactagctccaggtctcttctttggtctcttgaacatggtgctatcactactgaagtcaacaggctccagcaagacaagcaacgacaaggattcctttctctaagtctctttagtatactagtatgcaaaacctttcttttactcattatttaataatagtaaaaataaaaataaatactcacgtatttactcattataaatgtaaacaaagatataaatgacaaagatatgttccactatgaatataaatatttgtaacaatttaataatttttcctcagattttcataaatatgggagatagaaattctaaatattaggctgggtgtggtggctcattatgaatataaatatttgtaaccatttgatatttttccatatttttctctgatagatcaaacgagatacctcagattttcataagtatgggagataaaaattctaaatattaggctgggtgcggtggctcacggctataatcccagcactttgggaggccaaggcaggccgatcacttgagtccaagagtttgagaacagtctgggcagcataacgaaaccctgtctctactaaaaatacaaaaattagctgggtgtggtgatgcactcctatagtcccagctaccccagaggctgagatgggaggatcacttgagcccaagaacaagaccctgtctctacacagataaataaaattctaaacattttttgagatcacatttaaacatatcttacttactacgggaaaacaattacaaagagatgcaaaccatatttgtactaaaaagtataaaagagaaaaacataaaattagcttactgtgggacataaggtattaaggtattatgaaattttctaaaacaaatgaaataaaacatatctatagtggaaaccaacacatagcagagaattatgcacaaagtaaaaaattaaatacacaaattccagtaaatatgaggcacctgagtactggacaaatctttaagttaaaaataaaatataaccagtgacattctcagtgcacaacgacattccatacaaatgacaaaccagaaactgaaatttgcaactgaaataatagatacaaagtcagttaacagaaaatggctaaaactatttctaacctaaaatactgaaaacaaaagccatataaaaacaactctagtaattaaaaaaatcacattatatgaaacattggaaagcattactctaaagatatttaatacacaaagaaaatgttttgtcctctcaaacgataaaaagctacagggtaaaaaaaaaggagggacttaaaaaagagatcaggacaacattttttaaggtttatatatcttttgagataaaatctagctaaataagatgaggatgggatgagagaaaggcacttatagaaaactaaaatgcaataatagaaacataaatcctttgtaagcattagaaaatagaactgacgttacagacagaaagacaatttactagtatcacagatcaatttgagatcatttctcaaaatacaccgcaaaaaatagacataaaataaattaagggaaaatgataactattttgtactagtaaaagaaattcaatacatggatagtggatatcttaaaagaataaaacataacaaatgatgcagaaacagtaagctgagtatagcaaaagaagatgctccttaactcaggaagaaaaaaagactttgtatcattgtaaagacttaccaagttttacacaaaagtagtgggaaaatgtcattttgagatataacttcaatgaattttaaacaaaaaaaaataactgtaaaataaaagggtgataaattcaaccaaattaaaaataagaacatttattcatcaaaatttaaaaagagtgaaaagatatgccacaaactgagggaagatatttgcaacacataaaggtaaaaattatataatttgttatataaagtgctcttcaatatcaataataaaaagacaatataacaacaaaaaaatggacataagacatggagttatggcacacaagagaaacatgcaaagccctaagcataaaacgatgttcaaactcattagattcatcccttactagtaatttgggaaaagtcaaattatgaatgtattgagatataattttacaccccaacgtgaaccaaaatttagaggatgacaatactaattgttggagacaatgcggaaagggattaagattatttctaaaatgttgctgtggaagtataaatagcataaacaatttgacattctgctacaatgttctacatttgcagcctctatgaccccctacactctaaagactcttttccacatatgtaccaggagaaatgtataaatgtaaataaaacaaagatgtcataaagtaagaaatgcaaaacaatgaaaatattcatgaatagaagtgtagatcctaaaatccttactattatttaatcactgacttagaaaattagaacaatctcagtttaaacatagttaataaggtcttaaagataaccactattattttttaaaggggaattttcctcctaaatcactacagaagacaataaaatataccagagtatatgtacgataaaacagaaaacagtaaaaagatttaaaaacaaactcataaaagcatttaacacttgatagaaacaaatttatcatttattactatgagtttaaatggtttccagtcatcaataatagactacatttttcacctggaattatatttaaattcaaacatacactaaggagaaacaagccagacacaagctgagaaatccaattaaagagaaaagcatagagaaaaaatatattaaataagcaaaaagaaaagccacaataatatactacccaagtatgacaaaagatacctctttggagactatccaacctaaattccctgaccagtcaacaactcttacttctccctattttatattcaccagtatctaaaattttgtctatttgtttatttctttattgttcatcttccttatctacactgtgcacactgtgtgatatgacttgttcaaacagagacctgacagtattgtttaaacaatgtaactcaaaaactcaaattaattggtatatgtcaaacataatatcccacagttaggggatatactttactctcaataaacattagaacattaaaaaataatgacctaatattatatcaaattaaaaacattttatagtcaattcaaaaaaggcaattattctatactttctcactaccatgtaagtgaatgagaaaatgataacaaatatagcaacaggaaaaacatgcccatttggacaaaatcatcacatcaatctcgaatatctactaggcaaaactgtaatacgaaaaatacttttcaaaaaataaaatgagaaaatgtttatacccaagacctatccaagctgtaatcattatttttttaatcttagtgatatattttactcaagaagttatgactgttaaagcaagaaatgataatagtgaaatataataataatgatattaatcattaggataaaatgtgatatggtatgcattgagggcatccagcagaggaacatgacctaggccacagattcagaggttaccctcccctttctttgataaagaaatgccatatgatcatcagaatatgaaaaaattacacacacataacagcatttatatctataaagtaaaggtctgaaaaagggaagggaaacagcagttactatttgggagattataaattggtaatgcctttctagagaataatttgtcagcattcactgtttaaaccaacaattccacttctaggaagctatattagagaaccatgcagatatatacataagaagatatatacagagaggtttacggtcacatgatttgcaatggtaaagactcagaagtagtaaatgtccttagaaaaagatgattaaatatataattacatatgtatattatagaatattatgcattcattaaaattaatggaatagatcaatatgtactgcccacaaatcagttaaattctgccttgtatgtaacaactagcagaagacttttctagaagtctttatacgatgaacaattcattataacgctaagttacaatgtgatatataattatatataatattggagagcaaccaattttaaaaaacccttcaaactagaataaaaataaaataattaatgcatgtaacacagtaatatagatctgtccagaggcaacttatctctagagtcttaataaagcatgaaggtgacattggactaaagctaatttatataaaaccctggaatacagaccagcctaatttggcaagagcactcactgatttcgtgtgaaagggagattctagagtcaataaatatttttaagcacacaataaaatgccaggaacttagtaggtaaaggaacttatatccttgggaaaaaagacaagtaaacgagcaatattaatacaatataagtaagttttaaaactgtataatgtgattatttataagtgtctgttgtctgtctttccgtgactagaatgagagtcccatgaagcaaaacttttggtctgttttgttattttccaaatgttaaggcagtgctaggcacttaataagccctcaacagagattgattaattgaaagaaaaaaggacaaagaaaagcagaagcgggcagagtgggctatattagagggaggctcagggggctgggggcctgggaaagattcattttccagaaggtatgaaatcttagttgaagcctgaaggtcaagattggattcagtaaacatatttgaatggtgattgttttcaggcctgagtcaaagagatgactctaggccactaaggagtggaattgatttggaagaaaggaagttacatctgaaagaagtctagtaggcatctctctcttttttctctctctctcccctcctccccccacacctctgtagataataaatcttgataagagaaagcttaagacagatgttagataaaaactgaggccaaggaagagatgggcagaaggaatactgaatagtgaggatggcgactcgagaagctgttctaagaagaaaaatacttcgagaaggaaggtatccacagtgccaaattatacgaagttctggtaaggaaacacatggaaatatgttcaccagatttattaatagtaacaaagaggtcatttgaaactttcataacagcagtttcaccggtgcagaggaggtgaaagccacattatggtggctttaagagtaagatatgagagcctggcatttctagagaatggatagtgtttttgaagcctgattctaggtgagggcaagagatttatttagctggttatatctgtgaatgcttctagttgtaataacatactttcacttttttttttgaagtaacaaacctaggctatgtgtttgtagaggaggaaatattgctgcagaaggagagggaaaaaatgtctactgccttgtatgtgtctgcttcttccataggctttgggacattctcaccagggggtttgagaatcaaacagtataagacaacttacacaacaagttggtcaggtaaagacttgtctgcctattatttggattttataggaaatttaaaataaacagctctaacaagcagagtaagcttgttgactgaaccatatgagatgcatttaatttttctcaccacaggtgttctcaagcttctatatactctgtgcttgtggttgttctaagataatatttctgaaaatatggaaatatctctggggatatttgaaaataatttatttcaaagaatatggaatgttaagacctaaaatccatgatttattcaatactgggtattcattcatttatgtgatggaaaagttaccatagactttccatctacattttcttattgcatcttgttctgttccttcaagccatcctccttcaccctctgattaaccacacagttccattcttctcacaatatataggcagtaaatttttttctaaaaataacagtaaatgtgtgtgtttaacagtataagaggtagatctcaaatgagcgtaaagatcaataacaattatgtgccaattatactatgaatatgtaattggcagaactgtatgggcagaccatgaagactgagcaacagcaattctgatcgaaccatgccctaaatgtctctgcctaaaaccccaggtttttaaaagaagcctaatacaaacaagtacctaaatgaattgaaaatatcaacactggcatatatttgaaattaatatatacaatacaacttctattttttcattattcattgaactattgagctataagtggttatatacacataggtgaaacaaagaagactaagacacaattccctaccctctagtaactcaaattatctttgaattaagaagagtttactatattgtgaggttttctctaatttgataatagaagagatggaaatgcatgcagttacatggccacagacagataacttccttacttagcattgggataaatcctcaaaaactaattccaaaagtatatctaaaataaacctctattttccattcattctcctaaccaccttgccatagactttgaagtggaagactttcggttcagttgagagatgccacaggacggctcgtgcagagcaattactcatgtggtggctaagcatggcttccacaagacagcttctttactggccttctgttaatgagttagaggtatgacaacagatactgatggatgtgtttaaagaagcaaatgaatttgaaaaaccaaactttaaatgtgaacttcaatttttatattgtgtgactgtattttttatatcattgattagatttgagatagtagcatagtttagtctctggaatctttgtttcattcatttaagtagccacgaggtgccaggtattgttgtagaccctgaagttacagttgtgaacaaaactgactaagctactgctctcaggaaacttgaaccctagagacggaaagaggcattaggcaaaacagtaaagatagagatgataataaattctgtagagaaaataaaatgtagtcaggagtaataaataaaatgtggttaggagtaataaggaatgctggatgatgaatgttacatatgatgttgcgtgttaggaaaattcacactgagtagctagcatgtgatgaaagtaaggaagtgcagtatgtatataaaacaacataaagaaaaggtagtgcaaatgccttgaggcagaaggccgcaggaagtgttcatgaaaaatcaaggaagccagaagacagtgactaggagcctgggaaaacaagcagcaggagatgaggataggggcttgtaggctataataggaccaggttttattctgagtgacacaggaagacaatggaaaacataatctattttaggtttcaaaataataatacagttgcattttttttaatgtctgaggacaaggggagaggcagagacatcagataggagaatattagagttcaatactgtcattagacatggataacagagggtcactttagagaacctccatatctcaaacataaacacaataaatttattaaacgagtgcctgcttctgtcagtctgatattggtattaagagctcacgtagttctaaactctgtcctaactctggacctcagttctcataaccaaccgttcagtctgcagtgaacactcctctacatcttctgtcttatgtactcaaaaaaggaagaaccatatgaataattgtgggttatgccactgttgatacgagaagaaaactgctttgaaatgaaggaaagatttgagttgtagaagcctttaggtaaatgaaaaagcaaaattaactactcaacaaaacactaacaaaccaaactcaacagcacattaaaaggaccattcaccataatcaagcattatttacccccaggatgcaaggatggttcaacatacacaaatcaataagtgtgatataccacattaatagaataaaggacaaaaaccataggatcatctcaattgatgcaggaaaaaacattggacaaaactgaatatcctttcattatacaaatactgtaatcattaggtgtagaaaaaatgtacgtgaacacaataaaagccatgtatcacaagctcacaacgaacatcatattcaatggtgaagagctgaaagcttttcctctaagatcaggaacgagacaaggatacccacttttaccatttctattttacatagtactgaaagtcttagccagagcaattaggcaagagaaagaaataaaaggcatccaaaacgtaaaggaaaaggttcagttgtgtgtttgcaggtgacatggtcttatgtatagaaaacccgaaagccaacaccaaaaatagttcaaactaataaacaaattctgtaaatttacaaaatacaaaatcaacatactaaattcagtaacatatctacacattaacaataaaccacccaaaaaaaaaagaaatcaagaaaacaatcccatttacaagtagctaaaaaatatataattaagaacaaatgtttccaaggagttaaactatttatatcatgaaaaccataaatctttgaagaaaacaattgaagaagagaaacaaaaagtgtaaaagttgtcagaatctaaatggagtcaacggcattaaataccttgacaaatggggccacagtaggccataaaggaagggttctcacatacactcttgataacatactatcttgataacaagaactatcacaaaagacttcaaatgatatctgtaatttattactaaaagataaaatattattcgaagaaatcaaagctaaatgattaatcatctgaattaccaattaccagtcattaccaatatttaggtaaaactaaaatattaataataaaaagtactacttagtgagcatttaccatgtgctaaactttgtattatacccttttaaaattcctcagttcatttaactctcaaaataatgtagttagattaccataattatcaagatttctatttaacagtgaaagaaactagagctagctagttaaggtgaagaatcacacccaagatcaagttagtaaatgtagagacgatttcagtttgggcatgtgtctctgagtcagagctgattatattataccctactgcctcacacaacttaatcgtaattttaacatatcccataaaaataaaacacctctatctaggtcattaaaacttgacatataccactgtgctccttaggattttttggttgtctatatctcaaacatgatttacatagtttaagccaataaaaagagtctatccaagagtatctcacaaaacacaaagttgcaaaactctccctacacaaagccatgagaaacctgcgcagcttctttttctatgactgcctctatcttctctctcctcagcctggccttttctgattttcagtacatgttgcaagtggaaaatggccaccctgcagcaccaagctttcattttattcctgctcaaacagcccagaatgaaaaagaatctcttgtcatagatatctaggagagaatctgatttccccagcctcggtcagttctctccatcagattcaagtggccagaatgagggccagagttaggtggtacaaagaaagcttcaagggtctatgccaataaacttgtggatttgtgtggtaggtaccttcagaagtatacatcacagtcaaatttatccagaatttgtgataaatattcctatcttctaggaaagaatcctataaataagaaatataataaacaaaggaaacaatccaaagaggctgtatgtgagggggtcagaatgtcaccgcaaaatatgtcaccttggtataaggaccattttgagctgaaagcacttaagaaacaacaaactgcagaaagagctctttgctctttgctctctccctatctgcctaaaagcagacataaatttccttttgtgaaggtgttcccctcccttcttccataccaggaggagaacaatcctttatcactggatacagaaagttggcaccaagatggatttgcacaaacaaaccttgctaaaatagcccttatcttccattggtatccctcatatatttatcttcccacaatttatcacccctagaatcccaaaccccttttcctttgtgttatcacttctgcacgatttatctccctttattaaaatggtatgtaagcccctgggtttaactccttctttctgtcttcatttctttcatgtgaaggtcttgtgcacatataaattaaaatatgaacatcaaatacaatgtgtatgcatgttttcctgtcaatctgtcttctgtcagattaattcacatgccccagccactgaacataagaggttaaaggaaaaggtttttcttcccctacatacattacacataaatgtagtatatacagttattgatatttggagctccatattcaaatattgatgttggaattttaactactgattcaatttgcaaatgctgaatagatattaacatttttaggataaatcacatgaaatattctggggaataggttagtaaaatctaaatagatattagaaatttgaaagaaaagagaaaataaaatattccattctgtctcactaatgactactgaatcaaagcatgaccatgcaaatagggtataacacattttttttgtaattaaagcaacttcaagataggtaacattaaaaatatcctggcttaatgaaaacaaaaatatgaaatgcagttaggatgtgtggatctttatcgtgttatataaaaatacaaatatttcaaaattcataaacttcaataacggagagctatgacagcagagttccacatttttgttcatattcattttaagtgcatgactgcaggaaggcgtttctcatgctatttctctgtggtccctgatattcaaagtagtacatgcaatattaatgatctcacttttgtgagtatacagcatacaccacattcccacctaaagaaaagctcctcaattcctaatcatttcaataggctctaatgtaatatttcctacattggaaatcacagcactttatttaaggaaatcagtttggccaagtgagctctatggagtgcagcctgcacagacgtcagttcaaaggatcagatgtcaaagtgctccctctaatgtcctttaatcatcactccgattagtgcatgaataggactgtgattaaaaacgctgctgccattgtctacctattcaggcctctagcattttacgtgggttccaccgattagtgtttgaataggggaacgattagaaagacagctgccattgtatgcccattcgggaaaacagcaaaactcacatatttatttgctatgagcaccaaataaatgttttgcaaaggtaaaatataccattagactctaaagacaattttgctgatttcttttgttcagagcactgtattttcccatatgcaaagatgtttcttatttgcaaatacagtaatatgcttcattaatatcttttaaaatatacatattttgttttcatagaaatagtcttaacacacatctgctttattatatactacttattgacctataatacatcatacaattccagtttaatatttatgattatgcaaagattttctgtgtaaacaaattcaatctatttggttccagatcttttggatcccttctcaatattcttggactaatacgtagtctataagaacaacttcttctcccaagagaaatttccttgtcagacacggagaataaatatttcactcttgggccattctaagagagggaacacatttcaggttagcagttagtagccctgcaggagctcacacaagagagcttcggccagagtggaattccccacgacaatacaaacctctatcctatgataaaaattctccaagaccaaggcatcatgttgaggctttttggagaagggagaaatacaggcaaaaaaaaaaaaaaatcacagaaaaagaatccatccatatgcaaatataagacagtgctcaaaaaaatttttgtggctgtttctctctctcttctttctgtttctgtagaaatatgctactaggaaatttctgggcaatagaggaaatattctgtcttccattaccatcctcagtatcttgctgctcagtacttctccatggtttttccatatacattgttctctatccactatcatgatgtgcttccatatgtagtaacagaaacctcggagcatcccccttataaatgctgataatgataagcaataatacttacataaggttatatatatgccaaccacgattttaagaatactatgcacattgactcatttactctatcaggtagatattattctcttaatttagagatgaggaaatggagacagtaatggaatcagaaatttactcaaggtcatactctagtaaatggcaaaaccaataattggagctaagcagattatccctagagcttactctcttaaccaaactctctactgacaactgagctctttgggttccactgcctgccctcataaaaacccaacctcaaagataaggaagctgtgaagggaaaatttttcttcttttgcaaataaagctaattgaaacataccttacacaggggaaagttttttccagttcagtttaaaccctgagtagataactatattccattaaccataaagttgtttaaaaaaatagagcaccctgcttaaccattattaaaatttcaaaccagtgaagaacaaaataaaagtaacaaggctgatggctgacaattacaaacgagtttaatttgtgtgtcacatggatgtggagaaagttgcaatcagtctgaaataaataattaaagcaaagcatttttgtaacagcctcaggaaattaagagttaacacttttcttctttttagtcaattatcatcttattacatatttctgcctggagaataaatctctgacaacactggtccatgtgtggaatgaagcactaggaaaaaacatacttttaaagagggatactaatatatatcaaaactctaaattacagcatatcacaaacaaagaatgtgcctttttaacatataacatgcacttctcaatgaaataaccagactatagaacttttcgagaaaaaaatatttatcatcatcatcattgtcactactctgtggagaggtcctcagcatcatctcttggtacttttcttcatgctccagtctacgacttcagccatgcagtactgacaccgtttcaatcccttaacttcaatcagtatgctcccccatcttcggactttcagatacaagttttctactctcgtgaaattcctctttttccttccttccttccctccttcatctttattttcagtttaaattctggttcctcagggaggccaaccttgaattctgagaccaggctacagtacttcagctgtaactcccatggaaggctgtactgacgaaacttgatcgtgaaatgaggttaacacctgtgcaaatgcccacttagctgtctgggcaaaaaccgttttgtccctttcccatgacttatcacagtggctggaacatgttagatcttccattaatatttagtaattaataaatatgtacaatttagattcaaatatttatactatataagtttcaaagtgaaataatttatatgtagtggtgttacagaaatactgaaaagtgtgatgcaataaattaattctttaagggggttcattactccagaaggtaacttatttccagcaattgaattaatgcccaaaaatattcaggagataatactcacagttcatacttcatatatatatataaacaacggaaaccaatcaatagcttcatattttacttgctgtttcagggtatactttgtattcttacagaaatctaggtgtatgttagtagataaaacttacataaaaattcttcaaaagaatatcaaaatacatttttatatatgtgtagattgagcaattcacttatcttcaccaagcttcgtatttcccattaataaaaagaggattataatcataataattaacaaaacaacagtaatagttctcatccaccagaatataagttttggaagagtaaagtacacagttgtattctcagcaccaaaagcagtgtttaacacacactaagatttcagtaaatattcaattgttatttattgcatacttactacatgtgtggcactatttcaggagctgaagatacagttgtgaacaaaataggtcttcacagaccttacattctcgtggggagaaaatgactaaacaaccaaacaagtaaaatatgaaaaatagtatgttagatggcaatatgttctatgaagaaaaataaagcaggaaagggagtataaggagtaaatgcatgaagtaatatttgcttcatagagttgttcatcaactaatttagttattataaacagcctggttcactatccaccatcctcattgtcttcatcatcaccattatcaccggtattatttgagatactgttacagagtacagcactgtgtcacacagctaaatcctttgttagatgcactccctacatcatagaacttcagaaaaaatgagtgaaatgtatttgcttctcagcacagagatggaaagaatatatgagaaactgaatcatataatctaaattaggtatttgtatcagatactcaaaaatgctttgtgtacattaaacatatcataaattcataaggaaggagaactacaaatattttacaaatcatgaacatttatgccacttatgtttacataatttacttgcagaactaggtgcatacagggtttttctcaaatcaagataccataagcaaattgatctctctatacaaatgtctaccaatattttcagttaaattaatttgggacaggaaaataatatatttgagaatccttaaaaatgatgtgattcagacactcagaggaattgctttttattctggaaatacaagacaaaattatcctaaactaagttgaactgcaatcttgcagttactaggactattgttcatatacctatgtttttattttcaaagagtttccttttcatgaatttccagtgctatggaaagctatcacatctaccaacaacattaataaaaattggagaacatttgcttcggtcaaaatattttctgccttctctctgtacatgctttattttatagtgccaaagacaacagagatttttaagatatgttatttttatatactaacaacaacaaaaaactgctaattaaactgatacaaactttcttatcagattaactataaaatgaatcttaattccagagatgtgaaactgtgataaaatatgcatcagagaattgatcaaatatggcaagtaccacaatgacataatgattcattgtttcatgcagaaatgaaaatcaaatggcataaaaatattaaatgaatgtatgttatacatttgagtcttcttttattctatgttagttacaatacagtgttgttgataatagcatttttagtgtcaagaattgccctgagttttcttgcctagatgacaaagtgattatttttgctaccaacatagcaaaagaaaagccaggcaggaataggcatgaataattcggtttttgacatagtcataatcagaaaccaatacaatatctaggtggaactatcataagaatcatctggatacagacaggatcttggatggagatattcatttggctgttaataaacacatagatgggcattaaaactatggagtgaatgtagctatcaagagaggcataattgagattttccactgttcccatcttgaaatctacaactagactctaaactttctacccaaaatgcctttgcataagcagccagttattattttaaaataaatacctgttgtatgtcagaattcatacaatgaaagactccacctcaacttcaaaattacaaggtctacaatatgtgtaaatgagctttatactctgaagggatttctaggtagtcacatttcacagtatatttttccctctctaatttttttccctctgctgaaattttaagctcgcattttctttaaagtgttattttctttaattttcctaagacacacacgcaaaattattaaatttacacattaataatatctaacatttgttagaaataagaaagctattgcccagtaatgatcacttaaaatatacttacttcaaagtaaacttttatttttctaattcattgcaatgttctcaacaaatgccacaggaaaattgtttttaaaatgtatgtatgccatttatgtttacataatttacttgcagaactagttgaatacggggtttttctcaaatcaagatgtcataggcaaactgatctctttattcaaatgtctaccaattttgagttaaattaacttggggataggaaaataataatatatttagtaatatattattcacagtaaaatcataccattatcaagtgttccaaaacactcaataatgcgtcatgactggtagtgcaattcagaagttaatgtaatgaccaggaaatcccacagagtgagccagcaagtacttctgactcaacctggacatccaaatccatctgggtcgctactgcggttttgcagttgctactgaagtttaaacacctgtggagacactactgggtcttgaggctggctggtacctccaggacagtggaagccctttgggccagtaacagggtgaagtaagtgaggcactgaggcactacatttaagttggcactcagttttaggatcacgcaagtaatgtcccagcttcccaacatggggttcctctggcattgcctgccctcgcctacctttctataatctttcccatcccaaataggaacttactctgccatctctccccactccaacagccttcatttgagaacttgctggatagagggcaggagatgatcatcattcatgataaattcaaattcaaaatcagtctttatgaggtggttgtagttttgctaccatcccttcccattccacctagaaatttatacctattaggcagagaagccactgggttttcatttcttgaaggaaataatataactacagaaagcagagaaacaaagggtgtttcttttggacttagaattttagaagtcacgttttcagaaaaattgaaaggacttcagtgattgacagtggatttaggaggaaatgggtgataagttaaaagtaacttttttcctccactcccatccttcccacccagtctatataaatatttaatggacagagagacaaaatgaggaccaaaagcaaagtgaagggcccagagatattggcagatcttggagaaagaggatcaatgcccagctccttaggctattctcagagggctgacaaataccaggtgtgggtaaatgaaagatggagaatctgtgactcgacaaacgaagccctgggagagtagattgaaccatgaacttctctgaaccccagtgttgagtggaacatcagaatgactgtcatcttttcaagaatggcttcaaagtagtagagaagtgagggatagaaagggttctaatgaatgaaaatgaaagatgactccaaagtccccatgatggtgaccagtgggaagatggcatgaaaaatcagctgggcttacctcacagcccacacttgccaccaaccctcataaaacttaggtatcagctcgcagaaataaggggtgagggggacaagcagggaaaaatgaatactacaagtgacacacaggtttccactctcacagatacttacaatagaattaagttcagttacaagaaaataaaagaggtcacgtgacttgcatgcctgagtttctagttggatatctgcatgctctatacaaacactgcatttttcacatactgaaagaggtatttagttgcaaagaatctgtttttatttttttatttcagaaactcaactactgtctatttttggaagaaaataattgtcaacaatcaaaaaagcaagctcatgcttgagaaagtattttcaaatatcatataacaggaggcaagggtagaacaggtattgctttcttactgggtatctggtgaaaagtttatttactttggagcttaaaaataaaaattcatattgtgaatttgatatgtcaatggagggacatatattctccatcaaatttaacagatcccagtagctggctatccatgaaagcgtgaatgagattgactgctagttgtactaattaagtggatttcatctcttaatagccatgtaaacttgagaaggaaaaatggtgccagcagacaagacaaacattaagtataatttccaaaagtataaaaattaaacgtatttggaacataagaaatattattagaaaaacatattaatctatccttcctccatggaagtcccctactatgctcttgtggttctcatctcacctctcatagtgcttatagctaaattctcatctctgcctgccttttccatgctacgttcagtaccatgctgagccacattggagcctgaggcaaaaggaaaaaggtgtgtgcctatatatatttattattattattgtttttctagattactgagtctttgttagccccttatattttgaacctcaggccagtgcctcacttgcctcactctaatttctgccctaatcccaaaggtctaacctgcaccctctttccactttacacactcttcctgggtaactctccccctaggcttttagttatttacatatatcctgatgattcaaaaattctttatctccatcccagaccctttactaatcttcaacttttgcagtgatccacaggcacaagacctcaaataatccaaaagtgagtttagtatttaccctcaacttatgctataaacaagtaaacatacacataaagtcaactcccaaatcatatgtgttttatctcctaaatcaattcaagctcatcctccctcctagtcttcatcacctgtcttccaactttctaaacccagtcccagagaccttgcctcccatcttttcattaaatccatggtccacactgaaagctagactgattcacctaaaggcaaatatgatcaactcacactgatcattaaaacgccttaactgttcttccttcaaaagagtattattattatttattggtatttcagtcttcttcaaaacaatgtgagaacttcttggcaaggcctatgtcacataaatttcaatgtggcaagtggcacagacaataaatgtgaaacaaacgagtgactgagattgtgaagctcatgcaagaaaaaaaaattatcaaaacccatatattatttagttattttcattgtctacaaggaaaataagtcaatgattttcttttatttccttattcaaaaaaattctactaaaagagctctctggcaattgcataggttcagtctctagttctaccattcagttgtggaactgtgaataggtttcttatgcttccatgtgcctcaattccctcatctatgaatggatgataaaatataatgtatacctgacagggtgcttctgaagcttaaataaattacttcacaaaaagcattgcaaattcttaatatacattatagcttattctcattgtatttttttttatggtgagcaccttgtatgtgtcatgcatttagaacaaatttgctataattcttaaaaacaagtctaataattggctaattggctgtctttaactgcctttccttttaattttcacctagcataagttttctgatttgtaatattttctggtcttcaaaaattgctcaggaaaaatgagtgcaaaatatttatgtaattaggatagttcaacattttcaaaaatggcaaaaataaacagcagttatggaacacctgcttaaaatatactggaaataactgcttcatgcttcattaaccagtataaacatgtttgccagtttaaatcccctactgaagtcagaatttccaattagtactagaagaatattaaactaccaagtgaagatattcctgggcaataatttcagaactgccattcttaaggcacttttaccggtcaaacacatgcttattttctaagaagcctatgatttacttattaaacaaaatttgtatctattttaataaacgattttagactacttattttgctagattttattcacctctgagtagcattcaatacagtgcctgaaataagatgcttcgagcaccaaagaaatagaaaaaaggaagaagaaggcagatagtaagagaggactatataatgcctcaagaaaaacttctataattgttgagtccaattataactctgttttgggtaagtgaacataagaaacatatagcctatatatagatagatatctatatatagagagagatatatgtatatatatcaatatatagatagagagacagtaatgcaggctagaaatataaaggaatcttcaatctaaagatagtattaaaagtaaggagataacgagataaccaatgtagtgactattttaaaagaaagaaagagagtttgagctctgggcactgaaatatctagggatgagaggagaaataatcaacaaagaagtgaagaaaaacaagaaggagatgtcagtgaggtaagaagaaaactttttcgtatctcatcagttactggttactggctagctagtggggataaaagttccagcatcctacttgggtctttatgaattgaaaaacaaaccatatgttttggtgacactttcattcaattatttatgccagcatgaagaggataataacaaatacgtaaggagcagcattattcaaccacaccgagaataactttcaaccctagcttcatatttcacttttgggaataaaccttactgctctgagaaattcatgaatgtcacagagagtcttcaaactaacagacatcagtgcaataaatctgatcttataaatcgagattactattttaacatagatctaaagctttcattttatttttctactaatactcattacagaagacctgaaatatacaaaagtgccaaaaaatataatcaatattaatatttcatttttttgttcttttgtgcatatatatataaaggtatggttatgtgtaagtgtacacaatcactattgaatacagtgatgttaaatcctttttccatgtaatgcagatagaatttatccagattattatttcaaaaacatcttaatgactgcacaatataccactgaattaatttactctaatttgcttaaccatgacccactggttggaattcagtgggatttcccctacatttgtctccattgagtaaataatgcctaagataatcctctttgtgcttaattctttatctatattcctaattctttccttcagatatgttattagaaaataaattactggtgcaagtgtttgataattttaaagtattgttatgaactgaactatatctcctcaaaaatcttatgttgaagtcctaacccccactatctcaaaatgtagctatatttggagagagagtctttaaagaggtaattaagttaaaatgaggttattagggtatgtcctaatccaatatagccgatgtccttatttggacacacgcacacccaaagtgaaaaactcagggagaagacaccatctacaagccaaggagagaggtcttggaagaaatcaccttgatctgggactcctaacctccagaactgtgagaaaataagtctctgttgtttaagccacctagtctgtggtatcttcttgtagcatccgtaggtataaatagcatccctaggtatagcatcacaggtccaaatgaatattgtcaaagatattgtcaaactgcttttataaatatttgggtcaatatatatttgacagagaaagtggacctcactgtaccttggttattatttttaaaatgataaaataaactcaatttataggatcacattatgagatacaaatgctaatttccataaaataacaacaacagcaatcaaaataaagaaagtctccatttcgaaataaagtcctgaccataaatactttgaaaacttataaatgcgagacattagggaagtcacatagtgtctcttgatcatagttctcagacctttaaaaattagagatttaggcttgatagtctttaagggctttctaagtttaaaaattatatcacactctggggactgttgtggggtggggggtggagggatagcattaggagatatacctaatgctaaatgacgagttaatgggtgcagcacaccagcacatggcacatgtatacatatgtaactaacctgcacattgtgcacatgtaccctaaaacttaaagtataataataataaaaaaaagaaaaaaaactataataaaaaaattatatgattcttttttcagtgttattcaattgctcttatcattaaactgcgtcatggcttgtaagtggcctattccttgaacaatctgaatcacactggtttccttttagagacctctactagaagcatcatgatagaaaacaaagctcccaaaactggaacaagaaaaactgaattcaaaatccatgtctgtaattaagtgactatgggatcttttcatgtaacattgtttctctgtttctttttcttttttcattcaaaaaaaattgcccagtggctggtgatagaaaaacttaaaattagataaatacaagcacacatgagcacacaccctcagtttccatcctcaaagagttcataatataagaaggaggaaagaagtacataaactaaaatcatacattctataagaaagtatatacacggttccaattgagctaatgttaaactaatactactgtctcactcattaatttgggaatgttaatttggggtaatctggggaaatcagataaaaagacatttctttcaaaatttaaaaacgtatataactttaagatggaatttctaacatcacctttaaggttgtacttatatccgatctatggtgtcagtttcagctctataatcacctcctatatacagttaaacaaagttctagcaataatctcagagaaatgctgttttgctcctacacctcacctggaaatattaggtgttcatagaacatctaatgttcatatattttgtgagggtgtatttttaaagtccacagataccagtgtatctatagctttcttcatttagactatatctttaacatgaaaactcttctgtatcattgtgtcattaggcaaaacaattttaaaacaaattttaaagattttgaaaaaagaaattttggcaccaaactaaatttacaggttgcatatcccttatcaaaaatgcttgacaacagatttgtttcagatttgggtattatgaattttcagatttgggttactcaacctgtatataatttgtatttcaggagattttttaaagcagtgtaattaaaaatacactttcaaactttttcaaatattaaatatttaaaatatttttaaaatcacggctgtactttaataccttatttctaagtgtatgtaaaatcttgccttacaatgtgtggagtgaggtaattttcagcatgaaatagtgtatcagtggtacttacaaagcagttcttatcaggatttcttttccaatgtttcttgtctaatttcttggccgaagtggaacgcagagttgcatgagtttgtgttcgaggatttaaagccaggatactctaaagacagcataaacaatgtgtaaatatatggaaatatgttggcatttgtttaaacttatttttattttatttttatttattttgagacacggtctctctcactttgtcacccaggctggagtgcagtggtacaatctcagttcactgcaacctctgccttccaggctcaggcgatcctcccaccttagtctcccaagtagctcggactacaggcgtacgctaccacacctggctaatttttatatttttaatagagatgaggtttcgccatgttgcccaggctggtcttgaactcctggtctcaagcgatccacctggctcaacctcccaaagtgctggggttacaggtgtgagccaccatgtctggtagcatttttaggaatcaaactttatctaagatttcctcttacaggcccctaaagaaagggttagccaggaaagaaaacttaggaatcacaaaaaaaaaaagatacatgtaaatcagaagaatgaccccaaatttgcaagattgtgtttaataaaatcaagtgaggaatcctatatttggttttccaaaaaaaagttcagtatgggaaaatcctaatacaatgaaaatttatatggaaaaagtgagaagatatacttgtcttagaaaaaatctaataatgttatcattgatataatgacatcattatatcaatgtatatcattatacattgacaaaaagctaaaatatatgtttaaaatgttgcatggctctcaaacagcttacattaatagactaatatggggcaaaatataaatcgagtaattgttattgtattttctactaattagccagaagcaattcttgaccagaagaaaaacttcaagaaaaacaaataaatataatcaataatgaacaacataccattatttcaccagagaggaggaaacatggtagtagcacatgcttctgtctaaccaaattaacattattacctaccatctttcaataatgattatgtgttgaaaagttagatgcaacagctgaagaaaagcctggagaaaagatctgggagagacacagtgtatttcagtaggtgaagaactttcacatggaagagagatttaatttgttttgtattaacacagaaccaaggctgtggaaattaatggaggaagatttggattcagatataaattaaaaagtggcagctgagattgtattagaaatcattccagctgacattactgcagtcattttaaatgatgttcatttcaaaagtcttcttccatgaagttacccctaactaatctagatccatttttctgtttcagatcactgaaacatctctaccacagtatttcagtctaaacagtaactgctgctttaagaattttcttcccttctaaactgtgaatgtgttgagttgcgggattcctgacttttcaaaaatctttcagtttatgatatacagtaccaggtaggtagcatatgcttattcctgtaaaatagtaattcaaaaatcataaatataatttttaattcctagtactcttataactttgagtaaaccattgatctttttgatctttgatttcctcacatgcaaaatagggcaacacctgaatcagaagtaaagaataaatgaaatgcatgatacaacatgttttctaaactacaaaaaccctaaaaattgaagtgtagtgaaaatggaatccagaggctatgtgcaacagtaatcctctgtccatgatttgttcatgtagtggccaagtaagaatttgaaggggacctgagaatgcaattcctactagatttaaccaaatccaagatcaccttccaaatctagattccatgattctttaaaaattattgggtcatgttcatcattttcacatataaaaatgaactcttattgagatccacagagaactatcaaaaagaccacaataaatgaacagataaaagaattattatactattaacaacagacacaagctaaaaatgttattttccacctctactaatgtaattccacaatcaacatatctaaagtaatcattttctaggtgatatcttagctgattttataagagtatcacatgctaatatgaagaatttaaaaatcataaatgactttctaaaataaatgttatacttagtattcttagacaagaataaaatcagaaaaagtcacttcatttcattctgcatttgatttaaagtggtaataacaatgctttgtgttttaagtttttagagtttaaaagttcaaaagctttcacatccattatgtaacttaacttacaaacagctactactctctcaatacttaggatgagcaaataaattgagggtgattaagtaacctgcttaagatctcacagttaatatgcaaaaagaattgaattggaactctgtttttctgagtatgggacttatattgaacctgatccaaagatgagggctatatttaaaagtcactttttgagatataaggtaggaaacatttttaaccacatgtttaaataatatcaatttgcacctgagtagctcaatgaaaaattaatttcaaaccctgtcttgagcaagccagtaaacatgaccattaagaggtcacctctggaatggtagagtaaggacctctgcagactgactcccataaaaataaacatataactgcaaaaatagtaaaaatgaaaactctttgaagtctctggaaatttgccttaaggcaaacagcaaatgaagaaacaataatacatgaaaatctgctaaaactggtaaaaggagtgaaggtctatggcatttgaagtataacccacaccacttcagtccagtgtgacagtcattctacctcagatgggtatagctcaaaacacagagctcgctctaccccagccaccagttgagggctatggtatctcccagagaggggtaagatgccagcatttctcattttctctctcccccatgctacacagagacaaaactgcaactgagtgcagctgagactaaagtgcagctgacaggtcaggagttctgttactccatccagcccccactcatagagccaaggttctacctcaggaatatcatgccaataacaccagggccctgattatccttgcctcacctcacttactgggtagagattgcacacaaggaagagcaagctgagaggactagaggctattgcctatacctagtactttgctcataaagcagaaatttaactctgagagaagtgggccattgtcactatcctcagctctggagcagtggcccagagatttttcccagaagacacaagccataagaacagagaggtccccccaaaggaactgactttatttgaacctgtatgcagggaagttcaaacctaagagtactcttataaacaataaaaatgttcatgtcaaacaattaagaagagggaggtagcttcctgaaaacaaaaaactgaaccataaggcaggtagttcataagggaaacccagggaaagaaacataagatgagttctcctggagttacaaaaaacctcaaggactcacctcaaaaactaccactgaaaaaaggcccaaatttaactgaatcacactgtggaacaactcatattccacagcaaaagtaataaagaaatcaaccagaagccactggaactaagatctgggtgtgacattactacaggcagacatcttaagagagagatcagagaaaaaggcaaagagacacctgataaaaccagggacacccaagaatgactgcacatatccaaggctgcaccctgtgagaatgacatcagcggttcacacagaggaaaatgtacatccctaaatagtatatccaggccaggcataatgggtcatgtctgtaatgccagcactttgggaggctgaggcaagtggactgcttgaggaattcaagaccagcctgggcaacacagtgaatccccatctctataaaaaatacaaaaattagccgggcatggtggcatatgcctgtggtctcagctactcagaaggctgaagcaggaggatcgcttgagcctgggaggtcaaggatgcagtgagctgtgaccatgccactttactccagcctgggtgacaaagtgagactctgcattaaaaaaaaaaaaaaaaaaaaaaaaaagtatatccagtcgctagtaacaagtcgccctcctctagagggggtttagtgtccggcaagaatagctacattatgtaagatgttcagtcttcaatttaaaaaagtatgagccatgcaaagaaacagaattgtgtgatccatacagacacacaaaaaaaggagacaacagaaactcccattaagagggcccatgtgtcaaatttaacactttgatatggtttagctgcatccccacccaaatctcatcttgaattgtagttcccataatccccatgtggtcatgggagggacccggtgggagataattgaatcatggggccagttacccccatgctgctgttctcatgatagtgagtgagttctcacgatatgtgatggttttataagtgacttttccgtctttgctaagcacttcttcctgctgtcatgtgaagaaggatgtgtttgcttccccttctgccatgattgtaagttccctcacgcctccccagacatgcacaactgtgagtcagttaaaccactttcctttataaattgcccagtctcgggcagttctttacagcagcatgagaactaatacacacttcaaagcagccattacaaggaaagtatgatgacaatgtcttagagagtacagaatatccatatacagatataaatcacttaaattattttaacaaaaacaacaagcaggcattctggtcttgaaaaatacaatagctgatatgaaacattcactagagttcaatagtagatttgaactagcagaagaaagaatcagcaaacttaaagacagatcaagagagattacacaatcagaagaccaaagagaaaaagaataaagaaaaattaacagagcctcaatgatatgtgatacaccactgagcaaaccaaaatactgtaatgggattacctgaaaaagaaaagacaaagcaggagaaaatacagaagttacactggcttaaaatttgcccgatttattttttttttaataaagtagaacaaggtatattacactataccttcaggaagctcaatgaatgtgaagtatgctaaatgtaaagagatccacacaaagaacatcagtaaaagggctgaaagtcaatagcaaaaagaaaatcttgaatgtagcaaaaaaaaaataattcatcatgtaaaaatagtttcaataagtttaacagtgaatttctcattaacaaccagagagaccagagagaagtgggataagacatacaaagtattaaaagaaaaaaaaatgtgaaccatgactcctatacccaacaaaactatctttcaaaaaatacattcccagaataacaaacaataagagaatttgttattagcagatgtgacttataagaattactaaaggaagttcttggccaggcatgatggctcccgcctgtaatcccaacactttgggagtccaaggcaggtggatcaccaaggtcaggagttcaagaccagcctggccaacatggtgaaaccctgtctctactaaaaatacaaaaattagccaggcatggtcgtgggtgcctgtaatcccagctactcagaaggctgaggcaggagaatcacttgaactccagaggtggaggttacaatgagccgagatcacgccactgcactccagcctaggcaacaagagtgaaactctgtctcaaaataaatagataaataaaaatgaaaataaaaagtgaaaaaaataaaattaaaggaagttcttcaggcagaaagtaagtaaccataacttactattcacacgaaaaaaacaaaggtcaacagtaaagtataggtaattatgaaattataatagtataaatgtatactgtcagactagataaaaagcaagatgcaactatgttctgtctttaggagacacactttaaattcaatgacacaaatatgttgaaagtaaaagatggaaaatgacatatcatgcaaatagcagcagcatgaaagctgcagtgcccatactaatatcagaacaacaaacttttaaagaaacaaaaaaatttactagaaataaagaggaacattttatcatcataaaggctcaatctaccaggaaaatataacaattataaacatatatgtgcctaacaacaaggcccaaaatacaaacaaatttgaaaggaaacaaatctttaaacaatactaattaaagacttcaatactccacattaaacagtggatagaacaactaggcagaagaccaaaaaggaaacagaagacttgaataacaactataaatcaacaagacctaacagacatccatataacactctaaaagagcaaaatacacattcttctcaactctatatggaatcttctctaggatatattgtatgctagatgaaaaaacaacttctactaacttaaaaatattaaatcatacaaaatagttctccctcttcaatggaatagaattagatatcaataacagaaagaaatttggaaaattcaaaaacaatatgatgaatactgtaaacattatgctaagtgaaagatgtcaactacaaatatgacatattgttgataccatttatataaaatgtccagaataagcaaatctatagagataaaaagtatattagtggttgctcaggctggcggattagggagaaatgagatggctactataaaaaggataagtgatttctttttgggtgaagaaacctgattatggttatattggcacaactctgaatacactaaaaaatactttgaattctataatttacattggttaattgttgatttgtgaactgtatatcaataaagctgttaccaaagtaaaaccctattaaattctacattcagtcgatttagccatatactttattcactgtaataccactaaaacttcctttattagctcaatataaatgtaacaagattatttttagtaactcctaaatattacagaaatcatatttcttcagtctctcaagttagacatctgtgtctttttgaagaaaaatatacaataaagctttaattttaagtggtgtattccttatgatgaaataatactaacaggacctattttacaaagccagtattagaagattcaagtaatctcatgcttatagaaaaaaagtgaaaacattttcttattccagaatataatgtttgcttatctattcagttttcaaccattactaatctcatccattaattcaaattgagaaataaaaagacacatttttttaaagtagttattctaacatttaaagcaaaccagccaggtaacatgcaagaaagatggctgcatttattttagtttttatttccataatccatattgtgataaatgatcatgtttatctatgtcagcatagcaatataacttttgagaataaacattctgaatgtaatttattggctacttatcacagctacttttctttcacatagcataagtagaaagcataacataacatgaaatattgggttaaccttttgcaaaaaggcagtgagttgaattcaatggatcttgggtaaaaataaattggattgtgcaaaatggttaccaaggatttggcttaataatatcccaaatgaaatgtgatataaaataaaaatacaagacatgagtggttcagagctgttaaaaataattttccaaagcaagactttaaaaaactaaaagtcaatatcatcaataactaagcagctgacagataatacaggagagttctaaattgcatttttcctaagaaatggccaaaggcacgttccaacaggtcacagagtcccctctctggatgaattgagcactttaagaagcccattaaccctttcagatacagggtacattacttatacagggagatttttctctcatcaaagaatttgacttgtttggctttaccaaacattttcagtaacacaataaagatacactggttattccagacgcagaaaaaaaaattagaaaaaatttaattgtactaattttacctagtttaagaaatgatggaatattatccagggccaagtataaatgaaatcaaataagagttatatattgtcaccgtttggtctgttaacactattctgtgaagcagtggaatgcggaaacatacaaactagaattatacatctaaagagagtttttctgtattaccattgagggcaaaaaagagaagcctgtattgattacaatcacaggccctcatgtcacaaacaaaatcactaaatcttaggcctaaaacattggagcttcagtattattcaagagcttgaattccaattgcaggaagctacttgaccaacatgtcctctttcttaacatgtggtattgttttatatcacaatagtaattatccaaacatagtgtaccattaagcttcctttaccctttgcattcgaacttataaacaaatttttcctattcaatactggtaattacttgctataattctgagccattaaaatgatacacatgttgctgacattttgtacttacatgcttaagatgataaactaagttttgtcttatttaaattatgcttacatttttctttaatggcttattctgagttctctataagttatctcctactttccaatgcatcaagtaaacaaataataataataataaacatgtttttcccatttctttcataattggacagaaatactttgatttcaatataacattgtgctgtggtgccaattttttatcaataaatattctcagctaacagaaaaacagaaatatctattgattaatgcttttgacgagtatttgttgccttatccaggtaacaatctaactaaggctggtcagtggagaactaaatttttcagtttatttgcttaacagtctcttgtttaaaagccccagtctcagccagttatcccacgcttctccatgtctctcattagtcatagtgtagagtgatttaattaatatctcagaaattcacaaaggtatctttggttcttgaataagctcagaactgatacggcccatctcctgctaggtagggaacagaagaggagagaatgcagctttattttgcatcctaggttcacacttgagatacaatcaaccttagagtctgaaaatttcagaaacccatggtaatcagtcctggtcaaagacttacatttacctaataattttttaaatgtacttccattctttgcccagacacaggtttctaagcccctaggttgttctacttttccaagtaacttatcatactttttttcccattttactagctctgtacaaaggccaattttccctttatgcacagtgggtaactcactgcagttgattaaaaatttatgaaggaaagaatctctgatagtcctaaatcttacaactttcattttgttaagtattcactaagcaatatgcatagtgtttgagattaaatttgggtttctatcttagctctactattcttgttggttatttaaactctcaagctctctactccttcaactgtaaaatggtgattagtaatagtacttaccccatagggttgttgtgatgattaaataagataatgcaaaagatgtttagagtggtgcatgcagtaagtgcttaccacatgttatctatgtatgtaatagaactaggttttagccactattaacccaatgtatactcatattcctatattgtcaattctgaatgtatacatgggaatcatatttttaagtacaggaatatagaaaaaggatgaagacaacaggtgagaaaatatctataaataaggtagtacaaaaaatagagatgtatctcagaggaaaccaaatcactgactgagtcatgggtctctgaacttatcattgccctaagccctgcaatttcaaaggcagactgcctgaaaatacaatatgctttttgcaaattaatatggcagtgtggaagggtcatgaaattcaaaaacagattttaatatccatcgcatatatatatatatatatatatatatatatatagcaatggagatatcattttataatccatagaactgtatataactcatgggtctttggtcccaacatgtttaggtaaatttacattacatttccttcccaggaagggcatgtcagatgaaaaatgatgaatttgtaaaacatcaaaaaatgttatcaactgaaaataaatgaatcccttcagaatgctcatcatatcgcctggaatatttgattcatttctactgagcatatagttaacacaaatagtttacacattttaaaatatcatgtctattatgtcactctcacactcaacaaggtaaggtgagccagaggaagctcttcgtctgtctttgcaaggcccagtgtgtgactctccttcacttctaaaatacacaccacacaacaggtgcctaaatgatctctatgtgaaaaaaaaagtctttttattgtctttcagaaaagattgacaattcaaacacaagaataataacatctgatattaacctcacaattcttaatacagaacagagcatgccaaaggtagtgactaattctgacatagacaatttagtctgttcaggcttttataacagaattccataagctgggtggcttaaacaacagatctttatttctcacagttagagaggctggaaagtctaagatcaaggtgcctgacaatttggttccaggtaagaatccttttccctcttctgactcactcacagccacctttttgcagtgtgatcatgttgcagagagagaggatgagaatgagagaaagctctctgtagtcttttcttataagaagcactaatcccactatgagggtcccaccctcatgacctcatctacccctagctaccttctaaaggctccatcttcaaataccacacattggaagttaagtcttcaacatatgaattttgaggggacataaacagttcataacagacaaggaaaggattccaccacctgtggaagtatgcaaatactattaatattgggcatcaacttaaagtcacctttagcctaagagttcaaatggtaccatgttgactgtaccattttattttatcaagaagaaacttcagaataaccaaaggagatattttaaagtattgcttaatttaagaaaagaaaagaaaacaatattaccaaataatgtaacactagctattaattatatatctttattctttaaacaatttaaacagcaaaacattaataacatatatactttatatatactgtttgtatatttttattataggaattgagaaataaagtgtcaaatgcaaacacttataaagagatatcaaaaatatataaaatgggataacctatactgtactttattttaaaatttcattactttaattataaactattttcaatttaatataatgtggcaaagcatccatatattacatatttaaattaaaaccagtatgtagaaaatgtgtaactatgaaaatacacgttggaatatcttgcatttgcaaaaagttgaacatatgtataaatttatacaaaatcccaagacagaattatgtgaaaagaaagttgatagggattattacgttaccaaaaaaattcaccagttcattgggtaagaaaatctatattttagcatttatactttttttcattcaaaacaaattagtcaatttacctcaaaacttgctttacagaaattgcctggctcctatgtaaaattggccttagagggcctttttcaagtagtatgaaaagtattatgatttacctttaatctagtaccttttgtgtataaaatactctcatttacaaaagacactgctcacaagaccaagggttattttagttcaaaagaggctaagtgtataccagcatgctaaaattatttaataccagtcaacaaatagagatgctggaaaacaggacttcaagggaaagatgaaagcaggacctgggctaactgagtttaaatgttttacaaattaagtaaatagaggaagtagcatgattttcaggttcacaaaactgtaataaatcatagcgtgactagttgcccttcatctatatggttaacagctaaaaggaaatatatatatgggctggcaagtgacttatgttaaaaataagaactgatatgataaaaatgagttttcatttctggattttattaattgaaggattatcatatctattttttgagaaggatcagagtagagcaaggagctgaggagttggggaattgggtgagttgaggagttggactatttaaaatcatgaaatttatgaatttaaagttcatgcatacaattactatttaagctacttttatttccttaataagtaatattttgtattcttaattaatacactttgtttcaatgcctagagagaatgctttccatttaaacagtagtattagctgtatatgcagtatggagtcacatcaagatatcccaatttttttaccaaaaacaacctaggaattccaatttaagagaacaaatatctcacttaaaataatttaagtttatacctaaagcaagatataaaaatataacacccaatcttacactgtaattacatactatttgacctaatctagcttctttccagggattaataaaattaacttggcatcttttttgggtccctaggatttagtatattagagttggaatggactcttagagattaacatttgatttcacgtcctatttagaaatcctgttccaaacactcattgaactatatcaatcaaattaatcaaaaatgacatagtgttagtctcttatataaagctcacataaatggataagaaaacaggaaaatattatcagataagctggaaaagggcatgaacagatcacagaagaatgcatacatatctccaatttaaagtgaaaaagagaaacattcagctacccactgagtcttcactttcctaccactactgcaaatgctcttgtcaagtctcaccgatgatgtgcatgttacccaacattctttgtgcattgttaggttttacttctccccgtctcatatttaagtgactttatttttttcttcataggtaaagtattacttttttacaatagctttattgagatataattcacttacacatgattcacctattttaagtatataattcatgaattttagtatacctacaaagctgtgcaaccatcaccatagtcaattttaaaacatttcatcaaacatatccctgccaaaaacatgtacccattatcagtcacttccagttttccccaaacctccagatttaagcaccattaatctactttctaactctttggatttgtctgttttggacatgtcatataaatggaatcatacaatatgttgtttttttgtaaatggtttctttcacttagcataatgtcttcaaagattattcatatagcattttacttgtatatgtgttataaaccccatactttactgtttaatttaaatgaccaattctcttaatgaggtttaaatagtaagtaaaaatcatatatctacctatgtagttaccatttttgcaattatgtaatccttggtgcaaacccctatttttacctactattgtttccttttgcctgaaggatgtgatttcctttaatatttcttgtaatgcgggtctgctgcttataaatgtttgcaacttttgtatgcctgaaaaagtctctactttgccctggtttttgaactctaatttcactggataatagaattctacactgaaagtttttgttccctgatactttaaatgtcttctcacttgcattatttccaacaataaatctgctattgctttatctttgttcttctgtatccagtacacctgtttttttcctctagccgctctgaagataaactctttatcactagttttgaccaatttgattatgatgtgcctcggcgttgttttctttatatttcttctgcttaggtttcactgggcttcttggatttacaaattcatttttacaaatattttcttcttctctcctcccactgcttcactctcatctctggggaaattccatttacatgtatatgaggccactcgaagttgttccacagctcactgatagtcttttcatttttttctctctctgtgtttcattttagagtttttattgctatgtcctcaagttaactatcttttcttctgcagtgtctaatctgtcttcaatattatccagtgtgtttttcatctccttacagttgccatctttagaagttcaatttgggtctcctatctattttgcacacctctacttcattttttgaacatatagaatacagttataatgacagttttaatgttcttctctgctaatttaacatctgtgtcggctttggatttgtctcaatacattaatttttatcctcattatgggtggtattttcctgcatcctttcatgcctagttatttttaattggatgatagacattgtgaattttaccatattgggtacatgatattttcgcattcctataaatgtttttgagttttgttctaggacataattgaattatttgaaaatgatttgatcctctcaggtcttggttttaagctttgtgaggagggaatcaagcagcatttgctctggggctaattatttcccactactgaggcaaaaaacttctgaatacccaatgtcgtatgaatcatgaagttttccagtctggctggtgggaggaggcattattcccagacccatgtgagtgctagttccgtcggactgttctttacgcagccatgggtcattttcccacatgcgtatactaatcattactctgtggagtactcaaggggaaccctctgctgatctgcaggtttctctctgagcagctctagcctctctgttgttctgttctacaaactctagcttccttggtctccctagactttcagctctgtctctccaattgaaggattccaccaggctttgtgtggtttcccccttctgatctgcagcctataaactctctcaagaggataaactagaaaaatattagggtttccttcatttgtttatgtttctcagggaacactgtatttcattgcttgatagccagtatcttaaaaataattgtttcatatattttgtttcttttttattgtttcaggtggaaatgtgtacaggaaagaacctgataggcctgagttgctcaaatcctgagcaatatggtttgactgtgtccccaaccaaacccaccttgaactgtaataatccccatgtcacacgggtggggctaggtgaaggtaactgaatcatcagggaggtttccccacactgttttcatggtagtgaatacgtctcatgagatctgatggttttctacatggtggttcctctgcataagctttcttgcctgccaccatgtaagatgtgcctttgctcctcctttgccttccaacatgattgtgaagccaccccagccatgtggaactctgaatccatcaaacctctttcctttataaattatccagtttcaggtatgtcttaatcagcagcgtgagaacagactaatacactaagcattcccaagaaaggcttgttttcagaagaagtggccctcagctcactcctaggaaccaagctgtgactattctgtcagacaagagtgttttgttttgtttttttttttaatgccaaaggccttgggccacgttgtaacagttggctagtttacattaacagtgtgattaatgatgagtatctgctttttctctggtggtctgaaccttgaataactgaagtcagtcacacagcactatatgtatacatgactaacacgcaattaaaaaccctggatactaaggtttgggtgagcttcccttattggcaactcttcacatgttgtcacacatcatttgctggaagaattaaatgtgtgccatgtaactccattgggagaggacaactgaaagcttgtgggtgacttcctctgaactttgacaaatgcgccttttccctttgtttcttttaatttattctttcaccataataaactataaccatgaatacaacaacttctatatcctgagggtatttatagtaaatcaattgtgcctggaggtggtcttggaacccccaatacaaaatgtacatctattccctagtgtcccaccttgagtgtatgcagaattccagtaagagtatcatactctagtggccactccttcacatggcttaattttatagagcacctggacaaacaatacagaaaaattttcaaaatggcaatacgtaatttctttactcacttttatataggaatcttaggtaaatgtattagagattgatacgtggtcatgggaccatgggctttaaagtagaaaaagttaacttatcacagatactcctgaataaatcagctgcatcagaatatctcagatttccctacacatctatcaattatacatggataggccttgggaatcaatcagtttaacaaatgtctgtggcagactttgcagctctcctgcctcagtatgcactccatccttccttcttagtagcaaacccctattacattttgggagccatagttctcagctacagactataattcccaggctttgacaagccattcagctaagtaccaggaaataatatgcatttagaagtgtgtatcttttaaggagtctcattaaagggagaggtataccttgtttttcctgttcttctctgcttttggagctctagctgctaacttcaacagagaggtgaacttgaggatatcagaatggaaagacagaaacctgttgacaacaaaaaggtgctatacgcactctagtatctatctctggacttcttttacatgaggaataaataaagttctgtcttctttaagccgcttttagcaatttttcccatgttataccccaacacctggtttttacagtgcccaaggtgattctggtggtcaactaggtatgggaaggactgatagtccaatcaacaaggcaaaatattcaaaaccagggtgcatggaaacttcaaaataaaagcatttggcttatgtacttaaaagataagtgggaaatcacatcagcttaagtatttttcttgaaatccatcaaatgtcaaaaatcctaaaccaaaacttactcatttcaaagaatgatcaatggaaattttattgtgccagcacaaaaaaagtaattcattttcatctccattcattgactgctaataggtttctccattttaactgacataatttttttacaatatagcataatgatgtgaataaaatatatccaatgctcctttgcaaactgttttttgaaaatctcccatgcacacaactccctccccaaaatccacacttccaaccagtctgttaaatccctccctcctatcaagccgcagtagataacacatttctgtgctcccaagatacaccatgcaaaacaccctatctctattaatattctaacttgatttctggatgtgttctcagtctaatatatacttcaacaataagacagtttagcaactttttatcaaaattttataatgtcttttattcgaaaaaaattatattaaaaaatgatataagaacattttttaatgttcttatatcagatgactatttggtaatacctgatgttgaatgagagcttacagtatgccaggcaccccttcaagtgtttttcaagtacagatgagaaaactaaatcacaaggagattgagtaacttccccaggaagtaacagagattcttaacccacatattttggcttcagattatggactgttattcactactctgtacttcttctatgggcagctaatattagtttcattttaatgtagtaactcaacgattgctgcatattcactgtaaatactgaaatcaattttgcgctggtgcagctacagaaacaagacctgaaataagtcagattaaagaaaagtctattatatgctgattaagccacaatatataccaaacttcctggtacacattgcttatatagtgttacttcaaatgaaaagaaagagacaaacctcagaaatattgttaaggaagctctagcaggacttgataacaatgagtataggttgtaaagagacagaaaagtaaatacacctcccatattaacaatttgtgattataaggggaatagtatgcacagaaaataaaagttgggatagaaaactggcttagaaaaaaatatttagtactgtttggctcatcacttgaataatggtgtcatcttacaaatgacatataagcagcaacaataacaaaaaactgacagtgaaatacagcatgtctccagtgcctttcaattaattgttggatttgaattaagttcacacatcttgtctaaaaagctaagatttttctttaattgtaaaaaaatcacagatgctctggtatcaaaaatacatttaccattcagaaatgtcaggtaatgctacttccattaaaatagaaattctgggtttaatatttatcaatttataaaatagtttacatatattattaaaccctcaaattcttgtattccaattgaaatccacatagtctaaaattctctgcttatatgcctgtctgccccactagcctttcagcttactgagtatgatgactggctattacccttctcagtatctccaggaacttatataaggcataaatatagagacttgcaataaattgaattgtatctccttagagtgtaagagccacaagggacctctatttacagatgcgcctagtgaagtaaaagaacaatccatattaaagactgagtcaagattagaaccaagtctcctaactctatgacatcaccacactcatacaaaaatatcactacaatgaggctcctgaatactttgaattatccatgactttacattgcctacgagcctacttctgataagaaaccatacttgaaagtagcataagagcaagaattagaagatgcataaataatatagaccagagaggcataagaggtcagaagttcagtgttttggatttactgggtaaaactggttttctttaatttccataggaaagattacaggatgcccacatgtcaagtaattctttaatcattaagtttgctgtttccattgaaatgttattcatctcaaagatatgtaaattatcaccatcactttaatacaatgcttcctacactttctctgtcattttaaagattaagactgaaaataaattaaaagcaggggtatgttgctatataataagaggtaatttcatcaaattagtaacattcagattctaatgagatttctttattattttagacacagaatattttcctaaaggagcatactaaacaaaacaatctaccttttaagacttttcttaaatggagcataccactagaaaacaaacagctattatttttcatttcaatctaaataactgcaataacttccaggtgtttagaaagaggtacctcccaacactacatagttccacgctttctttaaaccttcctaacacttagacttactcaaagatataaacattattccaaaggatgataaatattgcatcgtaattaaggttactgggctggcacagaagagaatttgacttaatgggagacttctgtgatggaaattaataagtttgccacttaattacaaacagtgtgggttgtgagcaacattcatactatttacacacttgttaagatttaagtaagaaaaggcttgataatacatctcttatttactacgaagcaaaattaaaacttgaaaactagaaacaatctatatttaacaatatcacaaagaatgaaatagctccgatttcttttgctttaaaatttgttttactgaatataatacatatttatttttaaaagttttaatccgaatgaatgataaccccctaaaatgcaggttatagagctggatgaagcatgtgaaaatttttagaaacgtatgtaaatggtgtttctcacaatttatggatcagttctgtctatcaattccaaatttgagtttttgtcataaccagaatcttgaaatggtcaaaacatgttggtctagcaaatcaatatctaacatggacaacgctaagtaaatgtccttggttattaagttaattatatattaacatataagtatgtttaatatcaacagtatctttttaaaactattccttagaaaatctttcttgatactgtcttacaattcatcttttttcacattcaggcccattgtttggtaattttaaattacttcaaactatactagaggaactaagaaatccaaatatctagagttttaaaatgttaattcaaactttaggcagccttttaaaaagctgcctttccaagactgctaggcaaatggccaacaacaacattttaactgtccaaaaatctgacggctgaataaaaatttgaattttactagcaaatgaattaagagaaacagctaaagtgttgcttctagaaagggaaataggagaagatggagaggggtgaggtgaaagctagacccagtgggcactggagagaggatagctaacatctatttccaactccctattcttagggagggcttaaaatcagcaacagaggctgtatttaccccagggtaatcaggaagggctacacatcaggatgtcccttctctgcaccatccctcccctaactcccatttactagtttaccatcatatcactgggaggaatagaaccactattccacaaagttgtttgtttatttttaaatgtttatgatatgcatgtactatcatgatggaaatcaaacacatttaaagatgtcattattaaaacaatggaataattcagaaatgattatacaggatccactgggtggcaaggtaatcataacatttcagtgacaatatcttaatcataatggaagtgtgggagaccagaatataccttcccaaaatatgaagggttattgcactgaaggcagttaagaagaaacacaggagagttctctggcctccctttatttgcctaaaagcagtagatagatttacaaagaaaatggtatcctgcccacctctctaccaaaaagaaaaaaggttaaccaccaaagacagctttagacccttatcagcctagcaacagtaccagaggaatttatattaacaagttttactaacttttgtctgccatgcatttgccttctcctcaagttgccatcctttgtcttttcagttctctaaaaatgtactgttctttgttgaaggagctatttcaaaaccacttctgggaaaactactcattctctgggtatctcccatgtacttgtgaaatatatatgttaatcagcttgtttacttttctcttgttaatccatctttcataataggggtatgttccaactaagaacctactgaaagttattactcccttacagtttgtactcaaaattccatatcaatccaaatcagttgccatgggtattaaaaggcactactgatcttgagtaatagcaagggcacctgcatagtcaatgtaatctaatttctccaggaaagttgacttacacaattaaagttaccaaacctaaaattatatttattttaagcccaatatatgtttttatggaagtatactattttagaattgataaaataaagaatttcatagattctggatttatttcactttcagattaactgagaactagactagaattgctttgttttgaacactgtagtgcaaattataattacccaatatgcacctctaactatttgctcctgtagcataattaattcaaaattatacaggactaaagatgcaaagggagcaagggttagactaatataaaattaaccttagatcatatccttgtcattatattttttcagtcctcaatatgaactggttttcttgacaatgacatcattatcattataaagtagaaataaaaagaaaaatgtccttcagtcaagggctccagtgaatcagttttataacacatctaaatgtatacagactttaaagaaaagaaaacacgatatagaatcccaaaaccaattccagtccggtaatccagtttgcctatttctttttccaaatttcccaacaaataaagattctgtcctgtcagctgccaaagtggccggcaaaggacaaaactggtcatttgacatgatgtagagaagtgattgatgatatctcatcagctccctccactgcaaccatctggcctgtggattagacgccattcataccttgcttcatttacacatgtgaaggactccttgaagaaccgaatattaaacatcttattgagaaactcagtgaatacatacggtcaggaaaaatgaggtaacttttgaaggacttcccacttctatacctctatgattcctaattttcatgtcatgtattttaatgtctgaataaacagcaatgtaaaactgagctcatattcatagattttagtttccagttcactactgactttaatcaaaccatttaacctttctatgtccttggtttcaccatttctgaaacggatacatctttttaagactggaaacatgttcttaagtagggaacaagaaaaaaaaatgctctgagtgcatagatccatgatgatccctattaattctaactctgccagctcctatacttacacctgcctcacacctgacccatttcagccaggacagccttccttcacctgtccttggaaaatgatcacctaattcattttctggcccctaaattactggatattgaggtgaaggtgaagggaaactgtaacaaaacttatatgaatttctttatcatttattaaatataatctaaataatggtgtaaaactaaattattaagttgcatgaatgtgaatttataacatgcttattttaactcttacaccataattctgaaccatcatccccaagtacttatgactttctgtcttgatatataattattggtgaaattgcctcatcttctgttctgtatcaaaagcacatttagaggagatgcatttatctttctaaccagactctaagtggtacttaatatagttcccaagatacagcaagtacttaaaaattacttataaaattgaactatggaataatatgttttgttggtaacttaagctttcgaaaaatgtatacaggagtccaccctaatccacggggatatgttccaagactcccccagtggatgtctgaaactgcagatagtattgaaccctacatatatatttgttttcaatgctttttccgttgtaactgagcacttctcatgaactgtaacttttacagcctgtggtgcaactgcaaaacttgcaagaatttctttttccttcttcacagcttcagggacagaagattcattcttaccatagatcttagcaatctcagtatctttccttaagtaaagaattttcacattttcacttgaggaagcactttactgcttctctttggcatatatgaattgtctccatcactactgttgcactctagagccattattaagtaaaatatgcgtttcttgaatacaaaggactccaatattgccacagtcatctgagaactagcatggttactaagtgactagcaggcagggagcttagaaagtgtggagaccctggctggacaaagcgatgagtcatgggctgggcaggaaggagcggaacaatgaaagatttcatcacattacccaaaatcgtgcaatttaaaacttatgaattatttatttctggaatttcacatttaatattttcagacctaaaactacaaaaagcaaaaattggatgaaggggaactgctgtgtttaatttttagtgtgggttttaaaaaattatctacctggttcttttccatatttgataacaaacatcttttcccttcatataaggactgtgcatatctggaagttaagcaacttcatgatagtaacagcttacatttgcatttgttcttaacttatttcttccaaacaacaacattataagataagcagaacaaggatcacgatctcgattttatagatggggaaattagcttaagttcacaaagctcaaaagtgccagaaccaggactttaatagcatatttaggattcttcatatttaggaatagtcaaccccaattacttccttcaactacaaaaatttgaatttaataaatactgtctcttacaaatgttagttatccccagtctcatttattcctaatatcaaagtatctgaggtcctcccctgcttcctcctccctcccttccttacgttctttgtccttcctctttccttccttcctttcttccttccacaaatatcccagctcctttgcagttcacatcaaaatttgtattcattttcttgggctgccattaaaaaaattacacaaacttagtggcttaaaacagaaatttactgcctcactcattctcaagtctagaagtctaaagtaaaggtgtcaaccttgtcatattccctctgaaatctgtaggggagaattctttgttgtctcttctaggttctggcaatccttgttatcctctggctggttgatgcatcactccaatcactgtctgcatagtcataaggctatcttttcatttttttcccctttctttttggagacaaggcgtcactctgttgcccaagctggagtgcagtggtgtaatcatggcttactgcagcttccatctctcaggctcaagcaatcctcccgcctcagcctcccaagtagctaggattacaggcacacaccagcacaccaatctaattttggtatgtgttgtagagatggggttttgccctattgcccgggctggtcttgaactcctgagttcaaacaatccacaccacttggcctcccaaagtgctgggattacaggcgtaagtcatcgtacctggcctggctgtcctttcttatgtatcttcccatcatatttcctctgtgttctactccctataactcagtgcttctgtcatctaccaaccccagggggttgccaccacaccctctacccagattcagtgagaatttaacatctaattctctatgtcttcaactccactcaattttttacaccagtcttagtgacttcaacagactcttggctcatttagcatctgcctctttttactcaccatctcaccaccaataattcttgttcttccaccccactgcagccaccatcacccttggttatagtcttgactttaccatgattatcgcactatctctaaaagctttatttcaaacataccactccaatctttacctctgacaacattccactttccaagaattatctgaccttcctgaaaccatcaatccatggagcgtatcactggtgttttcagtagtcatctcattctcctatgctgacgtccctcagatcagcttccatgatacactattatgacttcttcacaacatccttaattccctactcttctctcactccaactttattgcccaagcaaaactaatccacttaaacttatctctttacatcttatttgcctgaacccaagcagttaaaagtggatggagaacaatccactattatgttcactgctctcatgttcaattcttgactgcaagcatcaagtagaaaataaatactgcctaacaatcctactatacttattattttcattatcctactttacagaaaatctattcatactttcacctgttcttcaaacttttacagcctgttttcctctcaccctcagttggtaatcctgcctcatactcttattgagaaaattaaaaccatccattggaagagggaacttattttttgttccgccacccaatgtgccacctctgtctcaccacctattctaaaccttatattatcaatcctattccctctcaccaaaagaatccctttatacaagtaattatcctgtctatgtctttcaactctagtttccccactgcaactcttcccttaatatatgtacctgctctgttatccctctccagctacttccctattttctgttcccctttacaggaaaacttttctccagcatttcccaatgccattgtcttacttcctcacattctattttcttctcaaaccatttttattaggcttctttccccaatggctattgtcaagctcacactttttcaatgttactaagttaaaagaaatctttatgccctcaactaccctcccaacagcagacaagaaagttgactatatacacatccttcctcctcccttggtttcttggctatcttctcctcttcttaatgcctaaagtcctcagtcccttgttgagctacgctgtctttaagtaatcttactcagtcccaagactttaaataacatctttatgtcaataattcctcaatttctatctccagctacggcttctttacagacatccaaaagtttactttcagctgcctacgtggtatctttactgtgctatctaatagtgatttcaaactgaatgccattacatattaaatttgtgttccccacacctcttactttttttgtttaccaaagttcagtcccacctctttgatttgctttcatttttcctcaaaagcccctagcagacttcttatgatcttctagatttcagttcaaatgtcacctctacagggaggccttctctgactaccatgtgaaaaaagaccctactagccattctgcatcacattttcttggtttatttttacaaaagctcatgatattatctgaaattactgtatattaaagaaattttttttactattgttcctccattagaatgcaattttattgactgcagaattcttttctgtcttgtttgaaaatgtgtttacaacatctagaccagtgcttagcacattaggaaaaaattaatattttagatttaaaaaaagagagtaaattcctgtgttttaaagaagactaaaataacatattgtcaaagagataaatcactgaagtcaaacaataggtggtagccattattaataatttaatacctaatattaattgcatacttgccacatgctggaactattaaaaaggatgaatctgtagtattttcttcaaccacacaacaatcctgtaatgtaagtatgatttctatccccacttttacaatgagaaaactgaaacaaaaaatgtttaagttatttgccaaggtcaaaactagtaagtggcagagctaggctgtgaacattagcactctaattccagagtctatactcttaaccacaaatctatgctgtccttccactacaatcagactaaatattaattatctgttactcatcatcaataaatattataaaggacagaggttatcagtctactgctgtttctgaatttatctgaggtttggggagattttatgtttccaagataacattcattttgttgtgatctcatgatacattagcatctagttttcttaaaatctgttatacttctacttttcttatttgtattcttatttacatttttttattttactcttacattaaaatgttgttaaaataatttgtttaaaataaaacccaaaatattttaaaatgtggaaaaatgtttaaaatttaccaatattcaaacaaatacaaattaaacgaatcacacaaaagtttcacctaattgtttatttaaaaaataatttttattaacacttgaaagggtatcattttatacatactcatacagctgctagcagctatattaattagtagtactatgtagacatcaacttgaaaatatttcaaatccttaaagtagtcatacctaccattgatgattcccttctaggatcctataatattgtgatcttaagcataaaggatgcttaagttttgtttcttactgtccagtcttggaatgaaaggggtgatgggcactaattttcatgagctacatacaaatttttctctgcaaatgtttttatctctttcagaaaagacagagccttaagcataccaatgtctggagtctgggttgcaagtaaactttagctttaaaatgtagcaaaaatcaagagtcattttggttggcacacccaaggaagaagtatgttttgcttcatttaatttgtatgtgggagaaaaatgtgttgagtcaaaagtagttacactcacggaccctttcttctctgagtaccaggaagaaaaaaaaaagaaaatgtacacacacatgctagtgcatatgcacatgcacacacatgacaacccatacttcaaagtaaaggcaggctaggataaaataattctttgagaatctggtctgccagagtggtttgttcttggggtgagggtgagaaggctgggataatataaaagtttccatcacataatgagacagctgcagttagtattacatttactcattctagataacaacctgagatttatccattcacgacaataatctgaggtttatgaatgttccatccaagataacaacctgaggtccaaccttactcttccttttctcccagggcagaaaaaattaggaaccatgcacgctgtcaagccattctccagaaagaaacgctattatcagcactgagttaaaaggaagtcacatccacatcaaagggaactacatccagatgcctgcccgttctgttacctagaatcagtgttaggaagatgaggcaaacggttaaactggttccatttccattttgctccttctgtctttgcaccccaaaatggtccccttttccttttttaaaacatatttttaaagacacttaattcagttgaagcatgcaaacgagaacggcagaaccaaaatgcactatatatcattgagccaacactctcaagtgtatttccagcacaatgctttaagcaaataaaaaaaaattgtgctgaaacattgttcttaataactgactactaaaaaacaaggtaaatgtatgataataagagagaggcttgaatacattttgatatctccactcacaaggaatgttacgccgtgacttaaaactgaagttaatatgaatataaagaaatgcttttgataggacaagaaaacaaatatcaaattatatatgactaaaagtatttagggaaagattacctcgtgcacaggaaagaaatgtactacatcaatattacgtggatgacttgagtgggatgactatgtatctttggggtcatcttttgattttagttttttgtatgttttaaatcttctgtaataatcatgaaaaataatttaaaaatcaaatcggggaaataaagcataataaaagttaacacttttattacactaaggttacactaaaagttaacaggaatgaacattttgtggtgaacggtaacacacgttacccctagagatctgtaaggggaactgaatgcctttcttctttgaactgtggagaagtttaaatttttaccccagcactcctcaatatttggcatagagaaatatctgaaagaagtcccgcaaagctctcaggtcactgtggtacaaggagtcagattagtatagcttgaattctggggaccccattgcttatgccatggttttcacctacaatcatcaatcaacaaacacactgaagaaattggcataaagagtcccatctcctttttcgaatctctggtcttaatttctagttaaagacagcataatcctaaacatacaaaatgtaaatttgttaattccagatcacccttacacagaactccagccatatatagtacgattgaacttttcttgtattctcaggcgaaatttagatttagctacttcatcagattaaaaaagaaaaggcagcaagcagacattaaaaaagtttaaaatcaggtgaataagcacatgaaattcatacagctggtataaatagtacactcaatcctaccaagtatgtaaatcgaggagccaatatctcagcatttccttaatatgaacacacaccaggtcacatttccaaacaatttcaccattgccatattttatttcaaaccatccttaaaagactgatcaacagcaaactcactgaagatcagaaaactcttcacagtggctgaatgattcccacaaggtcagagagcaagggatctatggcatagagcaaaattatccccaggcttatcctgtatcttgggaaatgtacttattttaattaacaaatagtaaatacacattctactattttgctggcaattttcacacgaccttttcattaggcatggtaatgtttctataaattttaacatgctacaatttttcatgtcagtcttaaagaatttcataaagattaagatctaccgggtgagtcaattctgtgtaggtacactgagttgtaagttggaggataaagttttgggagagaagtaaaagtgctgggggctttgaggggttgaggtggaggagaaccagcagagagaggtgaggaataaaacatgggggggaggaggaagtgcagtcagggctccatccatgatcgcctcctatataaatcaggcctggagttgacatgtaattttgtgtgggtcccctgagaagtggccctcagggattaattattgatgaagagatttttcttcaaagtggctcagtcaagagtgcctcaaggggacattcataagtgcttataatatcaatttccaagcacctgggaggtagggacacagattgtctctttaattattatgatggaggtaaagtctagcaaaaatgctgttacacagccaaggtaaaattctcaaagaaatgaaattattatagctagtataaaaagtgtaatatatgagtcatctctcagtaagatcacactttaccttttcctggtgcaaaataggttatctccaaccaactgtttcctaggagctaaaagagttattcataagcaaatgcagtgtgtttagggatgcttaaaagtttagaaaaaaattgtttttgaagctaatatgtttgcttagaaagaagatgagtttactccagttagcacatggaaatacaagggtttgttttaattatgtaggaatttcttttcagaaaaaaattaatgtcaaatgccttctacatttctatgagaatgccaaaaaataattttcacctatgcattagccctgatctagtctcaaaaacactcagaaaaacacagaagaatcaatccatatgtatgttgcagtaaaaaaaggatggggctagcctggatttgaatcttattaacctacgtaatagatgtgaatagtcatgtataaacaaaacctaggccatatacttcctttgtaccatctgaaacttacaccagtgggctcgcagtacaacaggtactaaaaacatatttttagacagaaatgaaatgaaatgggtctctttaaattgatctgaatttcagaaactccccaatctccctcataatattgacaaatgttaattcagtaactttttcacaatagatatatgcaacatttataaatctataatgcacctctttcataatcttttaacttcattaactcctccctttctcatagattctaacagacttcaataccactagttgattactagagcaaaaacaaattcttgccaattgatgtttatataatgtacatgatagacgcagtaataacatttaaaataagtgtaaccaattaaaaaagcatatatttatgtgacaaatgctgtctgaagcattttgtgtatgtgactccaattaatccttatagctattgcatgaaatacataggattaaattcaattcacagaagaagaaatggcagtccaagaaagaagctgaccacagtcacacaaataaaataaaatagtgccaggattctaacccaggtctgtttaaatacaatgttttctttttgtactaaccatgaaaggaagcttgatttggggagatacaaaataaataacttcatataaaagtacttaattcctcaatacatataaatatatatgtattcatggtgaactggctaaaagttatatgttgagtttgaatgcagatgtttcatatgtactagtgtaacattttaattaaaagcaatggaagcagtaataattataaaccacaggaaagacataatcctattaagagttatctcagtagtataattggctccaggatatcagtgaacacccacatgactgatatttgaggccaaaaacaccttctgtcttgatatggaggattatgagcaaatgaagtccagaaggtaaatatgtcacattttaaaatcaaagtcccaattatagataaaggtgtaatcttacaatgccttattaaatatttttaattaaggtggaatataaacaaaataaaattttctttacagttttaaggactgaagggctctgcaacatatttgtcatgcattcatacagctgagaggcagaaaaataaattggccaatcctccattttgatctcctctttagctgtattgaagcctggattatatcaaatctcatcagattttctttgtcatgatattttacgacaatcttttttcagtctcattgtcttctagttttagtgttccaaactattacttacatttacgctaattattagaattctcccacagtgatcagacatctttattttactaggggttccagctttcagcccttgtgttgttgccagtttatacagagtttggtaagatgctgtattcaaatagttaaagaaaggtatgattgcttaaagatcttccataactgaatcagtattttgactctagatcttcttagtgtccttatcaattccttactgttaatattcatctttttttattattatactttaagttttagggtacatgtgtacaacgtgcaggttagttacatatatatacatgtgccatgttggtgtgctgcacccagtaactcgtcatttaacattaggtatatctccaaatgctatccctcctcccgaccccacaacaggccccggtgtgtgatgttccccttcctgtgttcatgtgttcttattgctcaattcccacctatgagtgagaacatgcggtgtttggttttttgtccttgtgatagtttgctgagaatgatggtttccagcttcatccatgtccctacaaaggatatgaactcataatctttttaaaagtgaatttttcttctagaatgtaacaaaggaggctaccaaattccagcacactttacaattaagcaatcagtcaacaccatttgctatcattaagattaagcagatccaatctaaaaatcaccctccatcaagatccatcattagtcattaatctcccagattttaattaaactaccaaaactattcatctgaattcatatgcaaaggatagaatttttctttaaactgcccacaactttggtgggccaagctgaaaggttcgcttgagcccaagagtacaaggccagcccgggcaatatactgagacccccatctctattttaaaaaactgcactgaaacacatatcaacacactcaactacagaaatatgcagtaccttaaaactacaggaagctaccattagaatcagtgactcctcaaatcagataatcagacacatttctactatccagctaaactccttagaaaggagaaacactttaaagtaaaactatggcccacaaaacagcttaaagtaggaagtacaagcatgttttcaacaactctaactcacaaaatagttttaaaaagttaaagctttaaaagtcttaatttatttaagaatatatttccaaaagatctgcagtgcccagtcaataaaaggaaggagaaaagaaatgactgatgcttacacattcagtaaaaatatatccatttaaatcaataaacaactcatggctttgtataaagtggaatctttattatcttttttggatccatgattctccttcctccccagcagcaaaggcaattatgataaaagatgttctgaaaatttttttgccatctctgccaatttataacccatgactttccttgtttcaaaatttgtaaagtccactttctccaagtctttcccattatgcttctattttccaaattcgctatttttaatctcattttcctagttaatcatacagaaaattcccaattaccttttcaaatgaatagaagtcacagtatcagtaattccgaaaccatttctgtttgacttaaaatgcatttgattttgtggacaatggactaaaatccctttttcatttagggtaaatgtgaattaagtttataaccctttaacattcactaactgatcattcaaggaatgggccttgtgattgtgactgtggtagcagtacagtaacagatagcaacttggtttggctacaaatatatatcaaaagtactagtattcaaatagttaaaagcttgctgcagctgcatacatttcgtttagatatatatactttcaaagtctattctcattatccttgccggtggaggggaacaaggtcttgaacaaaagagtactgtttcaaaataattctcatttcctttcaagtgtgcagatattcacaatatactggctgtaaattcaatctaaatgaagaagtgctgttaagttactgctgaggcctgggaaagtgaccaatgtccaatactaaccttctttgaaaccatcccaggagagtttgtattaaagtcatcgttgacaaaattcagactgtatccaaacagtacactcacaaagcaaaataacttctaaaagcatataactactattaacggactttaaaatgctaatcatttcattggaagtgattttcctgagaataagatatatttttctgttatctttattttttaacatttttgtcctttttcccaacaagatgctgtcaacttgtgacatttgtttattatccttagcagattttccatgtgcaattcagagaggctaacttgcccaaacacacagcttaaagttagacctcaatcagaggcagttggtttcagaagccaggctctgaaccacattaatatatctgaaaaaaaacatgatttctcatgcaacttctatgattacaacaacaacaacaacaattctgagtaatgagctaggtcctattaccaagtaacacatcctttccttgcctatctcccagcccagggatattccagctatggagtttggtgatctgattgttttccatgttcctaaccgtcaaatcctgatgtgatattggattcagactagaaattatgaagcaggcacacaaagcacctttatatatacctcaataacttttcccccagaaacaaagatatttcttggctgtttcactgaaacctgaggttctgtagttagctcatagggaaaagtcagtcactattagagtaggttgttatcatcaccttctgttcttttaacaattgtcaagtacttttcacatttatcaatgtgttcttatcacattcattaactgcttcataccaatatttttaaaatattacttgcttatccatgtatttgaagctaaaacaatgatcacaatcagatctctagacaatggttgtaatgaatttgttcaagaaaagcattcaaatttgatggaaaactgagcctttataattcattctaattcttcaacacaaaaatgaactttggtaaatcaataggatcaactgaggcatttatgcttgaatgtgctcccctaagcttaatgtatttttcctcactgcattatattttaatgattaatttcatgctctttcatggtattctagctcatgaatcacgggtattactttgagggaaaagtaaggtgctgtgagtgatgaaagatgttactgattaaagtgttgcacatatgaactacataagagctgaaggtgtttgaacaccagcaatctagattaaaagtaatattaggcaaactggccatatagactaaggttgaattgagtggagggagtgggaaggatgggcttcttaaatgttcttagttgaaacaatatatgaaatcaagcttggcattcaatgtttcactggcatctttctcctcagtagaatgtaagaactgatttcgaagacaactgcagagaaagaaatcagttaagcagataacacaccattctgaaattaaagagccaaaagccacccatcctaagtcaactccgatatcttaaatcaatactgccttaatactgtcagaagcttgtttttcgacttagtaaataaaattttttaaaaagttaagtcaaagtcacaaggaccaaaaaggaatagactaccctaaatgaaatatagaaaaagacaagtatctattatcctgcacacagatgaacaactatttgttaaatatatcatattgctcaatatcaaaaagtcaactctccaaaacagaaaccaaaagtaaactaaccagagatgtccacataatacactttggctcttgttactaaaatgatttttcaaaccaagttatggagcctggagaaaacaggactacttcctcccagaatataaagtttcttcaattacggaggcaaaatgtggcaaaagcagctattttgcaaacaggtggtttgcaaaacttttacttaagccgccaaaaggactgacgaaaggaaaattttgttatttctaaagaaaacacacacacacataattttctaccagagtagaagactcaaataaagaaaagccccaaacaaaacagaaaactaaaaatcagtttgtcttagctcaaaagtgctgacctaggtttagtatgtgtaaaatcactgttgataattaaatccttttcatcgcatatattaagatactagagagaaaggaaatgccatgtcgtttcaggtaggaccttatttacataaaaaaagattttttttaacagaaacggagtgcaagagggaatcaaaaaccgttgagaggagagaaaaatacagttagtttttctgagggcactgcatttttcatgttctgaatacttcgttccattctctccatgttaaattatttcataaacaatactatgactagaggcgactgctacagctgacacacagatgttttatttctatgcttcacctttgcaaatagcaggattcagctattggaaatgggggcagtggaggtgtccagaaacgacatacaggaggtgaaggggtagaacgtgtgggaaatgggcactcctaccccctagagtccacctctctggaactccagtgcttcttcagtcactgacattcagaggaggacaagacaggcttcctgaaatctcttccgaagtaaacaggtcccgacgcaaagggcaacccctccagtagcggaaagtcctcccctgagctccccgcctgcccacgcgggcctgtggctccgcgctcctccgctcccccgcagagctcccacgggggaaactttcccgcgtctctcactctccggggtgcgggggccgcgggggcctccccggcacctacccgcagagcactccccaccaccccgccaccaccgacgagccggcgcgaagtccgtacctcgatgtccgccgagtccttactgagcacaggggccatggcagtgcctacagtctcgagtctgccagtgacaaaccctccttgcgtcctcaagctccagccagagagccaagtgacagcagccggagcgcgagtcgaaaacaggcagactagggccggcggcgcgggggcggagc

SEQ ID NO: 1775 - DNA, 68348 bp, Homo sapiens
cctggtgtggctggctgcggccagaatcggagccccaaccgcgctgccggtgagtgaccagccccaggggacagagacgggaggcctgggaccccccctctccagggtggggcctcccgccgtgtctgggaaagtttgcgggcgccccgggacgcgggcatctccagggccgctcggcgcctccccatctccccgcgcccgccctggccgcccccaggggcgccctggggcccgcagagggatggcctcccggcagggactcctcggctcccctctgttctgagactgctgctgggaccggggtccgactctaaagagaaaactcaaacagcaaaaaaaggaatatcgactcagttccgagggcgggggccggggctcgttctcacccgcgcgcggcccctcgacctctcggacccgggccaccagctctgcgcccctcacgcctccctcggggtctctgtgtctctctcccgctcccggactccctcctccttctgactgctgttatttgggctgttgtccctccccgctccctggtacctcagctcggaccttagcctgtgcctgcagcccggagtcccctcctgccctggaaggcaaggagccaggccacggggccacagccgcgggggccaccacactggcccaaatatttcctgcaggtatgaccattcactgggtattggggttgggtcccttggacccacaaactgaacctcgtgggtacagggaaaaattaaaatatattcctccttaggattgtactgcttctgttggtttggcatctttttatttttaacccttctaactgtgctttcttcgaataataatgatacttcatgtaattagcgtttctaatatctaaagacagaagaaggaagaaaataaacggaagagagagaatgcttgctaaaaatactcatttttgacttcagtccacactcgactgttttcctgggagatagaagttcagtgtagcttgttttcagactaaccgcaaacacgattacagcctcctccaggctagaagttttaatttgcctgacatgcagcacactgtttgttggtattcccagcctggcattcccgtctgcatagctctagtctccctcccaactcccccacccccactttctttctcataaaagggagctgtgaaaacaaggcaatgggagaggctcaaacgagctggaccacataataaaaacagccctacttattttaatcctgaggctatggactcccctggactctgattgggtggaagaattgtttagttcatttgtgtggtttttctgtcagtagttattatggttgaatcagtgtttccatgacagtcttgcttctgtgggcacgatggggagcctgttaattctcggatgggtctggacagatcaagtctggagtctggagagatttttcagggcttgacctgggctgatattgcaaacctctgcacactcactcagaaccagagcagccgggagcagcctgagctggggttttcttccacatgatctgggaagaaaaagctctaccaaggagcgaactgtgtgagcatggttgctgggggatgttgaatgttttacgtttttaggaagaacacacttctcaaaactttagccattcctgtttccatacaaacaataaatgtggttgtaacaaatgtagtagatcagattctgaacaaccccttaaaaaacaggtccaagtattgaaccatttggaaataaagattttattttatttgaattctactggaaataaaagagtttatgttaaaaaggatgtaattcacttctctccactgatgcagtttgacagttccccattggtatgaatcagttaggttttattgtggtctcaaaacatcattaaggcagggcacaacatcattaaggcagggcacggggttcatgcctataatcccagcattttgggaggccggggcgggcagatcacttgaggtcaggagttcgagaccagcctggccaacctgatgaaaccccgtctctattaaaaatacaaaagctagctgggccaggtggcgggaacctgtaattcccagctacttgggaggttgaggcggaagaatcgtttgaacctgggaggcggaggttgcagtgagccgagattacaccactgcactccatcctgggcgacacagcaagactctgtctaaataaataaataaataaataaataaataaataaataaataattgataggcaagtgttgtgactgtgacttccattcaaaaagtaagtccaaaaaaaaaaaaaaacaacaaaagtaagtccataaattctgagcttgtttggccctgttgcttagaaaaacaatgtactgtgctcagataaaaatcttcagtctcttcctcttcctgagaatttttaatagtgcatttaatatcctgtaagtcaaccttatactgtttacagaaaagttgcctttctgccttgtccagcttttgcactatctcatgaaatattgttagactggatggtttgccacgggtacaagagtctgcccagcagcccgaggagaggctggggttgtaatgaaggccacgggggcctggacctaaggagcaggtggtctggatggtgagatgaaggctacatccccagacagccacagaaagcagccactgatcacctggacaggtcagatgagttggaaatatcaatacatgaagtgtgggaccagtggagagcaaggaaggcagaggtggttaagaagcaaaatgatacaaataaataaaaaaggaaaaggccaggcacagtggctcatgcctgtgaagtgctaggtgtggtgattcatgcctgtaaccctagcactgtgggaagtggaggccagaggatcacttgaggctaggagttaagaccagactgggcaacaaagtgagaccccatctcttaaaaaaaaagatgggccgggcgcggtggcttccgcttgtaatcccagcacttggggaggccaaggcaggcagatcatgaagtcaggagttccagaccagcctggccaacatagtgaaaccccgtctctactaaaaacacaaaaattaggtgggcatggtggcgggcacctataatcccacctactcgggaggctgaggcaggagaatcacttgaacctgggaggcggaggttgcagtgagccgactgcaccactgcacttcagcctgggcgacagagcgagactccgtctcagaaaagaaaagaaaaaaaaagatgtaggccaggttcagtggctcatacctgtaatcccaacattttgggaggccacggcaggtggatcgcctgaggtcagaagttcgataccagcctggccaacatgatgaaaacctgtctctactaaaaatatagaaaattagctgggtgtggtggcaggcacctataatgtcagctactcgggaggctgaagcaggttgcagggagccaagattgtgccactgcactggagcctgggcaacaagagcaaaactccgtctcaaaaaaaaaaaaaaaaaaaagagataaaagatgtaaaataacccaaaggaatactctgtgaccttttaaaatcatgttgtataagaatgttgaattacacaggactttttttttttttttttttgagacaaagttttgctctcgttgcccaggctggagtgcaatggcgtgatctcagcttatcgcaacctccacctcctgggttcaagcgattctcctgcctcagccacccgagtacctgggattacaggcatgtgccaccatgcctggctaattttgtatttttagtagagatggggtttctccatgttggtcaggctggtttcgaactcctgatctcaggtgatccgccagcctcagcctcccaaagtgtcaggattataggtgtgagccactgtgcctggcctggggttaatttttgaaagcaagttataaaatggaaagcactataattttactctttgaaaatacatcgagaaaatactggaattatgtgcatcaaaatggatggtgagagtatagctgtttttaaattttctttgtacttgtatttctcaacttttatagtaataatagctaacatttactgagaactaagcacttacatatggtattttattcgaaaactctttgaggtaaatattactattattttcattatggagtttcagaaactagaaccagaagggtaactcatccatggtcacacagccactaagtgctggaatcaagtgttgaattcaggtcggtggctaaagtctatgcatctctgtcactactgtctaccatctccctgcacatgtattattattattttaattataaggaataagtagaaaaggaaagggaaaatgtttcatgctttagtaagaactgatgggcacagtggctcatgcctataatctcagcactttgggaggctgaggtggaaggatcacttgagcccaggggttgaagactaagtggcacaaattagtcaggcatggttgcacatgcctgagtcccaagtactcaggaggctgagctgggaggatcacctgagcctaggagatggaggcttcagtgagctatgtcacgctactgcactccagcctcggcaacagagcgagaccctgtctcctaagagggggtgaggagggagaaaaacaaaaacaaaaacacactgatacgtaaaatggaaaatgcctcccatctcttccagctccgccagtcacttctctttagaagtctttggtaactgctccagatttagaggtagctcaccccttccttgcaaaccagctccactcacaagaagaatcccgaattccatggaggcttcctggccagcctggaattccaggtaccttatgggattctggagcagtcctcagtacagggcaagatttttaaagtagatcaggcaaattatgtcttcagagctctgcagattacagggtgtcatcattctttgcagcgtcaggagagtgtgataggtagaaagacccagggaaagcaccgaggctcaaatgtacctgtgtgttacatggaatgccaggggaaataaagggtttaccatggaataagaaagagaaaaaaaaaacctcattgctggatgcttattactatgaacacacaacaataaattatctttcgaaagcttgcctatgtgggtgatcccatgcattggtgagtttgactgattgggtgaggtggaaatatttagtgtgagtgattctggggagagctctgggaaaaaatgcccacatcctgtactaccatgtcccctcacaggcaagcagctcctgggatcactcatccattctctttgtggaaggtaccttgagatccccagaaggatcagcattcttagagcccctggcccatcacataacaaacatgccttaagaagaaggctttcagctgggcgcagtggctcatgcctgtaatctcagcactttgggaggccgacgtggggggatcacctgaggtcaggacaagaagtctgatcacaaatgattgtcattttattataatctgccttctccctggtagcttttaaaattttctctaaaatgttccacaggtatgtctaggtatggatttagaaaattttatcctacccagcagtcagtgagcatttgtgattacacaaatttgtgtagctgggcacggtggttcatgcctgtaatcccagcactttgggaggctgaggcgggctgatcgcttgagctcaggagtttgagaacagcctgggcaacaaggatgagaccctgcctctacaaaaaatataaaaattagctgggcatggtggtgtgccctgtggtcccagctacttgggaggctgagatgggaggatcacttgagctggggaggcagaggttccaatgagctgagatcaggccactgcactccagcctgggtgacagagcgacactctgtctcaaaaaataaatcaaaaaacctaaaaaccaaatttgtgaggatttgtgattacccagtgagctgtgtgaccttgggcaagttgccaagttctctcagtctcctcatctatgaaatataaataatgatagtatctattacaaagatactgtgaagagatagtgcatgaaaatgtcagaatacgccaggtgtggtggctcacgcttgtaatcccagcactttgggaggccaaggtgggcagatcacctgaggttaaaagttcgagaccagcctggccaacatggtaaaaccccatctttactaaaaatacaaaaattagccgagtgtggtggtgggtgcctataatcccagctactcgggaggttgatgcaggagaatagcttgaacctgggaggcggaggttgcagtgagctgagatcgtgccattgcactccagcctgggtgacagagtgagatgccatcttaaaaaaaaaaaaaaaaaaaaaaaagttagaatagtacctgctatataaggaagaacgcaaaaattgttagctattattacttttttattttttcagaatttctgggccatcttggatttgaccaatttatataaacgttagtttgtctagttgcacacacacagaaaatcctgttgagattctctttgaaattgcattcaattaatactgacatctttacagtgctggcttttcctatcttctccttttattcaggtgaatgattactggtgatttcccctataaatgtcttctacaacttttgctgtatttatatcttatagatttggttgatattttaaacaatatcttttgtcctagtatattctctagtttacttgctggcccatagaaagaaacattgctgatttttgaattttgtttttttacccagcatcccagctgattctcttattagttctaatagtctgcatatagataattcttgaattttctatatagacaatcataaaacaacgataatttatcttttccatttctgtgactcctacatctttttcttaccatactgcattggggtagatggtccagtacagtgttcaatagaactgtgatgacaggcacccttgccttgtcttcttactgtctttaactttaactgctcttaaagtttctccattaagcgtgaagtttgcttaaggtttcagtagatagtctttattaaactaagaactttgctctattcttaatattttttaacaaggtaaaaattatatcatgacagtatatattttacttaatgctttaatgtctttttcataactatatgagatgatcattttttcttgatattacattgtgataagatgagcgtattaattgtgttgaaacatgtacataaatatacatatacaggtatattattctgtagggtatcggttgctagtattttactttggatttttgcaaatgttcataagtgaagttgttctagaattttctttttaaaatattggtctggctgggtgtggtggctcatgcctgtaattccagccctttgggaggccgaggcgagctgatcaactgaggtcaggagttcaagaccagcctggccaacatggcgaaaccctatctctactaaaaatgccaaaaattagctgggcgtggtgacatgcacctgtaatcccagctactcgggaggctgaggcacgaaaatcacttgaacccgggaggtggagattgcagtgtgctgagattgcaccactgccctccagactgggcgacagagcaagacttcatctcaaaaaaaaaaaaagaaaaaaaaaggaaaaaaaaaggaaattgttcttatattgtttggtatcaagcttgtattggccctataaagtaatcataagtatatgtctttctttatcttttttttttcgagacagagtcttcctgtttcccaggctagagtgcggtggcatgatcttggctcactgcaacctccgactcccgggttcaagcaattctcctgcctcagcctccttagtagctgggattacaggcacgcgccaccacgtgggcccagctaattttttgtatttttagtagagatggaatttcaccgtgttagccaggatggtcttgaactcctgctctcatgatatcccctcctcggcctcccaaagtgctgggattacaggcatgagccaccgtgcctggctggcatatatgtttttcttaactagtttgtaagagataaagattatctgtttcttaaaatttggtaaaactcattacgaaatcatctgaaccacttataaagggcatatgggtcaagtttttggtgattcagtttcataaatgattagtgatgaatttaggctttctattccttcttgattcagttttgataatttagtttagatgatccattcatgtgttcttgggcttcttagcatagttattcgtaattttctcttagggttttataaatattgcctctatcttttttgttttttaatttttttattacctttcctatggtgctgagaatctagcttatatttcttatttatttatttaagacagagtctcactctgttgcccaggctggagtgagtcatgcgatctcggctcactgcaacctctacttccagggttcaaacaattctgttgcctcagcctcccgagttgctgggattacaggtgtgcgccaccacacccagctattttttttttttttttttttttttttatattttctgtagagatgcagttttgccatgttggccaggctggtctcgaacttctggcctcaagtgatccgcctgccgcggcctcccaaaatacttggattatagggatgagccactgctctcggcctatttattgattttttagagatgggatcttgctgtgtcacccactgctggagtgcagcggcaccatcatagctcactgcagcctcaaactcctgggctcaagctatcctcttgcctcagcctccctagtagctgagactacaggtgcgcaccactatgcccagcaaagttttgtattttttgtagagatggggtcttgctatgttgaccagactggtctgaaactcctgtcctcaggtgatcctcttgcctcagtctttgaaagtgttgggattacaggcatgagccaccactccttgccctttttttattcttaatattgtttatttgtgccaactctctttttctttattaatatagatgtctactacttaatcttttcaaataaacagcttgttcttatctatatttttgtttttcattatttttacctttatctacatttcttctgtttctagctacttgaattcatgcctagcttactttttgtttttcagtaaatttatttaaatctataaatttacctctaaatactgctttagctacatcatgcaagttttaacccatgtgtggtgttatgatatatgttttcttttttgagatgggatggagtctcgctctgtcacccaggctggagtgcagtggtgtgatcttggctcactgcaacctctgcctcctgggttcaagcgatcttcctgcctcagcctcctcagtagctgggactacaggggcatgccagcacaccaggctaatttttgtatttttagtagaaactaaagttcctgggctcaaacgatcaatgggcctcagctttctaaagtgctgggattacaggcgtgagccactgtatacatttaaccttatttcttgcatgtactacacgcctgatttcaaattttataggccactcattttctactctttgcccaagcagatgacaaggtttctggctgttttctcaggttagtaaatgatgttcctctagacctatttcacatatggagcagctttttatgacctccagctttttgtaagtgcctcactaacagctcatggtgtaaggtgaccatctcctggaccccctcactgcatgtatggtcattaaagccccagctcgcaggtatttaggcctcttgctgcggtggatttctctatgagccccttggcctcagcttccatacattgacctaacttccacttccctctgtttctggtacctggagatttctactttatctaggttttagatgatatttttgttatcatatttttgttcagtgttttgaagtgtttggatgggaggatgtggtgttatgatatatactagtttttatccatggttcctggctcataacaccccacagcccttgttacagtttttgttgttataatactgggtgtgttaggcctcagaggcagccctctgaccttctgccctcctttcacttaccccaaggcaggactctaatgttccgcctgtgagagtgttgatgcacccaatgccctggaggaaggaatgctgacattgtgaagcttccataaaaacccaggaggaccgggttgatggagcttctgaatagctgaacacagggaggttcctggaggatggtgcacccaggcagagcatggaagggctgtgcccctttcctcatactgccctacacatccgcttatctgtatctttcgcagtattctttatagtaaaccagtaaacctaagtaactttccctgagttctgtgagctgctccagcaaattcgctgaacccaaagacggcgctcttgagcctcaacttgaagtgggtcagtcagaagttcctgaggctcagacttgtgactggcatgtggggaggggcagtcttgggaactagccctcagcctatgggatctgacactatctcagagtagatagttcattagaggacacccagctggtgtctgttgcttggtgtatttggaaaaagcccccacacatttggtcacaagaagtcttctgtgttggtgattattatggtgtgagagtggaggaaaaacatggttagagagtttttcctatacagagggatatttctacccaatccgtcatactgactgaggttcttaactcctaattaacttaattaaattaactcctaatttaaaagtttattttgggccgggcacagtggctcacgcctgtaatcccagaactttgggaggctgaggcgggcagatagcttgaggttggggagttcaagaccagcctggccaacatggtgaaaccctgtctctactaaaaatacaaaaattagctgggcatggtgttgtatgactataatcccagcactcaggaggctgaggcaggacagtcacttgaacctaagctggggcggaggttgaagtgagctgagatcctgctactgcatcccagcctgggagacagtgtgagactccatctcaaaaaaaaaaaattattttcttatatgtaaaatagaatacagcgaagtcggccgggtgcagtggctcacacctgtaatcccagcactctgggaggctgaggcaggcggatcacttgacatcaagagttcaaaaccagcctgaccaacatggtgaaaccccatctctactaaaaaaaaaaaaaaaaaaaaatacaaaattagtcgggcatggtggtgcacgcctgtagtcccagctacttgggaggctgaggcaggagaatcacttgaacctaggagatggaggttatagtgagccgagattgcaccattgcactccatcctgggtgacaagagtgaaacttcgtctcaaaaaaaaaaaaaaaaaaaaaaaaccacacaaaaaaacagaatacagcaaagtaaatacatgtacattggctcctgcatgtgaaatctcctgctactaagagaatgcgggagagaagaggtctgaataaataataccgtgtgccactgccaccatctggaaccctgcacgcttactgcggtgtctcactctcatctggccaatgttttcagtccagaaaagatctgaatttcccaaccatgctgctccagtccctaaatgctgtcctttagattctctatagtagatcaaaacctcatgctcaactagcatcttaactcacatctatgttgaaaagaaaaaacatgtggaaaagttcctgttgtccttggatatgaagacgatgttctgtttctgctgggcatgcatgtgtacgtgtgtctctaacagtgcagaggtttacagtgagcaattgattctttacttgtggctgattccatctctgggaatgttgatccatatcagtggagcctatttataatgctgaaagcagtctacacaaagatattttccccatagtcattggccttctcctctggcccttttaagagctttatcagtgtccttctatcagtgacaatgggaaagaaatgggctttggagtcaagcagatctgggtttgaatctaagctttgccactaattagatatgtggcctttggcaagttacttaacacctctgagtctaaattgtcttctttataaaacagtaataacaaaatccacctcaaaaggttgttctgaagatcaagtgagataactggaaataatataaccttattataagcattatgttaatgctcacaaatgttagtttcctcccattatctccactctcctattcttattctttcaaagtagaattgtgcttcaggaggtctaatcaggctaggcatggtggctcaagcctataattccagcactttgggaggccgaggtgggtggatcacttgaggccaggagctcaagaccagcctggccaacatggcaaaaccccatctctacaaaaatacaaaaattagccagacgtggtggcacatgcgtgtaatcccagctactcaggaggctgaggcacaaggattgcttgagccggggaggttgaggttgcagtgagccaatattgcaccaaggcactcccgcctggacaacagagtgagactctgtctcaaaaaaaaaagaaggtctaatcagagacacttttggggagtggccgtggttactcctaatatcttgactttttttttttttttttttttgagatagagtctcactttattgcccaggctggagtgcagtggcatgatctccactcactgtaacctctgcttcctgggtttaagcgattctcctgcttcagcctcctgagtagctgggattacaggcacctgctaccatgcccagctaatttttgtatttctagtagagatggggtttcaccatgttggccaggctgatctcaaactcctgacgtcaggtgatccgcctgcctcggcctcccaaagtgctgggattacatgtgtgaaccattgcacccggccatatcttgatatttttggtaatcaatttagatttattttgggcgaatttcctgaaactttttggacagccagtttattttgcttctgtaccagctgttatagccctcccagcctattgttggatctttctgtagagtagctatgttgttacttaagaaccatgtccctcttaaccagaaatatctctttgccttatttgttaatgctcctgccttttaggagataaaaactctttatttcatttttaaagataacttttttttttttttttttttgagctggagtcttgctctatcacccaggctggagtgcagtggtgggatctcggctcactgcaacctttgcctcctgggttcaagcaattttcctggctcagcctcccaagtagctgggactataggcatacaccaccatgcctagctaatgtttgtatttttagtagagatggggtttctccatgttgaccaggctggttttgaactcctagcctcaggtgatccgcctgcctcagcccctcaaagttttgggattacaggcgtgagccaccactcccgacaacgataacattttaaatgaaaagaccccagagagactatgtaacatgtaaatataagctagatccacttctgggactaggttttcccaggagggatcatgaagtccccaagtgattgaggagtaggtgggggtagggaatcaccaaaggggtggctggaggagatagaagaactgaaggtatttttttgagaattttacaagacctaaaatctgcctgtttcacaacagtcatttatctgggccctgtggaatctgtatttggctcagaacatgttgctttttgcaagtatctcatcagaaataataataatgatgatagctatgactattcttttttttcttctctggattttgtgtgtgtgtgtgtgtctgtctgtctagacctctgatcatgacttcttaaggagaggaaaagactatcatgaaaataaaacgtaattggaattatggatttgccttcatgtaaatatctgtggctcagagcacaaaaatagcttttccattgcagagctaagtcaggagtttcatgagaaattgagcattgatgatctaatttaaaacagctatggcccagaaattcagagaaagggctgacacattggcctctgtttatacctttgaatattttcttcctagcttatggtaactcatattcagggacagtttggagggatgataaggccataagtttttttggtttgttttcgttttttgttttgttttgtttttttgagacagagtcttgctctgttgcttaggctgcagtgaaatggcatgatcttggctcactgcaacctctgcctcccaggttcaagcgatcctcctgcttcagcctcccgagtagctgggattacaggcacccaccaccatgcctggctagtttttgtatttttcgtagaaacaggggtttcaccgtgctggccaggcttgtcttgaactcctgacctcaagtgatccacctgccttggcctcccaaagtgctgggattacaggcgtgagccactgagcccggccataaggtttgatgctacaaaccttgtttttgttggcattggtttaatgttaacacgaacgtagagaaaaattttaatctcaatcctttgcaaccaggaatccctcctagtgtagctccaggcctgttgctcatttgtggcttgaggcagagccttatacattttgtgaaactcccggtgactcttgttagtcttggtttcagcagagggtgcctaattgaggtcattctcagcagcacactggtggtcaggtgctcctgattttcagaaaaaattaccttgtttaaaaaaatgtgatcaggctttcctgggaattgtctgataggcttggacttgcctaggtcaacatttttattcggtaaggcaggaaattgttgttttaggcatctgacatcatctttatcaatcacctgactataaactccaagtgagaatggctttataacacatgtgatggggtttcgccagctttcaacagcccctgcttgtcggtattggcctcctctgcacccacatattcccatctctgccagatgttctgacttaactgctcacatgtgtgcaaccacacgggcgcgcacagaccccggccagacatgtgtccctgctacaaactcctgcccctagcggctggcttgctgtctgtctaaccagaggggccatctttccatgattctttcgagggctgcctcagtcactctctgcctttggagacggagacacagaatctcctcaccagacaggcgctggctcctttagtggtttcctcatctgcctgtgctcctcactctccatggctatgtatcacctagttcctttaaccttatccttcctggaacttttctgtttgtcttctgatttgttactttgcttggacttgacttctcagtccttcccagcactgacctcactttgtttaggacttctctacctccacccctttgtgatgtatgtggctcaggcattcagcccccacttaatgagcagctgctctgtttcaggtacctacatatcacaattggtcatgatgctaaggctgacattactttctggggccaccaagtcactgtggagaatgatgagggtgatgttgcagttctgcaaagctttggggaaatttccccatgctgtgggatatgtatatgaaaaacaattctttctctcctcttatatttcatacttaaaaaataaatgtgtaggggcagagttgtcaggtttcaaccctcatgtcttacctgagttcctgccatagcctcctatctgacattcttgccattggccttgccatcttccggtctgtccttcactctttctaaaattctgatttgaccctgtttattgtctcttttaagtcttttcactgcatcctcattttcttttggataaaatcaagctctatcgtgagacagaatggcttcttcgacctcacttgcctgtagttctctccctgtgtcacctgcattaactcctggctccagcttggctgtctccctgcagtcaggctctctcctgcctccctgtctttgcacacacactcagctctgtgcactctgttctgcctgagcatatcagccttcaagatttagctctgaagctcatgtttccatgaggtgtttggagttctccaggacctgcatctttgtccccccatcacagttatggacacttgccaccatcattcctgccaatcttgattaggcatctggctttgtgtcccacagaacactggatttgtctttgtcacatgaacaaagtacttcagaattgtctcctagacagaaaatgccctaagctaaaggactatgatgtgtttttacttgcagcagtgtatagcatagttttaagagttgtcagttattgctattgctgttgaatgaatgcatggaagaattattatttttagagatggggtgtcttgctatgttgcccagtctggtctcaaactcctggcctcaagcaatcttcctgctttggcctcccaaaatgtggggattacaggtatgagctgctgtgcctggctatacaagaatcaattcacacacacctttcaccacattgcatgaacacacaccaagacatagatcccaatgggcagcttacttcaaatcttactgagaatatttacaaagcacatagtaggtgcttagtgagtttctgttgagtcaaataaagaatgaatgcacatccacacaaactatggaaaatatactcagaagagaggcataatgtaaccttacttccttttaactacagaaagaatatggggctggaaaataagattagagctcatgtttatcttctcagctatgttactccaaatgaatcagttgatctctctggactcttatttcctcatctctcaaatgaaatgttagaaaagataatatttaatgcccattgaacagtctaacttcaatcattattaggcttaaagtcaaatgaccggtgctttacattaagtggcatgaatttgggactctgatttttaggcctcaccatggagtgtgttcatgacaggcccttagcactgggcagagctgcaaagatgagaccaagagatggaccagagttcgcctaaagtgaggcaggaggccacaacctagttgttaagcaaacatagagctacgaggcatggccaggatgagaagccctgaggcggggatagcagtcagtgtcccatggtcgtgcggggtcaaagctggcctgagatcaccaggaaacaagtgtggaagcaggctgggcagtgtgctttcagggatatgctgaaaatgtgccctgctctcagggaagacttccagaaatctctgtgaaagccatcaatgccagctgtttgtctcaagttatctgaagggtggtcaagtgaaaagtgtttagatttagttgatgtctcccggagcatagatagaagccgggaggaggttaatttgcggttaataggaaggagaaaagtttaatcttgtctacatgataatgagatgaactcacttatacagtaatgaggtctccttcattggaagagtttacgcagcacagggtaattcctcatcaggaacattgtattagggatttctgaattgtgagcattgggctagatgcgttttaaagtttttttctgcttctcatgtccttaccaaatcaagtctaggtaaacactttcagatcccatagcccttccttttgtgaaatgatctcagcatgccctgatgtcctggtgaccagcctttggtaactctttagtctttgaatgtcccccttaaagtggagctccttgaatgggacctcatgtgccaggatgtggcttggccagggcctttctagggacatgacacaatttttacaggtagtggacttcatttattatttcctcatctattttctcgctctgacctgagctgtaaaagcacatagcattgagccttggctgcttctgctacatgcttatgccacctcaggtgatgggagacttcctttccttccattccacttttgtctgctggggaccctggggtaaatgtaatctagacagtgactctgaggctctgtactgggaacttccatggcattccattcttgctttctcaagagcctcatactttatgccaaatgcttgctttctctgtcttttgtttcctttcttctttcatttttctttttttttttcttttttttcttgagacaggtctccctctgttgcccaggctggagtgcagtggcgtgatctcggctcactgaagcctccacctcccgagttcaagtgattctcaagccccagtctccagagtaactgggattacaggcgtgcaccagcatgcctgcctaatttttgcatttttagtagatgtgggggtttcaccatgttgcccaggctggtcttgaactactgacctcaggtgatctgcctgcctcaccctcccaaagtgctgggattacaggcgtgagccaccatgcccggcctcatttttcttttttatctcttccttctaaaccctccatgcccactgaatactacaacatttttactgcacagtgtttttcttttcaaactcttggccctcttggtatccgagtgaataggaatgtgggcggcttctaagctcctttgtgcacatgaagaaaaatgcccagagaagttagtgacttgcttaatttactggcagagtcaatgagcccggaacccacatttcttgatttccctcaccgcctctgtcttggagatcacagtgcatttgctaatagcactggagtcacaaagaacagcaagctgttttccctctgtgtggtcattgtaccaaaagaatttatccgggaaacaatcccaggcctccatagactcagtaagaccacactaaagtaaactaaaaagagtaacaagagcagaagaatttatcaagtgcttcctatttttcaaagaaactttcaagtccattgccttatatgatgctccctgaagcaccttaaggtagaagaacccgcaggagcctccttttgtaagtaaaggtcaaggatggagtccaggcctggggtgggtagaggaggttgctggtccacaaaccttccatggaactatgcttcagaaaaccagggaaagggaatgaatgagttgtttccatctggtatcaaagatgtgggtgccctgaggacagacctagggttctggtttgtcagtggttcaagaagcatcctaggccgggcgcggtggctcacgcctgtaatcccagcactttgggaggccaagaagggtggatcacctgaggtcaggagttcaataccagcctgaccaacatggtgaaaccccttctctactaaaaatacaaaaattacccgggtgtggtgatgggctcctgtaatcccagctacttgggaagctgaggcaggagaatggcttgaactcagggggacagaggttgcagcaagccaagattgtgtcactgcactccagcccggacgacagagtgactccatctcaaaaaaaaaaaaaaaaaaaaaaagagaaaagaaaaagcagcctaggtccaggtttggaggtaggaacctggctgggggtgggtggggtggtgggaccgactcttgtcctcaacatcaggccagctccagctgagcagtttgggagaatataagtccagacaggagggaagagtactggcttgggaaaccagttgttaagacatgggacagcagggcagtggccccctgggcagtgaggtgacttctgggatctagtagatgctctagttgaggattctgaagtgtggagcaagacttgctctcaccacatgggagtcttgtcagaatcttaggttattcagtcatttattcagcagctatcaacaagtactcagtgaatataaatatatcttaagcatatttatatactgggcgcggtggctcatgcttgtattcccagcactttgagaggctgaggggagtggatcacctgaggtcaggagtttgagaccagcctgatcaacatggtgaaaccctctctctgctaaatacaaaaaattagctgggcatggtggtgcgtgcctgtaatcccagctacttgggagcctgaggcaggagaattgcttgaacctaggaggcagaggttgtagtcagctgagattgcaccattgcactccagcctgggcaacaagagtgaaactctatctcaaaaaaaaaaaaagacaaaaaccccacatatttatagtgtttcttatgaggatatatatgtgtgtgtatatatatattatatatatatatgtatcttatatatttactctttttaatgcacataaccaaaccatgggaatatgtaatattattctctattttatgaattaggaaactgaggctcaaggatgataactggttagctcaaagtccaaagttcctgtcttctgaattctttcactgatgtttatagctgctttccacatgttaagcagttcctaaatttcaaggtgtatgcctggaagaaaatagaggaaaacaccttcagagttattgctcaaggcattactttatctttagggactggaaaacctaaacacataactgaaattcaacttgagtcctttttgttcaacctctaagtgagcaattgtatggttggcattcactctttttcttttctttttacttaaaaaaaattttttgtaactattttttctttcttttactggtttctgtatttattattattattattattttttcaacttttagatcattttagatctaggggggtacatttgcaggtttgttacctgggtggcattcactctaagccaatcaagaacaacttcttcttaaacctggaattaacatctatgctctggtgtgtcctgacttgtgtcaggcaccctagttatgtggccaagtggaacatcgcaacagggagaatgggttggactatagatgggtgtttcctgggtaaatttgttatgggtgagaggcttggggacatagtgcaacaaatctgagtcctcctgcagtgaaggaaggtcatgccccaatgcttccagggctggggtatgcaattgagctcatagttcaagttcccttccctactttccatggcctgtgccatgaccaagggccaagcccctctgaccctgcccctgcccctggccttgtcttgttggctcagcttgatgccctagataccttcctaaccttcagatggtaaagtctctgccagctgtggctacctgcctgattctggggacggggcgctttgatggagatcctgagctgtctggaagtgaatttttctctgacagaatgtccttttgctgcttcctctccctttctttcccagccagaagcagttagtctcccgcattttccttggcatggctcttgccttgcaaggagcatgtaaaaaactctgggatgagtcagaacctggctgaagtgtcaggtacatttaccaaacattgattggactccaggccctcagcctatgccagggcagagaacccaggcatgaataagatcctatcatcccctgtgctggagttgctcccagcctagagacctgaggagacacccagcccactgtgacaagtgatgttgggagctccaacccggattcctggtcagtcaccaacttcacctactctgagggttagttcctggtgtcctgtgttttgggtggactctccaggtcctgacatctgccgtgggaacccagctctgctttccatggctgcattgcctgctgctccagtgatctgttgctgcagagcagctactccaaaatgttgaggttttcatcagcagatgaatggataaacaaaatggggcatgtccatgcaatggaatattattcagccttaaaaaggaatgaaatattgatgtaagcttctgtatggatgggccttgaagacataatgctatgtgaaataagccagacacaagaggacacatactgtatgattccatttatatgaggtacttagagtagacaaattcatgaagacagaaggtagagtggtggttgcaggggctggagagaagatgaatgaggactaagtgttttatgggtgcagagttttagtttggaaagatgaaaaagttttagaggtggatagtggtgatggttacacaacaatgtgaatgtatttaatgccactaaagtgtacacttacaggccgggtgtggtggctcatgcctgtaatcccagcactttgggaggccgaggtgggcaggtctcctggggtcaggagttcgggaccagccttgccaacatggtgagagcccgtctctactaaaaatacaaaaaaaaaaatttagcagggtatggtggcaggcgcctgtaatcccagctactcaggatgccaaggcaggtgaatcgcttgaacccaggaggcagaggttgcagtgagctaagatggcaccactgcactccagcctgggcaacagagtgagactccatctcaaaaaacaaataataataataactaaataaaagtgtacacttacaaatggttaaaagggtagattttatgtatgttttatcacagaaaacatgtagaggttgaaaatcacaatttaatattttctcttctggttctatgggttgactgggctcagctgagtggttcttgcttgaggtttctcatgtagttgcagcctgatggcaaatggacatccaaggtggtgccttggagtggctgctccatgtggcttctctatccagcaaagtagctgggcttcttacatggcatctcagactctgacaagtcagaaacggaagcttctgggtcatttcaggggtatgactagaattgtcacaacatcatgtttgctacattgtatggtcagagcagtgacagcgcccaccagatccaagaggaggggaaacagagtcttcctcttgatggaagaggggcaagatgacatttcagaagagcagggtatgaaagatattgttgctgtgccttggaaaacctccggcctgaaggctcaagagtttagacagaaaggcagcttcagggggcaaatacctctctgtagacccttcccttcccttctcttcccttcccttcccttcccttcccatcccgtcccatcccctcccctccgctcttcctcctccctttctctctctctctcgtttgttttgttttgtttttttcctgtcctgtcctgtcctttcctctttcctttttttgaggtggagttttgctcttgtttcccaggccagagtgcaatggcatggtctcggctcactgcaacctctgcctcccgggttcaagcgattctcctgcctcagcctcccaagtagctgggattacaggcacatgccaccatgcctggctaatttttttatttttagtagagacacagttttatcatgttggccaggctggtcttgaactcctgatctcaagtgatgcacctgcctcggccttccaaagtgctgggattacaggcgtgagataccatgactggccttagaccccttcttaggagaattgatcctcgtagattgtttgagtttgaagggaccttggaaactgcttgatagcagtgacttgttcaaacttacaaaggcagagagaagcagagttagaagaaaacctaaatactggcttcatggttcccaggccaggcaaatagctgtggggacttcacccaaaggacttctgtgtgctgtgagcaggaatacaaagtctgttggagagatgggtgtggggagagagcagaaccctgggtggtgtccagtggagaccatccatcaccttagaggtggtgtgagctcctggttgtgctgggctgcatctgttgggagctagtgtgccttgctgagctgggctgtgcagaggcacctgagatgacttgggcttcctgaggaggctgggtgttactcctttattttattttatttatttgtttatttgtttttgagacagagtctctctttgtcgcccgagctggagggcaatgacacaatctcggctcactgcaacctccacctccctggttcaagcagttctcctgcctcagcctcccaactagctgggattacaggcgtgcaccaccatgcccagctaattttttgtatttttaatagagacggggttttaccacgttggccaggctagtttcgaactcctgacctcaggtgatctgcctgcctcggcctcccaaagtgctaggattacaggcgtgagccattgcgcccggccttttgcttctttaaattggactcagagttgggaggaaagaggttagcctgccaggggctcaagcacccaaggttgagacttagagatctgtaaatttacatataggctaaggtcgaaaatgtcagttggcacatccagtcattggctcccacgtatgcgtttctactcaaactttaagtgcaaaattttttttttttttttttatttatttatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaagacagaggaatttttcttagtgcagaacaaaatgaaaagtctcccatgtctacttctttctacacagacactgcaaccatccgatttctcaatcttttccccgcctttcccgcctttctattccacaaagccgccattgtcatcctggcccgttctcaatgagctgttgggcacacctcccagacggggaggtggctgggcagaggcgcccctcacctcccggacggggcggctggccgggcggggggggctgaccccccccacctccctcccggatggggcggctggccgggcagaggggctcctcacttcccagtaggggcggccgggcagaggcgcccctcacctaccggacggggccactggccgggcaggggggctgaccccccccacctccctcccggacggggcggctggccgggtggggggctgacccccccacctccctcacggacgaggcggctggccgggcgtggggctgacacccccacctccctcctggacagggcggctggccgggcggggggctgacccccccacctccctcccggatggggcggctggccgggcggggggccgacccccccacctccctcccggacggggcggctggccgggcagaggggctcctcacttcccagtaggggcggccgggcagaggcgcccctcaactcccagacggggcggctggccgggcggagggctgacccccccacctccctcccggacggggcggctggccgggtgggggggctgacccccccatctccctcccggacggggtggctggccgggcggggcgctgacccccccacctccctcccggacggggcggctggccaggcggggggctgacccccccacctccctcccggacggggcggctggccgggtgggggggctgacccccccatctccctcccggacggggtggctggccgggcggggcgctgacccccccacctccctcccggacggggcggctggccaggcggggggctgacccccccacctccctcccggacggggcggctggccgggtgggggggctgacccccccatctccctcccggacggggtggctggccgggcggggcgctgacccccccacctccctcctggacggggcggctggccaggcggggggctgacccccccacctccctcccggacggggcggctggccgggcagaggggctcctcacttcccagtaggggcggccgggcagaggcgcccctcaactcccagacggggcggctggccgggcggagggctgacccccccacctccctcccggacagggcggctggccgggcggggggctgacccccccacctccctcccggatggggcggctggccgggcagaggggctcctcacttcccagtaggggcggccgggcagaggcgcccctcacctcccagacggggcggctggccgggcggggcgctgacccccccacctccctcccggacggggcggctggccaggcggggggctgacccccccacctccctcccagacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcctggacggcacggctgcccgggcgggggggctgaccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcctggacggcacggctgcccgggcgggggggctgaccccccacctccctcccggatggggcggctggccgggcggggggctgacccccccccacctccctcccggacggggtggctgccgggcggagacgctcctcacttcccagatggggtggctgccgggcggagacgctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgagcagagaggctcctcacttcctagatgtgatggcggccgggcagagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctaagtgcaaaattttttgttaaagcctttggtagtctttgaaattcaataaagttcacaagtattttgcaagcactccccatagacttggagacttaaatattattttttgtgtgctgaagtttgcttttgagactaagacattactaaagttaatgccaatcttttataactgctttgtatataggaccttaataaagaattttaaaaatctgtcaggtgcggtggctcatgcctgtaatcccagcactttgggaggctgaggtgggtggatcacctgaggtcgggagttcgagaccagcatgaccaatatggagaaaccccatctctaccaaaaatacaaaaattagctgggcttggtggcacatgcctgtaatcccagctactcggcaggctgaggcagaagaatcgcttgaacccgggaggcagaggcggcagtgagccaagatcgcaccattgcacttctagcctgggcgaagagcgaaactctgtctgtctcaaaatagagaaagaaaaaaatctttctctattttgagtattgttcaagttgttacgtatttatacacatatatatcaatggaattccgtggaagtagagaggaatagaagcaaacatgctgttgttatgttatctgtaattcagcagtacttgcctgtgtccacagtgatgtggacatttccaggtgagcatgatggtcagcaacagcctaggactggccatggacaaaccaatatgcatttgattttgtggcacacacacaatactgctaatctctgctcagtggcttgtggcccagtttaggcagccagagaagagatctgccatagctatgatcacagtgtgtgtaattggattttgtatctgcttactggggtgaataaagccaggtgggagaaattcttttacactggcgttaactggcacataactcaaatcaacagaaacatgagcagagggtatagtggcaaagggcttgtttgctgccctatgtctttactcaagcagatgtcccttccccatgaagccttccttgctcctgagccagggctgcatttgatactgctcattcctaacctcccagtgcactttagcagagaaggatgagcacattttatctttcatttgttgttttctctggcctttcctacaaggttataaaagccttaggagcaggcatctatacaggttgagtgtccctaatccaaaatctgaaatctcgaaagttaggaccttttcgaatgctgacctgaggctgaaaggaaatactcattggagcatttcagattttggattttcagattagggatgctgagctggtaagtataatacaaatatttcaaaatctgaaaacatctgaaatctgaaacacttctggtcccaagcgttttagataagggatattcaacctgtagtaacaagagcttctatttaacatctcccccatgtacctggcattttacagatgttactttatttagtatgtgcaagaatcatttaacataactgtcttactcccttgagcttgctataacaaaaaatagcttagattgagtagcttataagaagagaaatgtcttgctcacagttctggaggctgggaagtccaatatcaaggctccagtggacttgatgtctgctgaggtcctgttcctcacagatggcaccttctatgtgttctcagatggcggaagggacaaacaagctctctggggcctctttgataaagacactaattctgttcataaggtcagagcccttatgacctaatcacctcccaaagggcccacctcttgttactgtcacattggggattaagtttcagcatatgaattttgggagacataaacatccagagcataaacgtaactaatgttatccttgtttcacacctgagaagacagaggctcagggaattgaagtaacttgctccatgtcactgctaggcagtggcagggctgggattgaaacacaaatctctctaacttctaagcccttttcctaccataccaccagggaatcagacctctgcagtttccatggtgcttaactcagaacccagcacttaggggatgtggtctttgctgaatgaataagcaggggatgtgtgatacaagaatttgtaccagaacctttggccaacatttccccaaggcccagcatccaatggtagagatcctgggtgactctctgtagatggtggtccttcacttctcatataggccattccaatctgaatgcagcttgttttgtgtgtgggaaggaattacgttttagggtattaaatatcctttctgggccatttagttacttgtctcctctcaaaacactaaaagcaattacatggtaattaagataaattacttgaccaattttcatagcaaactgattggtttcacttatccccccactgaactgttaagacctggcgagatcctttttatagttctttaaacttccaggactttctgcttatcttcaggaaggacagtggaccttcaggggagaggagaaggaggaaatttgcatatttaaaatgtgtgatctgagccaaacgctcttcagctaacttgatctcgcatcattttcccagcttcctttgagaattcagaatcaaaattcaggcatcaccatctagtgaccacagggtcctgcaccccagcccaaacctggggaccccttagggataatgccctttctcatttgtctttgagtgccctgctctttccactgaagagcccacagaacacagatgccagcaggcagccctgaaagcaggccttgtttgcaggtctttgcctgaacgaagcctgcttgtctgcctccttctgaaggccaggggtgggctacattttttggagagtaggaagcccaggggtcctcttcgtgctgctcctgagaacagaaggtagatagggtatgaagaggcagccgttgctagggctgccagaaaccagtccacccaggaaacaacacagctccacagctgcagtgagcacagctgcagaaacccaggagctgggcgagagggtgggggttaagatccaggcctctaccccaggccccagcatccatgctgggcaagcaggccacgtgctcccttgcttccagactggcagcctagcctccttgaaattggccctcactttatccccacccacctaatcagcaagccccaaagtctccccttgtctctgctctctgctgttcttctagggcccatgagggaacttttctgccttgggggctcctccacctcctggtttcaccttagctttttgtgtgtgtcttactttctccttttcatttcctcctcttgtaaagtgacccagccctggggctttacccattgtcttgcattcagctctcacagcgctgaaagacctccactctctacctctagcccttggttttctctctggatactgcctcttgtgtctagcttcatgaatgaggcttccatgtggacatacctcagacctgaccaatgtgcataaaaccagctccctgtcctgtctctcctgtggctccactagtccaagggccagatgccccactctcctttgttttctagattatatttggtgtacaaatcccatcaaggctttacaaatattcttttatctgccctttctcccttccgatttccatctcggaagtcagtatactatagggcaaagtgcagaatttggggctatggacagggttcaactctgatagcatcattttctgattgtgcgaacctcaggaaaatcatcaaatagaagcctctgattcattatctacgaagcagacacatacagaagggtggatcccagctcactgacctccttgcttttgacattttggactggaaaattcttgttgtggggctgccctgtgcattgtagaatgtttagcagcatctctggcccctacttactagacgctagtagcattcctgattgtcagttgtgacaatgaaaaatgtctccggacactgccaaatgtttcctggggagttaacttgctcctgtttgagacccattggtacagagtaatgctaagtcctgggtggtggtaatgaatattaacccaggttttcaggttttcacctttcagtcgtcagccacatgtatgaagttcccacattacttttattttttatttttttgaaacagagtctcactctgtcacccaggctggagtgcagtggtgcaatctcagctcattgcaacctctgcctccccggttcaagtgattctcgtgcctcagcctcccgagtagctgggattacaggcgtgcgccaccacgcccagctaatttttgtatttttagtagaaacggggttctaccacgttggccaggcttgtctctaactcctgaccttaagtaatccacccaccttggcctcccaaagtgctgggattacaggtgtgagccaccgcacctggcctcatgttacttttgattagtctttttcccagttagttttgacatctgcaggtgctgttctgacttgcttgattaattagttcctttcatgttacacatttttcaaatcagaacacactgggattgaaccttgatattctgttgtttgagaatgagagaccagttcagagttgttcagaaacctcagaactcccagtggggatgcctgcaggtttgacaccgccttgctgctcagggatcctaggcttgtagcaatggcgaatgctgatttgaacaccctgcccatacttgtgacaagcatttgtttaaagtgcctactatgcagaattttgctaacgttaatttatttggtccttgtgaagtaggtgttacttattttcactttacagaaaagcaaagtgaggccaaaagatacgaagcaacactgcctcagagatgctaagtagaagaaatgccatgagaggccaggtgactttggcatgaaagctggtgatgctaaatctctgtgctcttctgcctttttgggttgagcctttgctgtggctagagcacagaagcttatgaaggaggagctccttttaattgtggctcagaagttgcccatcttgccacctacaggttctgtgggtggagagcagacctataggccagacagatggctggttgagaccatgagccccagcactgtgtccagcacagggaaagcccccattaagggagcttcctccttgataacttggacaacacttggttgaacaacacactggatgctcactttccccagagagaacagcccaagagttcagtgatacttactcaaattgtagatgagagactgactgaccttgccctctgaagtgggaaactgaggagggttcccagaggcctgtgaagggcaggtaaccaggaatggtgacatggtaaggttgagtggagacagactgtggccccatggccctaggcagagtgcacactgggcatcctgcagcattgcagagacccattcccatgggaaatcccctgatttctccaccttagccaggagagtcctggggcctatgggtgggaggcttgagtgttgacagtcagaggggctgtgatgagagctgccaggtgccattctcaatgcccagaggatgctctggggaagaaagccctcacatgtttgccaaggtcaaaagcaagagctcattccagtcatggtctgtgtggaagctctttggtctgctgtcttggaaagcaaaggcagggatgtcctcctacgcggactgctggtctcccaggaaaagaatctgtggctcttacttgtcctgagtgatgctaagaccctgctaagtcaaagaagctgctataggcacagagccagtacccatggtcatagcagacagtgggcaatagaatacaaaaggccgaggtgtccagaggtaaaggtggactgtgtgttccctagtctcagactcttgtgtcttcagcatgctcctgagggttctgaggcacaccctccacgtggctttttttgtttgtttgtttgtttttgttgttgttgttgtttttgagacgtggtctcactgtgattcaggctggagtgcagtggtgtgatttcggctcaatgcagcgtcaaccttccaggttcaagcagttctctcacctcggcctcctaagtagctgggactacagccacatgccaccatgcctggcgaattttttttttttaacttttaatggagatgaggtctcactatgttgcccaggctggtcttgaactcctgactcaagcgatccacccacctcagccctccaaagtgctgggattacaggtgtgagccaccacgcctgccctccacgtgggttcttaaggaaaactacctgtttctccctcctgttagaggcccgtgactggctctgggaaggattgccatgaagagacctgtaagccctttctgataaggatttctcaaaggcatttgaccatgggtattttctccacaaacctattaagttttctccatttagagagatggtatcttcaagaatgtcttcaagtttgagctactatcacaaaataccatagaccaggtggcttataagcaacagagatttatttctcacagttccagaggctgaggtctaagatcagggtactagcatggttgggttctggtgagggttgcagatggctgatttctcattacatcctcacatggcagaaagagagtgagctaggtcctccagtggcagtggcggtgtcttcttcttcttcttcttcttcttcttcttcttcttcttcttcttcttcttcttcttcttcttcttcttcttctttcttcttcttcttcttcttcttcttcttcttcttcttcttcttcttcttcttcttcttcttcttcttcttcttcttcttcttcttctccttctccttctcctcctcctcctcctcctcctccttctccttctccttctccttctccttctctttctccttctccttcttcttcttctttcttatttcttcttcttcttcttccttctttcttcttcttcttcttccttatttcttctttctttctttctttctttttttttttttttttaagatggagtctcactctgtcacctaggctggagtgcagtggcacgatcttggctcactgcaacctctgcctcctgggtccaagtgattctcctgcctcagcctcctgagtagctggaattacaggcgtgcaccaccacgcccggctaatttttgtatttttagtagagacggggtttcaccatgttgggcaggatggtcttgaactcctgatatcaggtgatccacctgcctcagccttccaaagtgctgggattacagacgtgagccactgtccctggccctccggcttcttctttttttttttttttttttttttataagaaggagtctcgctctgtcgcccaggctggagtgcagtggtgtgatctctgctcactgcaagctccgcctcccaggttcatgccattctcctgcctcagcctcccgagtggctgggactacaggcgcccgccaccacgcccggctaattttttgtatttttggtagagacagggtttcaccatgttagccaggatggtctcgatctcctgacctcgtgatccacccgcctcggcctcccaaagtgccaggattacaggcgtgagccaccgcgcccagcctccgacttcttatacaggtactaatcctattcatgagggctctacactcatgacctcattaccttctaatggccccatctctaaatatcatcacattgggattcaggtttcaacataggaattttgtggggacacaaacattaagcccataacaaaggaggatccctgagcagggaattgggcacagggatctaagacagggaattatattatcagatccccagggcagaatacaggcatggtcataagttaggcagaatggagacacagttctagaaaaagattcatagcaagttgtcttgatggtaaaccaaggtccagagttgggcctctttagcttcctcctgactggagaaagcaggtgttctaaaggctagagtagggacagaggaggagaaaggaaaactaacatatatcgagtacatttatgaggcaatttacatatgaggtaaaattaatattaccattttacagatgaggaaactgtggctcagtgacctgcttagcaaatttctatagcatctatggcagtgacatgaacatggtatggatacatcatagaaatgtcatgataataaggataaaattctaaaatccgaatacccacccaactccaaatcttctctttgttcatgtaatgaccattttctgggactagccagtttgggttggattctgttcatattactgtcaaagataaacacagctggacattagttaaagtggtgagaatagatttttaattggtaataactattgcaacagggaaaagagtctagcttgaaccaaactcaatttccatttgtacagaggtgactgggcatattagtttttatttttttgagatggagtttcactctgtcacccaggctggagtgcagtggcaccatcttggctcactgcaacctccacctcccaggttcaagtgattctcctgcctcagcttcccaagtagctgggattacaggtgcccaccaccacgcccggctaatttttgtatttttagtagagacggggtttcaccatgttggtcaggctggtctcgatcttctgacgtcaggtgatctgcccacctcagtctccaccatgcccggctaatttttgtatttttagtagagacggggtttcaccatgttggtcaggctggtctcaatcttctgacgtcgggtgatccgcccacctcagtctcccaaagtgctgagattacaggcgtgagccaccgcacccgacctgtgactgggcattttaaagggagaatgagctcaagggagtcagggaagtgaaaaattacaaaaagtgggaaggaggggttggtccatgtgaaatccatctgggtttgcaaactggcatttatcaaagttaggctcctactctcccactgacgctagagggaccctatcttcaggcattgattgaaacaaacattgaattcttcaggcagccttgcgttttctcaggcgggcactttaagaggggctggtgttgtggtggtgtggcctcgagccattggaagcaatattagtgtttgttcaagtcgttacaggctgaagttgaaaggcctattcaagaagcagactctgagcctggctagaatttggtcaaagagagaatctatgtcactattctctaaatttaggaaatgaacagattattagaacaaggtaaaaaaaaaaagttggcacccaagtttatgctggaaaaatgaaggttaaatgccgtaggggaggggcagtgttagggaattgagctggaaccagcactgacaatatttgaaagcatggttaggttttgctgtggtttaatattttacaaatgttattccctgtcacatagctgaactaaataccccacatgtttgcgattaagcattatgagctgcagaacatatgtgctaataatatggttcatgcagcctgtgggcacttctcccatgacctaagatgaaggtgaggctttttgattttccttaaggtattgtgttttctgatgattcctttttgttccaaactttcgctttcccctttagaacgaagccttttacaggaatgatattttatttttatatatttattttttttgagatgcagtcttgccctgtcatccaggctggagtgcaatggcgcgatcttagctcactgcagtctccgcctcctgtgttcaagcgattctcctgcctcagcctcctgagtagctgggattacaggcgcccaccaccgtgcccggctaatttttgtatttttagtagagacggggttttgccatgttggtttcggactcctgacctcaggtgatctgcccgcctcggcctcccaaagtgctgcgattacaggcgtgagccactgcacctggccaggaatggtattttaaatactgtcatagcaagcccttaagaaaattcttcacagctgcatgttaacacactggcctgtccctgactttggctttgtttccaggatatacagttgtttctggaatgtacagtagctagattgcagccctccaatcatacaaaaacagactgagggtttggaaatgctgctaaagtctagttacagtgttgctcttgaggagtctggcgctatagggagtctgagaattccttatttgaaaaacagccaatggaaccgcacagacacactgaaattaagacattctttctgtagattatgcagcattgttagagagcaaagaaaagccacaggaataaaggactcaattcagccctctgctgaaggagagggtgttcctgaggcttgagtaggaattgacccaacagggacagtttggttgggctgataccaggaggctactgagaggtgtcgatgatgccttcctgagctctgctgaatacctccttggcatcagtcctcccccaacatctagcagaaacagaggagccagacattagggaccacattggggcgtgcttttccccacagatgcatactgaagtggggacaaagtcttcagctgccatatgacctggattgctgtttcacctatcacatgcatctaatctgacttcaacaatctacaggagaaggtagaacttcatatttacattttatttgagtggtttatgaagaaaagtagaggaaaactgcaaagaacggcagaagtagactcttgaggttggaggggagtaggggatgatggtgtgggagggatgaactttgcagggagttacacaaaatttggaaaattacagagaatactggaatcgccactaaaagagaggcagggcacctaaatctatttattagacaacaattctgagaaattattcatcactaagggcaggacagtcagttgatgcagtcaagaaggggcaggaaatagggcgagctgagttatgaaagccattctcagaaatgacccaaatttgtactgagctgttgttcttgagcaaccttggggaaaattatcagtctgcttttcccacagcctgatgtccaaggggcagatacgtgtggtgggcttgctggagaaataggctcttctcacgtgagaacagcatccttccaatctagagctcctggctccaggaagtggtggtggctctaccctggtgctatttcattagtgaagggtggggtggtggaaagtgcagaaaaggcaggacccctgacaccagcaaggcattggatctctctggacctccgggtggtggactttgggactggacagacctggtcacagtctaggttctacatcttactggtcgagcaactttaggcaagtagcttaactcctccgaacttattttccttttctaccaaataatgataatattacttcatgagtttgtgagtattaaatgagatcatgcatatacagcctacagcccttagcacaccatgaacacatagttatttgataaatgtttgttagtgtggttaattgaacagaaagccttaaatgtcttcctaaccctaaaatccagtgattctttgaactggggagggcagtagagagatttaatttgtggaaaaatgaaaagaccatttaaaattattcaatcagaaatgtattaagctttgtgtatttgtgtcaggcatttgtagacagtgtggaaaatgtcttatccaatgattctttgaactgggagggaagtagagagacttaatttgtggaaaagtgaaaagaccatttaaaattattcaatcagaaatgtattaagctttttgtatttgtgtcacaggcatttgtagacagtgtggaaaatgtcttaataaatgagacatgctctttccttgaaaaagcttcagtctgactcacaaagagtatatgaattttttcctatgatggcttgaaagattttatcttcaaattcctttttgtgagattgtttttccataccagtgcttcttatttatagggcttgttgcaagtaatttgcaatattgttacaggttgagtatcctttacaccaaatgctcagaccagaagtgttttagatttttttggattttggagtatttgcatccccaaatctaaaatgctcaagtgagcttttcctttgagtgtcatgttggcattcaaaacattttgaattttggagcaattcagattttgtgtttttgaattagagataatcaatttgtaataatatttaaggtattgctgtttgtgaaagatgtatttttaaacgatttagagtcaattcatgataatctccgtaatactcttacaagaattccaggctgggcatggtggctcatgcctgtaatcccagcgcattgggaggccaaggcagacagatcacttgaggtcaggagtttgaggccagcctggccaacatggcgaaaccccatctctactaaaaatacaaaaattagcagggcatggtgatgcacatctgtaatctcagctactcgggagcctgaggcaggagaatcacttgaacccgggaggtagaagtgtagtgagctgagattgcaccactgcactccagcctgggtgacagagtgagactcagtctcaaattaaaaaaaaaaagaattccaatatgatttcttaagtgggagaaaggggtggattgtacaaactgtgtgcaagtgcaacctttgttcgtgttttgtgtgaaccctcctattgctgatcaccacttaaaatggtagggacaattagttagttcagggcttccctaaatatggggagtgctaaattctgggtacatccaagagcacgtgctaggcttttgaatgccatttgtcacacatattgaggtctaaggttgcaaaccattgtatactagatccttgttattcctggtgtgaataggcatgtgtgcctacttttaatttcttcttgagttcagtgctttgaaaacagacagctgaagaaaatgtctaatagtctaaagaggaagcaaacactttcctagaaaccttcgaaactcagaaatggatttctagaaattctagccataatacatactccttttctttctgggcctcattcagaatcttgatgtctcaactgtctctgagttttttttttttttttttttttttttttgtctttccccagacagagtcttgcactatcccccaggctggagtgcagtggagtgatcttggctcactgcaacctccacctcctgggctcaagcgattctcctgcctcagcctcccgagtagctgtgaggagcaccaccacacccagctaatttttgtatttttggtagagacagggtttcaccatgttggccaggctgctcttgaactcctggcctccagtgatctgcccgccttggccttccaaagtgctgggattacaggcatgggccactgtgactggccttgtctctgaattttgtgtggaattgtcctctaggagtttgcagggtattccagattgaaagtagacctttgaaaagtatggggcatgcaggctgggatggaatccacagctgagggaaaagccagggaatcaaaatagaggaatctttgcttcagaggaaggcagctggggacttggtgccaggagtgtttggttcccagctctgcactaactggatttgagactttggggaaagtgcccagaagctgtggtctgctctggattgtcatgcagtttaaatgagacgttgcctgtgaagggctttctgggaggaacaggtacatatctagaccaaccctacttgtaatgcaggaacaaaacaaaactgaaattacatagatgctgccccttgaatactcttggattccagggtctcaaagtgcatagggtaaagtagcagatgactgaggaaaatgcatctaaacttctcttagccttcttatctctcggagacccaataggcttctaacagaccaaggctctggacagggtgtggccccctttcctatgagaggattaggagggaaggaaagggaaagaaggtgctgcatgaaattgatcttagttgttgactttgtgccaactggctggtgggggttttgagaccagaatagaaagatgaagtcatatagaaggatcagctgaaagaggtaagagaaacggaagcaagtgtaaaaaggattgataggctgggcacggtggctcacgcctgtaatcccagcactttgggaggccaaggcaggtgaaccacaaggtcaggagttcgagaccagcctggccaacatggtgaaaccctgtctctactaaaaatacaaaaattagcctggcatggtggtgggcgcctgtaatcccagctactcgggaggctgaggcaggagaattgcttgaacctgggaggcagaggttgcagtgagccaagatcatgccactacactccagcctgggtgacagaggaagactccatctctggaaaaaacaaaaaggattaataaaggaagatagcaagagattgaagaggggaggaagaggagggcagtgggaagcaggcctcccctcgacaatggggaatcagagctgctgactccagaacagtattaaacttccaggacaaaggtttgggttcctattgggcaccatatgaagttctatttggttgaataaactcacatcacatttgctgagtgcctcctatggaagagtcctggacgggggtgaaaggtggacagtgagggggtaggagtgcactttgcatagatctgggtttcaaggtaggagatgtttgtgtaaggtttgcttttaaaaaattcagggctgcttacaaagtaatgggcttgatttcttttctcctgcttatggaaatcagtttatttgtctcataataagcaaaaactgaagaaaccaacaccactgttgcaaattttgaagctacaaggaaaactgatgaggtgaaatttttggcatacatcagaatcgtattcagtctgaaacggaattatttcctctttttcttttctttttaataaacccaactaaagtaaatattttcctgagctctcacccctataggagggttattttggccttctgaagagggtgagatggagatatagtgctgctgatttcctacctgtgagcctcctcgtgggtcccatcgaaaccctgctctccctgctctgagggaaggtgcttcacagcaacttcagcctaagggcagtgacagtgaaatggcctccagggagccagcagcctgggctgccctccgctgtgtgtttttgtgccctcaggaatgtgtggatgcagcaaatgacaacagtgagtgctctgtccctagcggagccccaggccctgtcactttttgtcttggctggtttccaaggttgaatgattgcattggttgaagcttcattatccacaaggggaggcaagacagtgggctggagggagaaaaataggcctttcccacgggcatgattccagcagggtttgcatttttacatcagtagatctcagggactttcattttctgtcagtttgggccgtttgccctatcccagctacttgggaggctgaggcaggaggatcacttcagcccaggaatttgagaccagccttggaaacagcaggatcccacttctgaaagataaataaataaatatcccagcactaaagcccatgtatttagtggtaatacaatttctgcttttgacagcattttccactggatgtcagccgccatagcatcactttggagttggaaaggaccacagagctcattctagtgtaatccctgaatgtctggagaggctgtgcacacagctagtgagtgacagagtggtgcccagaatttgggttacccaagccccacatcagtgttgtggtccctacacttcactgcctctggtgtcattagaataatttcagtaatttgttgtatcaggttgggctgaagtgacctgtattcaaatcctggtttttccacacctaggtatatactcaagaaaaaggatcacacgaaacttatacacaaatattcagagcagcatttttcaaagtaactaaaaagtggaaacaaaccaaatgtctatcaactgataaatggataaacaaagtgtgatatttccatgcagtggactactcttcagccttgaaaaggaaggaagcagtgatatgtgctaccacatggatgaccttggaaacattatgctaggtgaaagaagccagacacaaaagccatatgttgtatgattcagtttacataaaatgtcctgaataggcatattcacaggcacagaaagtagtttagtggtttccagggcctgtggggaggggagtatgtggagtgactactaataagcatacagggtttattattgggatgaaaagaatgttgtggaatttggccaggtgcagtggctcacacctgtaatcccagcactatgggaggccgaggcaggtggatcacttgagatcaggagtttgagaccagcttggccaacatggtgaaaccctgtttctactaaaagtacaaaaattagccgggtgtggtggcgtgcacctgtaatcccagctacttgggaggctgaggcaggagaatcgattgaaccctggaggcaaaggttgcagtgagtcgagatcgtgccactgcactccaacctgagcgacagagtgcaactccatctcgaaaaaaaaaaaaagaaaagaaagaatgttgtggaatttgatagttgtgatggtttcacaattgtgttaacatactaaacatactaaaagccactgaactgacacttttttaaaagggtgaattcatggtataagaattatatctcagtaaagctgttatttaaaaaattctggctctacctcttactggctgggcgactttaggcaatgaacctaaagccaagtcatctcagctatgaaactggaataataatacacttcacagggtctttttgataaacgagattgtgaatttgaaaatgcttctaaagtgtaaacctcacatatttttggactgtcaatgggttataagttcattataaattggatttttaatcttctcctcctgtgtttttcacaatactaacaaggtctgggtacatagtgatcactcaaataaagatttattgagttgattcaaatgtatttcagttttattcaattgtggtaaatgaaactacacaacaggaaatctactcttttaaaagttttcaactgttaaaaacggtgttatgaacgatatgcacattgttgtacagcaaatctctagaaccttttcatcttacataactgaaactatatccactgaacagcaacttcccatttttacctactcccagttcctggcaaatgccattttactttctgcggtatgagttagactactttacatacttcgtataagaggagtcatgtaggatttgtccttctgtgatgggcttactgcacttagcataatgtgctgaaggttaatctatgttgcaacttgcgtcagaattttcttccttttaatactgaataatattctattgtatgaatatactgcattttctttatgcatccatccatcaattaacatttaggttgtttccatctgttgactattgtaaataatgatgcagtgaatatgagagtgcaaatattttttcaagaccctgttttaaattcttttggataggctgggttctgtggctcacacctgtaatcccagcactttgggaggccgaggagggtggatcacctgaggtcgggagttcgaaaccagcctgaccaacatggagaaaccccatctctactaaaaatacaaaattagccgggcatggtggtgcatgcctgtaatcccagctactcagagggctgaggcaggagaatcacttgaacccgggaggcagaggttgcggtgagccgagattgcgtcactgcactccagcctgggcaacaagagcaaaactccgtctcaaaaataaataaataaataaataaataaataaatgaattcttttggataaatacccgtaagtggattgctggatcatatggtagttctatttttagtttttgtttgttttttttttttttttgagatgcagttttgctcttgttgcccaggctggagtgcaatggcgtgatacccattcactgcaacatctgcctcctgggttcaagcaattctcctgcctcagcctcccaagcagctgagattacaggtgtgcgccaccacgcctggctaattttgcatttttagtagagacagggtttcaccatgttggctaggctggtcttgaactcctggtcttaggtgatccacctgtcttggcctcccaaagtgcctggattagaggtgtgagccaccgcacctggccctatttttaattttttgagggccttccatattgttccccataatggctgcaccactttacattgccagcaacaatgcacaagggttccgatttcttacatccttgccaagatttgttgttttcctttctttttttttttttttttttttttttgagacagagtctcactgtgttgcccaggctggagtgcagtgggatctctgctcactgcaacctctgcctcttgggttcaagtgattctcatgcctcagcctcctgagtggctgggatttcaggcacccaccaccacacccagctaatttttgtatttttagtagagatgagttttcaccatgttggccagactggtcttgaactcctgacctcaagtgatcctcccgcctcggctttccaaagtgctgggattataggtgtgagccactgtgcctggccatattatcctttttttttttttttttaaaagaaaataatggccattctaaaaggtatgaggtgatagatacctcgttgtagttttgatttgcattgtcctgatgattagtgatgttgagcatcttttcatatattttctggctatttgtatgtcttttttggagacatgtttattcaagtactttgccaattactaaattgcatgatttattttcttgccgttgagtttattgagttccttatatgttttggatattaattccttataagaaataccgtttgcaggccgggcgcggtggctcacgcctgtaatcccagcattttggaggcagagacgggtggagcacaagttcaggagattgagaccatcctggctaacacggtgaaaccctgtctctactaaaaatacaaaaaattagccgggcgcggtggcgggcgcctgtagtcccagctacttgggaggctgaggtaggagaatggcgtgaacctgggagatggagcttgccgtgagccaagatcgcgccactgcactccagcctgggcgactgagcgagattccatctcaaaaaaaaaaagaaaaaaagaaagacagaaataccgtttgcaaatattttctcctattctttatgttacctttttactctgttgattgtttcctttgctgtgcagaaacttttaagtttaatggtgtctcacttttctgtttttgcttttgttgcctgtgctttgctgtcatatccaagaaatcattgccaagaccaatgttatgaagattttcctctgcatttttttctcagagttttatagttttcaccgggcgcggtggctcatccctataatcccagcactttgggaggccgaggtgggcagatcacgaggtcgggagtttgagaccagcctgaccaacgtagggaaaccccatctctactaaaaataccaaaattagcctggcgtggtggtgcgtgcctgcaatcccagctactcaggaggctgaggcaggagaattgattgaaccagggaggcggatgttgcagtgagttgagatcgggccactgcattccagcctgagcgacagagcgagactccgtctcataaaaaaaaaaagaaaaaaaaacaggtttttttgtttgtttgttttttgtaggggaggagattcactcttgttgcccaggctggagtgcagtggcacaatcttgactcactgctacctccacctcctgggttcaagcgattctcctgcctcagcctcctgagtagctgggattacaggcgtccaccaccactcccggctattttttatatttttagtagagacgcgatttcaccatgttgcccaggctgatctccaactcctgacctcaggtgatccgtccacctcggcctcccaaagtgctgggattacaggcatgagccaccgagcccggccaaaaaaaaccaaaaaaacaaaaaaccccccagagttttatagtttcaagtcttatgtttaaatcttttatctattttttttttgagacggagttttgctctgtcgcccaggctgaagtgcagtgacacaaccttggcttactgcaacctctgcctcccaggcaattcccctgccttagcctccagagtagcttggaatacaggtgtgtgccaccaggcctggctaatttttttgtatttatagtagagatggggtttcaccatgttggccatgctggccttggacttctgacctcaggtgatccacccaccttggcctcccaaagttgttgggattacaggtgtgagccactgcacccagcctcttccatccatgttgagttgatggttgtgtatgatataagacaagcttgtccaacgtgcagcccacaggctacatgtagtccaggacggctttgaatgctgcctaacacaaatttgtaaactttcttaaaacatgagatccttttttttctttttttaactcatcagctatctgtagtgttagtgtattttgtgtgtggcccaacacaattctaattctcctttttctcctcctccttctccgcttcctctttctcctccttctcctccttctcctccttctcctcctcctcctcctccttcctttttttttttttttttttttttttgatatagagtttctctctgtcgtccaggctggagtgcaatggtgcaatctcagctcactgcaacctcctcctctcaggttcaagcaattctcctgcccaccaccatgcctggctaatttttgggcaggtacccaccaccatgcttggttaacttttgtatttttagtagagactgggttttgccatgttggccaggctggtctctaactcctgacctcaagtgatctacccaccttggcctcccaaagtgctgggattataggcgtgagccactgtgcctggccttaattcttcctccagtgtggctgagggaagccaaaagattagacatctctggtataagattacagtttagtttcactcttttgcatgtggatatcaagttttttcaacaccacttttttttttttgtttgagacaaagtttcgttctccttgcccaggctggagagtaatgacacagtctctgttcactgcaacctctgcctcccgggctcaagcgattttcctgcctcagcctcctgagtagctgggattacaagtgtgtgccaccatgcccagctaattttttgtatttttagtagagatggggtttctccatgttggccaggctggtctcgaactcctgacctcaggtgatctgctctcctcagcctcccaaagtgctgggattatagatgtgagccactgcacccagccctctttcttcctttttttttttgagacggagtctcactgtgttgcccaggctggagtgcagtggcgcatttgtggctataaagttccctgtgagtactgttttggtgtgctgtgttttcattttcatttgtctcaagatattttctaatttccttttttatttctcctttgatccattggttgttcaagagtatgttaattttcaaatatttgtgaattttttagttttccttctattattaatttctagttttattccattgtggttagaaaaaatgtttgtgtgatttcaatcttctcacatttgttaagatttgttttgtaacctaacgtgatctgctttggcaaatgttctgtgtgtgcttgagaagaatatgtgttctgctgctgttaggtggaatgttctgtatatgtatggcagtttagttgagtttatagtgttcaagtctattgtttctttagtggtcttctgtctggatgttctgtgtattgttgaaagtatggtgttgaaatctccaattattagtgggtggctatctatttctctcttcagttctgttaatgtttgcttcatatatttgggtgctctgatgttggatatataaatatatatatattttcagatggagtttcactctgtcacccaggctggagtgcaatggcactatctcagctcactgcaacctctgcctcccaggttcaagagattctcctgactcagctacctgagtagctgggattacaggtgcccaccaccatgcttggctaatttttgtatttttttgtagagacagggttttgctatgttggccagactgctctcgaactgctgacctcaggtgacctgcttgcctcggcctcccaaagtgctgggattacagttgtgacccaccattcccagctgggttaatatatatttataattgttgcgtcttcctagtgaattgactcttttatcattatattatgtccttctttgtctcctatgatagtttttgacttaaagtttattttgcttaagcatggctactcctgctctctcttggataacatttgcatggaatatgttttttcatcctttcactttcagcatatgtctgtctttaaatctaaagtgagtaccttatagacagcatacagttggatcatgttttttttttaatccacttagccaccaacagaattataatttttaagcatttatcagaagtaaagacatttagtaatgattccccccttcattttatatacctattttctctttattttatttttttaacagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtaaatattcaacaccccaagtttattttcatgggaaatagcttaaatattcttaccttcctccttgggttgaaaccaggtagagacagatggcaatttgtcagctgaggctgtgctttggggtaggagatggaacatttagctaaacagctggtttatttgtttccttttgcacctatttctaccagataagtttaactgttgaacattttttaaatatcatacgaaataccatgctaggctaggaatttgttgtggatggcggcactaagagaaaattcgttgatatccatggttgagattaacgcatcaacttcaaatgttaaaaatatttctaatatagctgagattccctaattaatctctaaagatctgtcatccatgaatatacctgaacttctttgcattctcagctgataccacttcttccttaggtttgctccctgctctttgaaataagactgctttcatttttacccaaattgatttttgttgactgaattcacccatttggtcatctcaacttgtattgtttttgtttttgacatggcatctcactctgtcatccaggctggagtgcagtggcacgatcacggctcactgcagcctccacttcccaggctcaagtgatcttcctgcttcagcctcctcagtacctgggattacagatgcataccatcgtgcctggctaattttttgttttttagtagagacggggtctccctatgttgcccaggctgctcttgaattcctgggctcaagggatcctcccacattggcctcccaaaatgctagcattacaggtgtgagccacctcatctggcctaaactggttgttttagaattaggtggacacacgtgagtgttaaaaattcagttaatttttaaaaattttgcaaataaaaattatctaaaagtcagaacttgaaaagacagttatagtaccacatttattttggagtagtaagtaaatagtagtggacataatataataaagtcaaaaaccaaattttaaaattagagctctttcctattttagttgagggttgttggttttttttttttttcccccctagcagagcactggtcactggtctctggagttaaattggaggtggggttgggggacctgagttgatgcattcatgcatccatcgatccatccatccattgatccaaatcttttttttcttttttttttttttttgagatggagtctcgctttctcacccaggtggagtgcggtggcacaatctcggcttactgcaacctccgcctctcgggttcaagtgattctcctgcctcagcctccggagtagctggaactacaggcgcccaccaccatgcctggctaatttttgtatttcagtagagacagggtttcaccatattggccagggtggtctcaaactcctgactttgtgatcctcccacctcggcctcccatagtgctgggattacaggcttgagccactgtgcccggcccatccatccaaatctttactgagtacttactgtataccaagtgccacatcaagtgctggggataaagataaataaaaatctgatccctgtttccagatggctcacagctgctgtagtccttcagagaaatttaagctcatctaggcccctccaggctgtggacttcagaggaagcatttttctttggggtggccttatggcagtgtttctcaaacctggctatattattattattattattttgagatggagtcttactctgttgctcaggctggagtgcagtgcgatagctcactgcaacctctgcctcccaggttcaagtgattttcctgcctcagcctcccgagtagctgggacgacaggcgtgagccaccacgcctggctagtttttttatttttagtagagacggggttttcccatgttggccagactggtcttgaactcctgacctcaagtgatccacccgccttggcctcccaaagtgttgggattacaggtgtgagccaccatgcctggccaaacctgactatattagaataacttgaaagcttttaaatcatctcaatgtttaggtttcacttcatgctaattaaatcggaatctctggcgggggtgggcggtggggagggagccagattccaagtattttaagatctctccagatacaaggtgtagccagagggaagaacactgctctccaggtgttgtaaagttgtagaaccagaagaacaagccccagactacaattgacttgaggggcagcactgcccgtaccctggaggccatgggaccaccttgtccatgactctctgtttgttggtttaacacctgttgactgatgagagcttgagctatgggcaggatccttcaggtgagagacacaggcctagtgagctgaggagctccaggaccctgtgcagaagggaagttcctacattgtctttcttcctgacaccccatacccttcttcattaatgccaaatttcaccccacagcgttctcaagactcagattaattatgttcagttcccccatactagcaaggatagctcaggcttagggcagagtgaggtggtgatggtgcagcctggtcacagtaaatggtctcaaacagcacattctgatcaactctgctgtgatgggagggaaggtcagtatcttctatgatataatccactgagatgatgtttcctgctttctttttttttctttttttgggatggagtgttgctctgtcacccaggctggagtgcagtggtgcaatcttggctcactgcaaccgctgcctcctgggttcaagcaattctagtggctcaacctcccaagtagctaggattacaggcccgcaccaccacacccggctaacttcttatattttgtgtagagatggggtttcaccatgttggccaggctggtctcgaactcccaacctcaggtgatccacccgcctcggcctcccaaagtgctgggattagaggtttgagccaccgtgcctggcccctgctttcttttataacttggctagagaggcaaattgaaccatttgcatcatcatgccagagaaaccagttttaaggtcttcatacaaggttccaaatggtctattctaaaagttacttgtgctagttttaggttagagggtttaaacaaaatcagagtattagcttttgttttgctcaacaaaaagggaaagagaggcaggcagaaagtcaggcaggctggaatgcctattggaaactcctggatctgcaggtttcccctgaaatctgggtgataaactaactcctgttgttttccgttgatcctagagatggtctcgaggactagaacaaaaggtccaaagcagtttttgcatagacttgaagtggtaattatgcttttgagagagaagcacaataggctcaggctgtgggcttgcccacgtggtgtgagagggacaagagcacaggctccctttgtagtccattcctattgctctacttagagcaggtgctccgggaggccctgaaggaaataagcacttggctaaagcctggccagggtaaccacacttatttttcaaactgagaacccataccaatcatcttttctaattttgggagtgcagacacgtatgaagctttttgtgaaaatgatcctgtttataatactgcatttttttcagagtcattggtgtagttaactgattcaatcaacaagaatttattgagaaggagtctcactcatttactccacaaacatctactaaagttcttctaggtataggttctgtgctgagtgtttaagagatacagacacaaacatgattcctactctaccagaaacttaacagtctagaaggtgagacagactctgaagcagctacccaaatgcactgtggaaaagtgcatagttccaggcttggacaaacatatgcacttagggatcccagaggaaagggtaataaactgcctggggactagggagggcttcgctgaagagctgatggctgggagagtcaatagagtttccatcaaagaaagaaacagcagaaccacaggtgtgtgggtgggggatcttacctaagttttggggctgagggagtggtcggggaagagaccagtgtattaagaccttgtgggccatgctgtggggtgtgaagtttatctgtcaacagggcctcggggttgttttcggcatgactgctacagaatcatatcttgtttcagaaaggctggcatgcagtgcagaggaaagatttaggagtagattatagacacagggaagttgggaggaggtaagggttgctgagcaaaggcagtggcagagagagagaggcaagagatgggtgagcgaattcaggggaggtgcccctaagtgatgacagattctctatgggcatgagggaaagggagggaatgggacaaggtcaggtgctctggctgtggtggataggtgggcaatggtgccattagccgagatagcctgggatcttctcatcactcatccttttaaagtctgtttcccagtcctggccacatgttagcatcattaaagcttcaaacacatacccatatttgggccccatcccctactaatcgggctctatgaagatgaggctcaggtgttgatgtttataaaggctcatgcagccggggttgagaactactgacgtgatcccctaggcagagatcattcctccctgctctgcatatgcctttgtcttccagacctctgttattgctctcccatgagtatttatttatttatttatttatttatgagacggagtctcgctctgccacccaggctggagtgcaatggcaccatcttggctcactgcaacctccacctcctgtgttcaagagatttttctgcctcagcctcccaagtagctgggactacaggtgcgcaccaccacgcctggctaattttcgtgtttttagtagagatggggtttcgccatattggccaggctggtctcaaactcctgacctcgtgacctgcccagtttggcctcccaaagtgctgggattataggcatgagccactgcgtccggcctcccatgagtatttattagcagtggagctcaccaagaacaatgacaagaatggacatttccagggaaactggctggacctgatcttggccttcaggaattcttttgtaaaaccgtcatatcaccaggcccacagaggacaacattttacaggcatttcagtcaattacacagtgataattcactgaacaaatcctttgggatcacagctgctttattgagatcaggtctgtgcacaaagaggaggcccagggaaaacacagtggggctgtgtcaggtggcgtccagagggcatggtgcagctgtgggcctggcttggggcaggacatttctgggattacagggccctgccccaagcttctccgttgagggggtagggagggcaatgcagagagtgagagggtgccagggcaggctataagctaatttgcctcttgagaagtagggtaataataaggttggagcagagaggaaatctttgtcctaaggcagtgcttctcaaacttttgtgggcccaggaatcaccttgttaaaatgtggattttgactgagcaagtgggatctggaatactgtgtttctaacaagtgctgatgtgacgccaatgcatctggcccaaggaatacgcttagaatagcaggatcccagaatgcatctctatttttctatatgacttttagatcagttgtgtatttagagaacataaagtttttaaaaagctctttaaaattttatccttttcaagattgtctcggaaaactttgcattatttgaaaagatacttcgaaaatggaaactgaatgaatagcactggagtgcagtggcgaggtctcagctcactgcaacctctacctcccaggctcaagccatcctcccacctcagcctcccaagtagctgggaccacagcacgtgccatcacacctggttaattttttgtatttttggtagagatgaggttttgccgtgttgctcaggctggtctcgaacttctcagctcaggcaacccacccgccttggccttccgagtgctgggattataggtataagctacctaccgcacctggcaagaacatataaactagtctactatgttctaattataaaacttttttttaaattttttttccttcctgggaatttgagggatcaggattgaccttttttactggggaaatcacctgtgatttctggaaaggtggggagggctgctggtcccttaatgtcccttctaaccagcttgtcaatgcttagtattcctttgacagtgggcaggtctttcattttgcaacaaaggtttgcctgaggcactagctcacagacttcattcatactaaggtgtgaatgacagcagaggagcttaggctttgttggggtgatagagagagaaagagaaaggaagaaagagaaagacagctgaagacaaatgaggatgctggttagccagaggaggtgtatatggtggcacagaattattaaggggaatgagagtggtggaggagcaattaaatatatctacctctaacttcccaatttttcgacttttctctttttttcttctgccctgtcatcagcacgttggttgctctctcctcctccactctgtcatcctcttgctattctttcccttcggccctctaacagttcagtttcaggtgtaaaatattttggttcaggagggactggatatcaactagacctaagattttgtgatttacattccccgtcctaagaaaaggaattatgttgagtgaacaatgaccaaagctggacagttccccctggtggtcagcactgcgacaacacgattttcctctatcttttattcattaattggtgaatttgaaaataatctgttaagccccaaacatgacagacattgtgctaaggacagacatgacacctgtccctgtggggcagaaagtctgaagagggagtgtgttactaaacattgtagagcatttagcattttcaaaagccttaaaaaataagccagaaaacttgaaaggaaaaaggcttttaccatttttaaagaaaagcaggtagaaaggttttgtttctgacattttttgtaccactaagtcttcaatttgggtttagttcttcaattttcatcgtaaaatttccccaaataattttttcttataaagtgtgagtatcaaatcagatcatgtgtagtataatttttaactccgaatgtgtaacattcacagtccctttattagcaaaattatagtaattaaataatactggctttataattgaatagcactttgcaaaataatatgtctggctcatctatattgctatagaatactactgccccagtgctgtatgcatatgaactggttaatcctcacaacagcccttataaggttcaggttatcctcattatccacatttttagatgaagaaactgaggctcagagagataagcaatttgtaaccctagccttaaccactttgccataacaagacagaagaatgcctgcagtaagtgtaaatgaacttactgtatcctcactgcagacagaggactaaaaagagtaatggggtttgcaatctttctgggtgtgtgtgtatgagaatgaagttatcacttgcctccagtgatcaggttgttaagagcacctcagaggccactgttgtcctacccttcctgtaagtggtagagatggctaatgagcatctgttggttaactgattgatgatttctcaaggctttttacagccttagaattctattagtcactctacaagaaacaggttgtatggaacgaaaggtaatttatcttttaagaattaagtgaaatcctttaaactcttgtttttgtgcctaaagctatattctgatggaaatgctctttctctagctatgtcagtggtacagtaatttaatctggttcttgaaattactctttatctcatacatttatttaagtaaagatagccacattagatatggagatgctatgaacaatgcaacagaatcatggaatgtttgtaaagctgctgcagtgattacaatgaaaatattgatcatttccttataacacacacacacacacacacacactatatgacccccatctaaaatctttgaaatatatccagtatctctgggtctggcactgaacctggcctggcatagcacagatgctcaataagtgacaaattgagtgaaaaccaatattagattaaaatattaaaggccaatatgcccatttctactctgtatagctgttccagtcaaagtattttggaaggatgagtgagaattacagtagggaaaaataatttgttccactgaaaaaagaattcttggcctggaacattttctgaaagttaagtttaacttttaaaaatcagaattttaaaataatgcgacttaatttgggctgaagtttatttttgagttatctgtaaatagatggtaaggaaatgaataaattaataattataagatgttactcagtctaagagaaagaggcttgtacaggtcttgagcacattgtagccaaataattatgtttaatataaatattactcatatcttttaattaaggaaaacaattaagtttaagcatattactatattgtttaatataaattaaacattaatattaaaaatattgcttaaaataaatatttagcaaattatattagtataatatagtaattatattgttatatactaatataatttgctaaatatagtaatatttctaattaatattagtaatatttctaattgaaaacatttttaggagttcatctgtgcctgcatatagtaatatattttttatttttatatttttgccattcttattcaaaatagtaatgaagttgtacttgtttttaaagctagtacttaaaaatggcagacagctttccccctagttggtgcaaaattgtagattttcatggtatgttgtttaaatggaatttgcactgctgcagtgctaatgaaattccttattaaggagagagatgagtgccttttatgttcaagagaaatgttcaatggccattaaaatactttgactatttgattttttttccctcgaggtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggtacatcccaaaacttctagaactgtgacctgatttggctttaaatatttgttttgctgtcttttgtgatcgtgtatgtgttgtgtgtgtgtgtatatgtgtggtgagatttgccctagagaggatctcagctatggaaacttgatggccaccattgagcttagttcttcctatccattctggagaatgttgggaacacttaataatttagctctcaatgaaaaacaggacattaaaaatgaatctacattttagaagcatatttataataaaaattatgatgttaggacaccatttctcaaaatatgtgctgcagaacatgtgtcccatataattatccaacaaaagaataagttggggaatgccgtatactaaattaatgttaaataaaggctcccaagaagtcctgcaataaggaaacttgttaaacttagttaacccagtttttcccaactcattggctattgtgtcttgtctttgtgggtatgtgtatgtaaaacacttatccctatcttgtggaatagtgttctgtggagcatgctttaggaaatgctgagttactctattatggtagttttcagtttttttttttttaagacggcatctcactctgtcacccaggctggagtgcagtggcattatcttggctcactgcaacctccgcctcctgggtccaagcgattctcctgcctcagcctctcaagtaactgggattacagccacccaccaccacacccagctattattattattattattattattattattattattctatttttagtagagatggggttttgccatgttggccaggctggtctcaaactcccgaccttaggtaatctgaccctctcggcctccccaagtgctgggattacaggcgtaagccaccatgcctagcctattggtagcttaaagttttattttaaatttttaaatagagatgggatctcactatgttggtcaggctggtctcaaattcctggtctcaagtgatcctcctgcctcggcctcccaaagtgctgggattacaagcgtgagccaccgtatccagcctggtattatggtagttttaaatgtttgccatcagctcttctgcattcttaggcagatgaactaaaggaggacatacacttacatctgtttctaaacttgttttcccttcttatcctcaagtttagtagatatatggatgtctcctgccacatatttcccacagtatcttgaaatggtgatgcatcttgctgattttgtttaaaaggttttctttattttgagacagagtcttgctctgttgcccaggttggagtgcagtggcatggtctcggctcactgcaacctccgcttcctaggttcaagtaattctcctgcctcagcctcccgagtagctgggattacaggtgcctgccaccacgcctggctaattttttgtgtttatagtagagatggggtttcaccatgttggccaggctggtctcgaactcctgaccttgtgatctgtctgcctcggcctcccaaagtgctgggattagaggtgtgagccaccacacctggcctaaaagtatttttaactagaaaatatttcaaaaatcacaaaaattaaatagtgcattacagacaggtggttcagtttagaatgtatgtttcccttctgtctttcacatgagcaacattttataatttctaatagcatttattttatttttaaaaatttaaattttgcctgttacacagccctcaggaggtcctgagaacatgtgcctctcaaatagcattttaaaatctatgtgttgcttgacttgcagcaaagattaatgccattctgattttctactaatttatttctattaaaaatagtgatattatacatgacatcgctaatatcaactgggtttcctatactatagtaatgtgagtcaggatttttctttattttggactatctgtttagaagtctatgtttgggtccagttatctttttctactgataaaagtaatgataggtagtgctgtcctgtgcagccccttcagacctgaaggatgtatttccccagcaggtgggaattgccgccgctgaagatagctgcctttcctgaggtcatgcctccttcctggaatctatgcaggggtgtataggcccctttgcatcaacttgggctaacgctgtaggtcagcccagcttcagctctccagggcatggacagaagccttcattctgactacattgcatcccagcttctctctctgcccatttagcttcatttcctgcctcactcccccatgaatgttgaactcaacggcactctccagtaaactttctgcacacagatctccatctcagagtttatttcttggggaacctgacctataacactaggtatatatatattatgtgtgactgaaatgtgggtcaagtggcatggagactgtgtttatacttattttcctattcacagggcatgccaggttcatgcaattttagtggacaattaaaaattactttacaaagtatctcttgctttagtagcatttactagttgatgtgcacctggtggcagtttcaaaatgttttcttccatttagtaattatctgttgccagatactgctccacatgcagggacacagcagtgtgaacagagagacaaagtccctgtcctcatggagcatagtttctagtgggggtaaacgaaaaatagttagtagataaataaataaataaatatgatttcaactaataacaaattccaagaaggtaataaaatagggtaacgggatagagagtgactggagggctttatcaggggtagtcctggaggacctccaggaggatgtgacatttgagctgagacaaaaatgatgaagagcagatggtttactattaggttgctgcaaaagtaatcacggtttttgccattagttttgcagcaacctaatagtttgtaagatggcttgtttcaattagataattttgggtgcattataaatcttaagggggccaatggctagatacatgatacagccatatattcaggtagagggataattgatcatatgtctagtcagatctgtaaattttttttcagtatacatattctgtatacattttataaaaactacgtttgacttagaagacagttttggtgctcttgaagacttgaccctggcggggaggatttgaggggctctgttgttcaaaaggagagcagagcgcctcacttggaagctactgtaggagggtagagggctgtgtctgtgtccaaagggtgaggtttgtgcagtctgtgccacatgtataaaataggactgaagaggtgtgagtgctgtgttgcatttgttaatgctgcctgtgttttgcttttgcataacaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaactatt

SEQ ID NO: 1776 - DNA, 68348 bp, Homo sapiens; identical to SEQ ID NO: 1775

SEQ ID NO: 1777 - DNA, 246594 bp, Homo sapiens
cagaagatgcgctggagggaagagaacggagcgtcggacaccagaaaaactttgggggattcggggtgagaaagaaggcgtgaagagagaagggaggctcagcaggggaggaggggcgggggcgggggcgggagcgggaggagtcactgcgccgcggccgcccctccccgccctccactcggcggccccgggtcttcctccccctcctcctccccctcctcctccccctcctcttcctccgcctcctggtgtggctggctgcggccagaatcggagccccaaccgcgctgccggtgagtgaccagccccaggggacagagacgggaggcctgggaccccccctctccagggtggggcctcccgccgtgtctgggaaagtttgcgggcgccccgggacgcgggcatctccagggccgctcggcgcctccccatctccccgcgcccgccctggccgcccccaggggcgccctggggcccgcagagggatggcctcccggcagggactcctcggctcccctctgttctgagactgctgctgggaccggggtccgactctaaagagaaaactcaaacagcaaaaaaaggaatatcgactcagttccgagggcgggggccggggctcgttctcacccgcgcgcggcccctcgacctctcggacccgggccaccagctctgcgcccctcacgcctccctcggggtctctgtgtctctctcccgctcccggactccctcctccttctgactgctgttatttgggctgttgtccctccccgctccctggtacctcagctcggaccttagcctgtgcctgcagcccggagtcccctcctgccctggaaggcaaggagccaggccacggggccacagccgcgggggccaccacactggcccaaatatttcctgcaggtatgaccattcactgggtattggggttgggtcccttggacccacaaactgaacctcgtgggtacagggaaaaattaaaatatattcctccttaggattgtactgcttctgttggtttggcatctttttatttttaacccttctaactgtgctttcttcgaataataatgatacttcatgtaattagcgtttctaatatctaaagacagaagaaggaagaaaataaacggaagagagagaatgcttgctaaaaatactcatttttgacttcagtccacactcgactgttttcctgggagatagaagttcagtgtagcttgttttcagactaaccgcaaacacgattacagcctcctccaggctagaagttttaatttgcctgacatgcagcacactgtttgttggtattcccagcctggcattcccgtctgcatagctctagtctccctcccaactcccccacccccactttctttctcataaaagggagctgtgaaaacaaggcaatgggagaggctcaaacgagctggaccacataataaaaacagccctacttattttaatcctgaggctatggactcccctggactctgattgggtggaagaattgtttagttcatttgtgtggtttttctgtcagtagttattatggttgaatcagtgtttccatgacagtcttgcttctgtgggcacgatggggagcctgttaattctcggatgggtctggacagatcaagtctggagtctggagagatttttcagggcttgacctgggctgatattgcaaacctctgcacactcactcagaaccagagcagccgggagcagcctgagctggggttttcttccacatgatctgggaagaaaaagctctaccaaggagcgaactgtgtgagcatggttgctgggggatgttgaatgttttacgtttttaggaagaacacacttctcaaaactttagccattcctgtttccatacaaacaataaatgtggttgtaacaaatgtagtagatcagattctgaacaaccccttaaaaaacaggtccaagtattgaaccatttggaaataaagattttattttatttgaattctactggaaataaaagagtttatgttaaaaaggatgtaattcacttctctccactgatgcagtttgacagttccccattggtatgaatcagttaggttttattgtggtctcaaaacatcattaaggcagggcacaacatcattaaggcagggcacggggttcatgcctataatcccagcattttgggaggccggggcgggcagatcacttgaggtcaggagttcgagaccagcctggccaacctgatgaaaccccgtctctattaaaaatacaaaagctagctgggccaggtggcgggaacctgtaattcccagctacttgggaggttgaggcggaagaatcgtttgaacctgggaggcggaggttgcagtgagccgagattacaccactgcactccatcctgggcgacacagcaagactctgtctaaataaataaataaataaataaataaataaataaataaataattgataggcaagtgttgtgactgtgacttccattcaaaaagtaagtccaaaaaaaaaaaaaaacaacaaaagtaagtccataaattctgagcttgtttggccctgttgcttagaaaaacaatgtactgtgctcagataaaaatcttcagtctcttcctcttcctgagaatttttaatagtgcatttaatatcctgtaagtcaaccttatactgtttacagaaaagttgcctttctgccttgtccagcttttgcactatctcatgaaatattgttagactggatggtttgccacgggtacaagagtctgcccagcagcccgaggagaggctggggttgtaatgaaggccacgggggcctggacctaaggagcaggtggtctggatggtgagatgaaggctacatccccagacagccacagaaagcagccactgatcacctggacaggtcagatgagttggaaatatcaatacatgaagtgtgggaccagtggagagcaaggaaggcagaggtggttaagaagcaaaatgatacaaataaataaaaaaggaaaaggccaggcacagtggctcatgcctgtgaagtgctaggtgtggtgattcatgcctgtaaccctagcactgtgggaagtggaggccagaggatcacttgaggctaggagttaagaccagactgggcaacaaagtgagaccccatctcttaaaaaaaaagatgggccgggcgcggtggcttccgcttgtaatcccagcacttggggaggccaaggcaggcagatcatgaagtcaggagttccagaccagcctggccaacatagtgaaaccccgtctctactaaaaacacaaaaattaggtgggcatggtggcgggcacctataatcccacctactcgggaggctgaggcaggagaatcacttgaacctgggaggcggaggttgcagtgagccgactgcaccactgcacttcagcctgggcgacagagcgagactccgtctcagaaaagaaaagaaaaaaaaagatgtaggccaggttcagtggctcatacctgtaatcccaacattttgggaggccacggcaggtggatcgcctgaggtcagaagttcgataccagcctggccaacatgatgaaaacctgtctctactaaaaatatagaaaattagctgggtgtggtggcaggcacctataatgtcagctactcgggaggctgaagcaggttgcagggagccaagattgtgccactgcactggagcctgggcaacaagagcaaaactccgtctcaaaaaaaaaaaaaaaaaaaagagataaaagatgtaaaataacccaaaggaatactctgtgaccttttaaaatcatgttgtataagaatgttgaattacacaggactttttttttttttttttttgagacaaagttttgctctcgttgcccaggctggagtgcaatggcgtgatctcagcttatcgcaacctccacctcctgggttcaagcgattctcctgcctcagccacccgagtacctgggattacaggcatgtgccaccatgcctggctaattttgtatttttagtagagatggggtttctccatgttggtcaggctggtttcgaactcctgatctcaggtgatccgccagcctcagcctcccaaagtgtcaggattataggtgtgagccactgtgcctggcctggggttaatttttgaaagcaagttataaaatggaaagcactataattttactctttgaaaatacatcgagaaaatactggaattatgtgcatcaaaatggatggtgagagtatagctgtttttaaattttctttgtacttgtatttctcaacttttatagtaataatagctaacatttactgagaactaagcacttacatatggtattttattcgaaaactctttgaggtaaatattactattattttcattatggagtttcagaaactagaaccagaagggtaactcatccatggtcacacagccactaagtgctggaatcaagtgttgaattcaggtcggtggctaaagtctatgcatctctgtcactactgtctaccatctccctgcacatgtattattattattttaattataaggaataagtagaaaaggaaagggaaaatgtttcatgctttagtaagaactgatgggcacagtggctcatgcctataatctcagcactttgggaggctgaggtggaaggatcacttgagcccaggggttgaagactaagtggcacaaattagtcaggcatggttgcacatgcctgagtcccaagtactcaggaggctgagctgggaggatcacctgagcctaggagatggaggcttcagtgagctatgtcacgctactgcactccagcctcggcaacagagcgagaccctgtctcctaagagggggtgaggagggagaaaaacaaaaacaaaaacacactgatacgtaaaatggaaaatgcctcccatctcttccagctccgccagtcacttctctttagaagtctttggtaactgctccagatttagaggtagctcaccccttccttgcaaaccagctccactcacaagaagaatcccgaattccatggaggcttcctggccagcctggaattccaggtaccttatgggattctggagcagtcctcagtacagggcaagatttttaaagtagatcaggcaaattatgtcttcagagctctgcagattacagggtgtcatcattctttgcagcgtcaggagagtgtgataggtagaaagacccagggaaagcaccgaggctcaaatgtacctgtgtgttacatggaatgccaggggaaataaagggtttaccatggaataagaaagagaaaaaaaaaacctcattgctggatgcttattactatgaacacacaacaataaattatctttcgaaagcttgcctatgtgggtgatcccatgcattggtgagtttgactgattgggtgaggtggaaatatttagtgtgagtgattctggggagagctctgggaaaaaatgcccacatcctgtactaccatgtcccctcacaggcaagcagctcctgggatcactcatccattctctttgtggaaggtaccttgagatccccagaaggatcagcattcttagagcccctggcccatcacataacaaacatgccttaagaagaaggctttcagctgggcgcagtggctcatgcctgtaatctcagcactttgggaggccgacgtggggggatcacctgaggtcaggacaagaagtctgatcacaaatgattgtcattttattataatctgccttctccctggtagcttttaaaattttctctaaaatgttccacaggtatgtctaggtatggatttagaaaattttatcctacccagcagtcagtgagcatttgtgattacacaaatttgtgtagctgggcacggtggttcatgcctgtaatcccagcactttgggaggctgaggcgggctgatcgcttgagctcaggagtttgagaacagcctgggcaacaaggatgagaccctgcctctacaaaaaatataaaaattagctgggcatggtggtgtgccctgtggtcccagctacttgggaggctgagatgggaggatcacttgagctggggaggcagaggttccaatgagctgagatcaggccactgcactccagcctgggtgacagagcgacactctgtctcaaaaaataaatcaaaaaacctaaaaaccaaatttgtgaggatttgtgattacccagtgagctgtgtgaccttgggcaagttgccaagttctctcagtctcctcatctatgaaatataaataatgatagtatctattacaaagatactgtgaagagatagtgcatgaaaatgtcagaatacgccaggtgtggtggctcacgcttgtaatcccagcactttgggaggccaaggtgggcagatcacctgaggttaaaagttcgagaccagcctggccaacatggtaaaaccccatctttactaaaaatacaaaaattagccgagtgtggtggtgggtgcctataatcccagctactcgggaggttgatgcaggagaatagcttgaacctgggaggcggaggttgcagtgagctgagatcgtgccattgcactccagcctgggtgacagagtgagatgccatcttaaaaaaaaaaaaaaaaaaaaaaaagttagaatagtacctgctatataaggaagaacgcaaaaattgttagctattattacttttttattttttcagaatttctgggccatcttggatttgaccaatttatataaacgttagtttgtctagttgcacacacacagaaaatcctgttgagattctctttgaaattgcattcaattaatactgacatctttacagtgctggcttttcctatcttctccttttattcaggtgaatgattactggtgatttcccctataaatgtcttctacaacttttgctgtatttatatcttatagatttggttgatattttaaacaatatcttttgtcctagtatattctctagtttacttgctggcccatagaaagaaacattgctgatttttgaattttgtttttttacccagcatcccagctgattctcttattagttctaatagtctgcatatagataattcttgaattttctatatagacaatcataaaacaacgataatttatcttttccatttctgtgactcctacatctttttcttaccatactgcattggggtagatggtccagtacagtgttcaatagaactgtgatgacaggcacccttgccttgtcttcttactgtctttaactttaactgctcttaaagtttctccattaagcgtgaagtttgcttaaggtttcagtagatagtctttattaaactaagaactttgctctattcttaatattttttaacaaggtaaaaattatatcatgacagtatatattttacttaatgctttaatgtctttttcataactatatgagatgatcattttttcttgatattacattgtgataagatgagcgtattaattgtgttgaaacatgtacataaatatacatatacaggtatattattctgtagggtatcggttgctagtattttactttggatttttgcaaatgttcataagtgaagttgttctagaattttctttttaaaatattggtctggctgggtgtggtggctcatgcctgtaattccagccctttgggaggccgaggcgagctgatcaactgaggtcaggagttcaagaccagcctggccaacatggcgaaaccctatctctactaaaaatgccaaaaattagctgggcgtggtgacatgcacctgtaatcccagctactcgggaggctgaggcacgaaaatcacttgaacccgggaggtggagattgcagtgtgctgagattgcaccactgccctccagactgggcgacagagcaagacttcatctcaaaaaaaaaaaaagaaaaaaaaaggaaaaaaaaaggaaattgttcttatattgtttggtatcaagcttgtattggccctataaagtaatcataagtatatgtctttctttatcttttttttttcgagacagagtcttcctgtttcccaggctagagtgcggtggcatgatcttggctcactgcaacctccgactcccgggttcaagcaattctcctgcctcagcctccttagtagctgggattacaggcacgcgccaccacgtgggcccagctaattttttgtatttttagtagagatggaatttcaccgtgttagccaggatggtcttgaactcctgctctcatgatatcccctcctcggcctcccaaagtgctgggattacaggcatgagccaccgtgcctggctggcatatatgtttttcttaactagtttgtaagagataaagattatctgtttcttaaaatttggtaaaactcattacgaaatcatctgaaccacttataaagggcatatgggtcaagtttttggtgattcagtttcataaatgattagtgatgaatttaggctttctattccttcttgattcagttttgataatttagtttagatgatccattcatgtgttcttgggcttcttagcatagttattcgtaattttctcttagggttttataaatattgcctctatcttttttgttttttaatttttttattacctttcctatggtgctgagaatctagcttatatttcttatttatttatttaagacagagtctcactctgttgcccaggctggagtgagtcatgcgatctcggctcactgcaacctctacttccagggttcaaacaattctgttgcctcagcctcccgagttgctgggattacaggtgtgcgccaccacacccagctattttttttttttttttttttttttttatattttctgtagagatgcagttttgccatgttggccaggctggtctcgaacttctggcctcaagtgatccgcctgccgcggcctcccaaaatacttggattatagggatgagccactgctctcggcctatttattgattttttagagatgggatcttgctgtgtcacccactgctggagtgcagcggcaccatcatagctcactgcagcctcaaactcctgggctcaagctatcctcttgcctcagcctccctagtagctgagactacaggtgcgcaccactatgcccagcaaagttttgtattttttgtagagatggggtcttgctatgttgaccagactggtctgaaactcctgtcctcaggtgatcctcttgcctcagtctttgaaagtgttgggattacaggcatgagccaccactccttgccctttttttattcttaatattgtttatttgtgccaactctctttttctttattaatatagatgtctactacttaatcttttcaaataaacagcttgttcttatctatatttttgtttttcattatttttacctttatctacatttcttctgtttctagctacttgaattcatgcctagcttactttttgtttttcagtaaatttatttaaatctataaatttacctctaaatactgctttagctacatcatgcaagttttaacccatgtgtggtgttatgatatatgttttcttttttgagatgggatggagtctcgctctgtcacccaggctggagtgcagtggtgtgatcttggctcactgcaacctctgcctcctgggttcaagcgatcttcctgcctcagcctcctcagtagctgggactacaggggcatgccagcacaccaggctaatttttgtatttttagtagaaactaaagttcctgggctcaaacgatcaatgggcctcagctttctaaagtgctgggattacaggcgtgagccactgtatacatttaaccttatttcttgcatgtactacacgcctgatttcaaattttataggccactcattttctactctttgcccaagcagatgacaaggtttctggctgttttctcaggttagtaaatgatgttcctctagacctatttcacatatggagcagctttttatgacctccagctttttgtaagtgcctcactaacagctcatggtgtaaggtgaccatctcctggaccccctcactgcatgtatggtcattaaagccccagctcgcaggtatttaggcctcttgctgcggtggatttctctatgagccccttggcctcagcttccatacattgacctaacttccacttccctctgtttctggtacctggagatttctactttatctaggttttagatgatatttttgttatcatatttttgttcagtgttttgaagtgtttggatgggaggatgtggtgttatgatatatactagtttttatccatggttcctggctcataacaccccacagcccttgttacagtttttgttgttataatactgggtgtgttaggcctcagaggcagccctctgaccttctgccctcctttcacttaccccaaggcaggactctaatgttccgcctgtgagagtgttgatgcacccaatgccctggaggaaggaatgctgacattgtgaagcttccataaaaacccaggaggaccgggttgatggagcttctgaatagctgaacacagggaggttcctggaggatggtgcacccaggcagagcatggaagggctgtgcccctttcctcatactgccctacacatccgcttatctgtatctttcgcagtattctttatagtaaaccagtaaacctaagtaactttccctgagttctgtgagctgctccagcaaattcgctgaacccaaagacggcgctcttgagcctcaacttgaagtgggtcagtcagaagttcctgaggctcagacttgtgactggcatgtggggaggggcagtcttgggaactagccctcagcctatgggatctgacactatctcagagtagatagttcattagaggacacccagctggtgtctgttgcttggtgtatttggaaaaagcccccacacatttggtcacaagaagtcttctgtgttggtgattattatggtgtgagagtggaggaaaaacatggttagagagtttttcctatacagagggatatttctacccaatccgtcatactgactgaggttcttaactcctaattaacttaattaaattaactcctaatttaaaagtttattttgggccgggcacagtggctcacgcctgtaatcccagaactttgggaggctgaggcgggcagatagcttgaggttggggagttcaagaccagcctggccaacatggtgaaaccctgtctctactaaaaatacaaaaattagctgggcatggtgttgtatgactataatcccagcactcaggaggctgaggcaggacagtcacttgaacctaagctggggcggaggttgaagtgagctgagatcctgctactgcatcccagcctgggagacagtgtgagactccatctcaaaaaaaaaaaattattttcttatatgtaaaatagaatacagcgaagtcggccgggtgcagtggctcacacctgtaatcccagcactctgggaggctgaggcaggcggatcacttgacatcaagagttcaaaaccagcctgaccaacatggtgaaaccccatctctactaaaaaaaaaaaaaaaaaaaaatacaaaattagtcgggcatggtggtgcacgcctgtagtcccagctacttgggaggctgaggcaggagaatcacttgaacctaggagatggaggttatagtgagccgagattgcaccattgcactccatcctgggtgacaagagtgaaacttcgtctcaaaaaaaaaaaaaaaaaaaaaaaaccacacaaaaaaacagaatacagcaaagtaaatacatgtacattggctcctgcatgtgaaatctcctgctactaagagaatgcgggagagaagaggtctgaataaataataccgtgtgccactgccaccatctggaaccctgcacgcttactgcggtgtctcactctcatctggccaatgttttcagtccagaaaagatctgaatttcccaaccatgctgctccagtccctaaatgctgtcctttagattctctatagtagatcaaaacctcatgctcaactagcatcttaactcacatctatgttgaaaagaaaaaacatgtggaaaagttcctgttgtccttggatatgaagacgatgttctgtttctgctgggcatgcatgtgtacgtgtgtctctaacagtgcagaggtttacagtgagcaattgattctttacttgtggctgattccatctctgggaatgttgatccatatcagtggagcctatttataatgctgaaagcagtctacacaaagatattttccccatagtcattggccttctcctctggcccttttaagagctttatcagtgtccttctatcagtgacaatgggaaagaaatgggctttggagtcaagcagatctgggtttgaatctaagctttgccactaattagatatgtggcctttggcaagttacttaacacctctgagtctaaattgtcttctttataaaacagtaataacaaaatccacctcaaaaggttgttctgaagatcaagtgagataactggaaataatataaccttattataagcattatgttaatgctcacaaatgttagtttcctcccattatctccactctcctattcttattctttcaaagtagaattgtgcttcaggaggtctaatcaggctaggcatggtggctcaagcctataattccagcactttgggaggccgaggtgggtggatcacttgaggccaggagctcaagaccagcctggccaacatggcaaaaccccatctctacaaaaatacaaaaattagccagacgtggtggcacatgcgtgtaatcccagctactcaggaggctgaggcacaaggattgcttgagccggggaggttgaggttgcagtgagccaatattgcaccaaggcactcccgcctggacaacagagtgagactctgtctcaaaaaaaaaagaaggtctaatcagagacacttttggggagtggccgtggttactcctaatatcttgactttttttttttttttttttttgagatagagtctcactttattgcccaggctggagtgcagtggcatgatctccactcactgtaacctctgcttcctgggtttaagcgattctcctgcttcagcctcctgagtagctgggattacaggcacctgctaccatgcccagctaatttttgtatttctagtagagatggggtttcaccatgttggccaggctgatctcaaactcctgacgtcaggtgatccgcctgcctcggcctcccaaagtgctgggattacatgtgtgaaccattgcacccggccatatcttgatatttttggtaatcaatttagatttattttgggcgaatttcctgaaactttttggacagccagtttattttgcttctgtaccagctgttatagccctcccagcctattgttggatctttctgtagagtagctatgttgttacttaagaaccatgtccctcttaaccagaaatatctctttgccttatttgttaatgctcctgccttttaggagataaaaactctttatttcatttttaaagataacttttttttttttttttttttgagctggagtcttgctctatcacccaggctggagtgcagtggtgggatctcggctcactgcaacctttgcctcctgggttcaagcaattttcctggctcagcctcccaagtagctgggactataggcatacaccaccatgcctagctaatgtttgtatttttagtagagatggggtttctccatgttgaccaggctggttttgaactcctagcctcaggtgatccgcctgcctcagcccctcaaagttttgggattacaggcgtgagccaccactcccgacaacgataacattttaaatgaaaagaccccagagagactatgtaacatgtaaatataagctagatccacttctgggactaggttttcccaggagggatcatgaagtccccaagtgattgaggagtaggtgggggtagggaatcaccaaaggggtggctggaggagatagaagaactgaaggtatttttttgagaattttacaagacctaaaatctgcctgtttcacaacagtcatttatctgggccctgtggaatctgtatttggctcagaacatgttgctttttgcaagtatctcatcagaaataataataatgatgatagctatgactattcttttttttcttctctggattttgtgtgtgtgtgtgtgtctgtctgtctagacctctgatcatgacttcttaaggagaggaaaagactatcatgaaaataaaacgtaattggaattatggatttgccttcatgtaaatatctgtggctcagagcacaaaaatagcttttccattgcagagctaagtcaggagtttcatgagaaattgagcattgatgatctaatttaaaacagctatggcccagaaattcagagaaagggctgacacattggcctctgtttatacctttgaatattttcttcctagcttatggtaactcatattcagggacagtttggagggatgataaggccataagtttttttggtttgttttcgttttttgttttgttttgtttttttgagacagagtcttgctctgttgcttaggctgcagtgaaatggcatgatcttggctcactgcaacctctgcctcccaggttcaagcgatcctcctgcttcagcctcccgagtagctgggattacaggcacccaccaccatgcctggctagtttttgtatttttcgtagaaacaggggtttcaccgtgctggccaggcttgtcttgaactcctgacctcaagtgatccacctgccttggcctcccaaagtgctgggattacaggcgtgagccactgagcccggccataaggtttgatgctacaaaccttgtttttgttggcattggtttaatgttaacacgaacgtagagaaaaattttaatctcaatcctttgcaaccaggaatccctcctagtgtagctccaggcctgttgctcatttgtggcttgaggcagagccttatacattttgtgaaactcccggtgactcttgttagtcttggtttcagcagagggtgcctaattgaggtcattctcagcagcacactggtggtcaggtgctcctgattttcagaaaaaattaccttgtttaaaaaaatgtgatcaggctttcctgggaattgtctgataggcttggacttgcctaggtcaacatttttattcggtaaggcaggaaattgttgttttaggcatctgacatcatctttatcaatcacctgactataaactccaagtgagaatggctttataacacatgtgatggggtttcgccagctttcaacagcccctgcttgtcggtattggcctcctctgcacccacatattcccatctctgccagatgttctgacttaactgctcacatgtgtgcaaccacacgggcgcgcacagaccccggccagacatgtgtccctgctacaaactcctgcccctagcggctggcttgctgtctgtctaaccagaggggccatctttccatgattctttcgagggctgcctcagtcactctctgcctttggagacggagacacagaatctcctcaccagacaggcgctggctcctttagtggtttcctcatctgcctgtgctcctcactctccatggctatgtatcacctagttcctttaaccttatccttcctggaacttttctgtttgtcttctgatttgttactttgcttggacttgacttctcagtccttcccagcactgacctcactttgtttaggacttctctacctccacccctttgtgatgtatgtggctcaggcattcagcccccacttaatgagcagctgctctgtttcaggtacctacatatcacaattggtcatgatgctaaggctgacattactttctggggccaccaagtcactgtggagaatgatgagggtgatgttgcagttctgcaaagctttggggaaatttccccatgctgtgggatatgtatatgaaaaacaattctttctctcctcttatatttcatacttaaaaaataaatgtgtaggggcagagttgtcaggtttcaaccctcatgtcttacctgagttcctgccatagcctcctatctgacattcttgccattggccttgccatcttccggtctgtccttcactctttctaaaattctgatttgaccctgtttattgtctcttttaagtcttttcactgcatcctcattttcttttggataaaatcaagctctatcgtgagacagaatggcttcttcgacctcacttgcctgtagttctctccctgtgtcacctgcattaactcctggctccagcttggctgtctccctgcagtcaggctctctcctgcctccctgtctttgcacacacactcagctctgtgcactctgttctgcctgagcatatcagccttcaagatttagctctgaagctcatgtttccatgaggtgtttggagttctccaggacctgcatctttgtccccccatcacagttatggacacttgccaccatcattcctgccaatcttgattaggcatctggctttgtgtcccacagaacactggatttgtctttgtcacatgaacaaagtacttcagaattgtctcctagacagaaaatgccctaagctaaaggactatgatgtgtttttacttgcagcagtgtatagcatagttttaagagttgtcagttattgctattgctgttgaatgaatgcatggaagaattattatttttagagatggggtgtcttgctatgttgcccagtctggtctcaaactcctggcctcaagcaatcttcctgctttggcctcccaaaatgtggggattacaggtatgagctgctgtgcctggctatacaagaatcaattcacacacacctttcaccacattgcatgaacacacaccaagacatagatcccaatgggcagcttacttcaaatcttactgagaatatttacaaagcacatagtaggtgcttagtgagtttctgttgagtcaaataaagaatgaatgcacatccacacaaactatggaaaatatactcagaagagaggcataatgtaaccttacttccttttaactacagaaagaatatggggctggaaaataagattagagctcatgtttatcttctcagctatgttactccaaatgaatcagttgatctctctggactcttatttcctcatctctcaaatgaaatgttagaaaagataatatttaatgcccattgaacagtctaacttcaatcattattaggcttaaagtcaaatgaccggtgctttacattaagtggcatgaatttgggactctgatttttaggcctcaccatggagtgtgttcatgacaggcccttagcactgggcagagctgcaaagatgagaccaagagatggaccagagttcgcctaaagtgaggcaggaggccacaacctagttgttaagcaaacatagagctacgaggcatggccaggatgagaagccctgaggcggggatagcagtcagtgtcccatggtcgtgcggggtcaaagctggcctgagatcaccaggaaacaagtgtggaagcaggctgggcagtgtgctttcagggatatgctgaaaatgtgccctgctctcagggaagacttccagaaatctctgtgaaagccatcaatgccagctgtttgtctcaagttatctgaagggtggtcaagtgaaaagtgtttagatttagttgatgtctcccggagcatagatagaagccgggaggaggttaatttgcggttaataggaaggagaaaagtttaatcttgtctacatgataatgagatgaactcacttatacagtaatgaggtctccttcattggaagagtttacgcagcacagggtaattcctcatcaggaacattgtattagggatttctgaattgtgagcattgggctagatgcgttttaaagtttttttctgcttctcatgtccttaccaaatcaagtctaggtaaacactttcagatcccatagcccttccttttgtgaaatgatctcagcatgccctgatgtcctggtgaccagcctttggtaactctttagtctttgaatgtcccccttaaagtggagctccttgaatgggacctcatgtgccaggatgtggcttggccagggcctttctagggacatgacacaatttttacaggtagtggacttcatttattatttcctcatctattttctcgctctgacctgagctgtaaaagcacatagcattgagccttggctgcttctgctacatgcttatgccacctcaggtgatgggagacttcctttccttccattccacttttgtctgctggggaccctggggtaaatgtaatctagacagtgactctgaggctctgtactgggaacttccatggcattccattcttgctttctcaagagcctcatactttatgccaaatgcttgctttctctgtcttttgtttcctttcttctttcatttttctttttttttttcttttttttcttgagacaggtctccctctgttgcccaggctggagtgcagtggcgtgatctcggctcactgaagcctccacctcccgagttcaagtgattctcaagccccagtctccagagtaactgggattacaggcgtgcaccagcatgcctgcctaatttttgcatttttagtagatgtgggggtttcaccatgttgcccaggctggtcttgaactactgacctcaggtgatctgcctgcctcaccctcccaaagtgctgggattacaggcgtgagccaccatgcccggcctcatttttcttttttatctcttccttctaaaccctccatgcccactgaatactacaacatttttactgcacagtgtttttcttttcaaactcttggccctcttggtatccgagtgaataggaatgtgggcggcttctaagctcctttgtgcacatgaagaaaaatgcccagagaagttagtgacttgcttaatttactggcagagtcaatgagcccggaacccacatttcttgatttccctcaccgcctctgtcttggagatcacagtgcatttgctaatagcactggagtcacaaagaacagcaagctgttttccctctgtgtggtcattgtaccaaaagaatttatccgggaaacaatcccaggcctccatagactcagtaagaccacactaaagtaaactaaaaagagtaacaagagcagaagaatttatcaagtgcttcctatttttcaaagaaactttcaagtccattgccttatatgatgctccctgaagcaccttaaggtagaagaacccgcaggagcctccttttgtaagtaaaggtcaaggatggagtccaggcctggggtgggtagaggaggttgctggtccacaaaccttccatggaactatgcttcagaaaaccagggaaagggaatgaatgagttgtttccatctggtatcaaagatgtgggtgccctgaggacagacctagggttctggtttgtcagtggttcaagaagcatcctaggccgggcgcggtggctcacgcctgtaatcccagcactttgggaggccaagaagggtggatcacctgaggtcaggagttcaataccagcctgaccaacatggtgaaaccccttctctactaaaaatacaaaaattacccgggtgtggtgatgggctcctgtaatcccagctacttgggaagctgaggcaggagaatggcttgaactcagggggacagaggttgcagcaagccaagattgtgtcactgcactccagcccggacgacagagtgactccatctcaaaaaaaaaaaaaaaaaaaaaaagagaaaagaaaaagcagcctaggtccaggtttggaggtaggaacctggctgggggtgggtggggtggtgggaccgactcttgtcctcaacatcaggccagctccagctgagcagtttgggagaatataagtccagacaggagggaagagtactggcttgggaaaccagttgttaagacatgggacagcagggcagtggccccctgggcagtgaggtgacttctgggatctagtagatgctctagttgaggattctgaagtgtggagcaagacttgctctcaccacatgggagtcttgtcagaatcttaggttattcagtcatttattcagcagctatcaacaagtactcagtgaatataaatatatcttaagcatatttatatactgggcgcggtggctcatgcttgtattcccagcactttgagaggctgaggggagtggatcacctgaggtcaggagtttgagaccagcctgatcaacatggtgaaaccctctctctgctaaatacaaaaaattagctgggcatggtggtgcgtgcctgtaatcccagctacttgggagcctgaggcaggagaattgcttgaacctaggaggcagaggttgtagtcagctgagattgcaccattgcactccagcctgggcaacaagagtgaaactctatctcaaaaaaaaaaaaagacaaaaaccccacatatttatagtgtttcttatgaggatatatatgtgtgtgtatatatatattatatatatatatgtatcttatatatttactctttttaatgcacataaccaaaccatgggaatatgtaatattattctctattttatgaattaggaaactgaggctcaaggatgataactggttagctcaaagtccaaagttcctgtcttctgaattctttcactgatgtttatagctgctttccacatgttaagcagttcctaaatttcaaggtgtatgcctggaagaaaatagaggaaaacaccttcagagttattgctcaaggcattactttatctttagggactggaaaacctaaacacataactgaaattcaacttgagtcctttttgttcaacctctaagtgagcaattgtatggttggcattcactctttttcttttctttttacttaaaaaaaattttttgtaactattttttctttcttttactggtttctgtatttattattattattattattttttcaacttttagatcattttagatctaggggggtacatttgcaggtttgttacctgggtggcattcactctaagccaatcaagaacaacttcttcttaaacctggaattaacatctatgctctggtgtgtcctgacttgtgtcaggcaccctagttatgtggccaagtggaacatcgcaacagggagaatgggttggactatagatgggtgtttcctgggtaaatttgttatgggtgagaggcttggggacatagtgcaacaaatctgagtcctcctgcagtgaaggaaggtcatgccccaatgcttccagggctggggtatgcaattgagctcatagttcaagttcccttccctactttccatggcctgtgccatgaccaagggccaagcccctctgaccctgcccctgcccctggccttgtcttgttggctcagcttgatgccctagataccttcctaaccttcagatggtaaagtctctgccagctgtggctacctgcctgattctggggacggggcgctttgatggagatcctgagctgtctggaagtgaatttttctctgacagaatgtccttttgctgcttcctctccctttctttcccagccagaagcagttagtctcccgcattttccttggcatggctcttgccttgcaaggagcatgtaaaaaactctgggatgagtcagaacctggctgaagtgtcaggtacatttaccaaacattgattggactccaggccctcagcctatgccagggcagagaacccaggcatgaataagatcctatcatcccctgtgctggagttgctcccagcctagagacctgaggagacacccagcccactgtgacaagtgatgttgggagctccaacccggattcctggtcagtcaccaacttcacctactctgagggttagttcctggtgtcctgtgttttgggtggactctccaggtcctgacatctgccgtgggaacccagctctgctttccatggctgcattgcctgctgctccagtgatctgttgctgcagagcagctactccaaaatgttgaggttttcatcagcagatgaatggataaacaaaatggggcatgtccatgcaatggaatattattcagccttaaaaaggaatgaaatattgatgtaagcttctgtatggatgggccttgaagacataatgctatgtgaaataagccagacacaagaggacacatactgtatgattccatttatatgaggtacttagagtagacaaattcatgaagacagaaggtagagtggtggttgcaggggctggagagaagatgaatgaggactaagtgttttatgggtgcagagttttagtttggaaagatgaaaaagttttagaggtggatagtggtgatggttacacaacaatgtgaatgtatttaatgccactaaagtgtacacttacaggccgggtgtggtggctcatgcctgtaatcccagcactttgggaggccgaggtgggcaggtctcctggggtcaggagttcgggaccagccttgccaacatggtgagagcccgtctctactaaaaatacaaaaaaaaaaatttagcagggtatggtggcaggcgcctgtaatcccagctactcaggatgccaaggcaggtgaatcgcttgaacccaggaggcagaggttgcagtgagctaagatggcaccactgcactccagcctgggcaacagagtgagactccatctcaaaaaacaaataataataataactaaataaaagtgtacacttacaaatggttaaaagggtagattttatgtatgttttatcacagaaaacatgtagaggttgaaaatcacaatttaatattttctcttctggttctatgggttgactgggctcagctgagtggttcttgcttgaggtttctcatgtagttgcagcctgatggcaaatggacatccaaggtggtgccttggagtggctgctccatgtggcttctctatccagcaaagtagctgggcttcttacatggcatctcagactctgacaagtcagaaacggaagcttctgggtcatttcaggggtatgactagaattgtcacaacatcatgtttgctacattgtatggtcagagcagtgacagcgcccaccagatccaagaggaggggaaacagagtcttcctcttgatggaagaggggcaagatgacatttcagaagagcagggtatgaaagatattgttgctgtgccttggaaaacctccggcctgaaggctcaagagtttagacagaaaggcagcttcagggggcaaatacctctctgtagacccttcccttcccttctcttcccttcccttcccttcccttcccatcccgtcccatcccctcccctccgctcttcctcctccctttctctctctctctcgtttgttttgttttgtttttttcctgtcctgtcctgtcctttcctctttcctttttttgaggtggagttttgctcttgtttcccaggccagagtgcaatggcatggtctcggctcactgcaacctctgcctcccgggttcaagcgattctcctgcctcagcctcccaagtagctgggattacaggcacatgccaccatgcctggctaatttttttatttttagtagagacacagttttatcatgttggccaggctggtcttgaactcctgatctcaagtgatgcacctgcctcggccttccaaagtgctgggattacaggcgtgagataccatgactggccttagaccccttcttaggagaattgatcctcgtagattgtttgagtttgaagggaccttggaaactgcttgatagcagtgacttgttcaaacttacaaaggcagagagaagcagagttagaagaaaacctaaatactggcttcatggttcccaggccaggcaaatagctgtggggacttcacccaaaggacttctgtgtgctgtgagcaggaatacaaagtctgttggagagatgggtgtggggagagagcagaaccctgggtggtgtccagtggagaccatccatcaccttagaggtggtgtgagctcctggttgtgctgggctgcatctgttgggagctagtgtgccttgctgagctgggctgtgcagaggcacctgagatgacttgggcttcctgaggaggctgggtgttactcctttattttattttatttatttgtttatttgtttttgagacagagtctctctttgtcgcccgagctggagggcaatgacacaatctcggctcactgcaacctccacctccctggttcaagcagttctcctgcctcagcctcccaactagctgggattacaggcgtgcaccaccatgcccagctaattttttgtatttttaatagagacggggttttaccacgttggccaggctagtttcgaactcctgacctcaggtgatctgcctgcctcggcctcccaaagtgctaggattacaggcgtgagccattgcgcccggccttttgcttctttaaattggactcagagttgggaggaaagaggttagcctgccaggggctcaagcacccaaggttgagacttagagatctgtaaatttacatataggctaaggtcgaaaatgtcagttggcacatccagtcattggctcccacgtatgcgtttctactcaaactttaagtgcaaaattttttttttttttttttatttatttatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaagacagaggaatttttcttagtgcagaacaaaatgaaaagtctcccatgtctacttctttctacacagacactgcaaccatccgatttctcaatcttttccccgcctttcccgcctttctattccacaaagccgccattgtcatcctggcccgttctcaatgagctgttgggcacacctcccagacggggaggtggctgggcagaggcgcccctcacctcccggacggggcggctggccgggcggggggggctgaccccccccacctccctcccggatggggcggctggccgggcagaggggctcctcacttcccagtaggggcggccgggcagaggcgcccctcacctaccggacggggccactggccgggcaggggggctgaccccccccacctccctcccggacggggcggctggccgggtggggggctgacccccccacctccctcacggacgaggcggctggccgggcgtggggctgacacccccacctccctcctggacagggcggctggccgggcggggggctgacccccccacctccctcccggatggggcggctggccgggcggggggccgacccccccacctccctcccggacggggcggctggccgggcagaggggctcctcacttcccagtaggggcggccgggcagaggcgcccctcaactcccagacggggcggctggccgggcggagggctgacccccccacctccctcccggacggggcggctggccgggtgggggggctgacccccccatctccctcccggacggggtggctggccgggcggggcgctgacccccccacctccctcccggacggggcggctggccaggcggggggctgacccccccacctccctcccggacggggcggctggccgggtgggggggctgacccccccatctccctcccggacggggtggctggccgggcggggcgctgacccccccacctccctcccggacggggcggctggccaggcggggggctgacccccccacctccctcccggacggggcggctggccgggtgggggggctgacccccccatctccctcccggacggggtggctggccgggcggggcgctgacccccccacctccctcctggacggggcggctggccaggcggggggctgacccccccacctccctcccggacggggcggctggccgggcagaggggctcctcacttcccagtaggggcggccgggcagaggcgcccctcaactcccagacggggcggctggccgggcggagggctgacccccccacctccctcccggacagggcggctggccgggcggggggctgacccccccacctccctcccggatggggcggctggccgggcagaggggctcctcacttcccagtaggggcggccgggcagaggcgcccctcacctcccagacggggcggctggccgggcggggcgctgacccccccacctccctcccggacggggcggctggccaggcggggggctgacccccccacctccctcccagacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcctggacggcacggctgcccgggcgggggggctgaccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcctggacggcacggctgcccgggcgggggggctgaccccccacctccctcccggatggggcggctggccgggcggggggctgacccccccccacctccctcccggacggggtggctgccgggcggagacgctcctcacttcccagatggggtggctgccgggcggagacgctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgagcagagaggctcctcacttcctagatgtgatggcggccgggcagagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctaagtgcaaaattttttgttaaagcctttggtagtctttgaaattcaataaagttcacaagtattttgcaagcactccccatagacttggagacttaaatattattttttgtgtgctgaagtttgcttttgagactaagacattactaaagttaatgccaatcttttataactgctttgtatataggaccttaataaagaattttaaaaatctgtcaggtgcggtggctcatgcctgtaatcccagcactttgggaggctgaggtgggtggatcacctgaggtcgggagttcgagaccagcatgaccaatatggagaaaccccatctctaccaaaaatacaaaaattagctgggcttggtggcacatgcctgtaatcccagctactcggcaggctgaggcagaagaatcgcttgaacccgggaggcagaggcggcagtgagccaagatcgcaccattgcacttctagcctgggcgaagagcgaaactctgtctgtctcaaaatagagaaagaaaaaaatctttctctattttgagtattgttcaagttgttacgtatttatacacatatatatcaatggaattccgtggaagtagagaggaatagaagcaaacatgctgttgttatgttatctgtaattcagcagtacttgcctgtgtccacagtgatgtggacatttccaggtgagcatgatggtcagcaacagcctaggactggccatggacaaaccaatatgcatttgattttgtggcacacacacaatactgctaatctctgctcagtggcttgtggcccagtttaggcagccagagaagagatctgccatagctatgatcacagtgtgtgtaattggattttgtatctgcttactggggtgaataaagccaggtgggagaaattcttttacactggcgttaactggcacataactcaaatcaacagaaacatgagcagagggtatagtggcaaagggcttgtttgctgccctatgtctttactcaagcagatgtcccttccccatgaagccttccttgctcctgagccagggctgcatttgatactgctcattcctaacctcccagtgcactttagcagagaaggatgagcacattttatctttcatttgttgttttctctggcctttcctacaaggttataaaagccttaggagcaggcatctatacaggttgagtgtccctaatccaaaatctgaaatctcgaaagttaggaccttttcgaatgctgacctgaggctgaaaggaaatactcattggagcatttcagattttggattttcagattagggatgctgagctggtaagtataatacaaatatttcaaaatctgaaaacatctgaaatctgaaacacttctggtcccaagcgttttagataagggatattcaacctgtagtaacaagagcttctatttaacatctcccccatgtacctggcattttacagatgttactttatttagtatgtgcaagaatcatttaacataactgtcttactcccttgagcttgctataacaaaaaatagcttagattgagtagcttataagaagagaaatgtcttgctcacagttctggaggctgggaagtccaatatcaaggctccagtggacttgatgtctgctgaggtcctgttcctcacagatggcaccttctatgtgttctcagatggcggaagggacaaacaagctctctggggcctctttgataaagacactaattctgttcataaggtcagagcccttatgacctaatcacctcccaaagggcccacctcttgttactgtcacattggggattaagtttcagcatatgaattttgggagacataaacatccagagcataaacgtaactaatgttatccttgtttcacacctgagaagacagaggctcagggaattgaagtaacttgctccatgtcactgctaggcagtggcagggctgggattgaaacacaaatctctctaacttctaagcccttttcctaccataccaccagggaatcagacctctgcagtttccatggtgcttaactcagaacccagcacttaggggatgtggtctttgctgaatgaataagcaggggatgtgtgatacaagaatttgtaccagaacctttggccaacatttccccaaggcccagcatccaatggtagagatcctgggtgactctctgtagatggtggtccttcacttctcatataggccattccaatctgaatgcagcttgttttgtgtgtgggaaggaattacgttttagggtattaaatatcctttctgggccatttagttacttgtctcctctcaaaacactaaaagcaattacatggtaattaagataaattacttgaccaattttcatagcaaactgattggtttcacttatccccccactgaactgttaagacctggcgagatcctttttatagttctttaaacttccaggactttctgcttatcttcaggaaggacagtggaccttcaggggagaggagaaggaggaaatttgcatatttaaaatgtgtgatctgagccaaacgctcttcagctaacttgatctcgcatcattttcccagcttcctttgagaattcagaatcaaaattcaggcatcaccatctagtgaccacagggtcctgcaccccagcccaaacctggggaccccttagggataatgccctttctcatttgtctttgagtgccctgctctttccactgaagagcccacagaacacagatgccagcaggcagccctgaaagcaggccttgtttgcaggtctttgcctgaacgaagcctgcttgtctgcctccttctgaaggccaggggtgggctacattttttggagagtaggaagcccaggggtcctcttcgtgctgctcctgagaacagaaggtagatagggtatgaagaggcagccgttgctagggctgccagaaaccagtccacccaggaaacaacacagctccacagctgcagtgagcacagctgcagaaacccaggagctgggcgagagggtgggggttaagatccaggcctctaccccaggccccagcatccatgctgggcaagcaggccacgtgctcccttgcttccagactggcagcctagcctccttgaaattggccctcactttatccccacccacctaatcagcaagccccaaagtctccccttgtctctgctctctgctgttcttctagggcccatgagggaacttttctgccttgggggctcctccacctcctggtttcaccttagctttttgtgtgtgtcttactttctccttttcatttcctcctcttgtaaagtgacccagccctggggctttacccattgtcttgcattcagctctcacagcgctgaaagacctccactctctacctctagcccttggttttctctctggatactgcctcttgtgtctagcttcatgaatgaggcttccatgtggacatacctcagacctgaccaatgtgcataaaaccagctccctgtcctgtctctcctgtggctccactagtccaagggccagatgccccactctcctttgttttctagattatatttggtgtacaaatcccatcaaggctttacaaatattcttttatctgccctttctcccttccgatttccatctcggaagtcagtatactatagggcaaagtgcagaatttggggctatggacagggttcaactctgatagcatcattttctgattgtgcgaacctcaggaaaatcatcaaatagaagcctctgattcattatctacgaagcagacacatacagaagggtggatcccagctcactgacctccttgcttttgacattttggactggaaaattcttgttgtggggctgccctgtgcattgtagaatgtttagcagcatctctggcccctacttactagacgctagtagcattcctgattgtcagttgtgacaatgaaaaatgtctccggacactgccaaatgtttcctggggagttaacttgctcctgtttgagacccattggtacagagtaatgctaagtcctgggtggtggtaatgaatattaacccaggttttcaggttttcacctttcagtcgtcagccacatgtatgaagttcccacattacttttattttttatttttttgaaacagagtctcactctgtcacccaggctggagtgcagtggtgcaatctcagctcattgcaacctctgcctccccggttcaagtgattctcgtgcctcagcctcccgagtagctgggattacaggcgtgcgccaccacgcccagctaatttttgtatttttagtagaaacggggttctaccacgttggccaggcttgtctctaactcctgaccttaagtaatccacccaccttggcctcccaaagtgctgggattacaggtgtgagccaccgcacctggcctcatgttacttttgattagtctttttcccagttagttttgacatctgcaggtgctgttctgacttgcttgattaattagttcctttcatgttacacatttttcaaatcagaacacactgggattgaaccttgatattctgttgtttgagaatgagagaccagttcagagttgttcagaaacctcagaactcccagtggggatgcctgcaggtttgacaccgccttgctgctcagggatcctaggcttgtagcaatggcgaatgctgatttgaacaccctgcccatacttgtgacaagcatttgtttaaagtgcctactatgcagaattttgctaacgttaatttatttggtccttgtgaagtaggtgttacttattttcactttacagaaaagcaaagtgaggccaaaagatacgaagcaacactgcctcagagatgctaagtagaagaaatgccatgagaggccaggtgactttggcatgaaagctggtgatgctaaatctctgtgctcttctgcctttttgggttgagcctttgctgtggctagagcacagaagcttatgaaggaggagctccttttaattgtggctcagaagttgcccatcttgccacctacaggttctgtgggtggagagcagacctataggccagacagatggctggttgagaccatgagccccagcactgtgtccagcacagggaaagcccccattaagggagcttcctccttgataacttggacaacacttggttgaacaacacactggatgctcactttccccagagagaacagcccaagagttcagtgatacttactcaaattgtagatgagagactgactgaccttgccctctgaagtgggaaactgaggagggttcccagaggcctgtgaagggcaggtaaccaggaatggtgacatggtaaggttgagtggagacagactgtggccccatggccctaggcagagtgcacactgggcatcctgcagcattgcagagacccattcccatgggaaatcccctgatttctccaccttagccaggagagtcctggggcctatgggtgggaggcttgagtgttgacagtcagaggggctgtgatgagagctgccaggtgccattctcaatgcccagaggatgctctggggaagaaagccctcacatgtttgccaaggtcaaaagcaagagctcattccagtcatggtctgtgtggaagctctttggtctgctgtcttggaaagcaaaggcagggatgtcctcctacgcggactgctggtctcccaggaaaagaatctgtggctcttacttgtcctgagtgatgctaagaccctgctaagtcaaagaagctgctataggcacagagccagtacccatggtcatagcagacagtgggcaatagaatacaaaaggccgaggtgtccagaggtaaaggtggactgtgtgttccctagtctcagactcttgtgtcttcagcatgctcctgagggttctgaggcacaccctccacgtggctttttttgtttgtttgtttgtttttgttgttgttgttgtttttgagacgtggtctcactgtgattcaggctggagtgcagtggtgtgatttcggctcaatgcagcgtcaaccttccaggttcaagcagttctctcacctcggcctcctaagtagctgggactacagccacatgccaccatgcctggcgaattttttttttttaacttttaatggagatgaggtctcactatgttgcccaggctggtcttgaactcctgactcaagcgatccacccacctcagccctccaaagtgctgggattacaggtgtgagccaccacgcctgccctccacgtgggttcttaaggaaaactacctgtttctccctcctgttagaggcccgtgactggctctgggaaggattgccatgaagagacctgtaagccctttctgataaggatttctcaaaggcatttgaccatgggtattttctccacaaacctattaagttttctccatttagagagatggtatcttcaagaatgtcttcaagtttgagctactatcacaaaataccatagaccaggtggcttataagcaacagagatttatttctcacagttccagaggctgaggtctaagatcagggtactagcatggttgggttctggtgagggttgcagatggctgatttctcattacatcctcacatggcagaaagagagtgagctaggtcctccagtggcagtggcggtgtcttcttcttcttcttcttcttcttcttcttcttcttcttcttcttcttcttcttcttcttcttcttcttcttctttcttcttcttcttcttcttcttcttcttcttcttcttcttcttcttcttcttcttcttcttcttcttcttcttcttcttcttcttctccttctccttctcctcctcctcctcctcctcctccttctccttctccttctccttctccttctctttctccttctccttcttcttcttctttcttatttcttcttcttcttcttccttctttcttcttcttcttcttccttatttcttctttctttctttctttctttttttttttttttttaagatggagtctcactctgtcacctaggctggagtgcagtggcacgatcttggctcactgcaacctctgcctcctgggtccaagtgattctcctgcctcagcctcctgagtagctggaattacaggcgtgcaccaccacgcccggctaatttttgtatttttagtagagacggggtttcaccatgttgggcaggatggtcttgaactcctgatatcaggtgatccacctgcctcagccttccaaagtgctgggattacagacgtgagccactgtccctggccctccggcttcttctttttttttttttttttttttttataagaaggagtctcgctctgtcgcccaggctggagtgcagtggtgtgatctctgctcactgcaagctccgcctcccaggttcatgccattctcctgcctcagcctcccgagtggctgggactacaggcgcccgccaccacgcccggctaattttttgtatttttggtagagacagggtttcaccatgttagccaggatggtctcgatctcctgacctcgtgatccacccgcctcggcctcccaaagtgccaggattacaggcgtgagccaccgcgcccagcctccgacttcttatacaggtactaatcctattcatgagggctctacactcatgacctcattaccttctaatggccccatctctaaatatcatcacattgggattcaggtttcaacataggaattttgtggggacacaaacattaagcccataacaaaggaggatccctgagcagggaattgggcacagggatctaagacagggaattatattatcagatccccagggcagaatacaggcatggtcataagttaggcagaatggagacacagttctagaaaaagattcatagcaagttgtcttgatggtaaaccaaggtccagagttgggcctctttagcttcctcctgactggagaaagcaggtgttctaaaggctagagtagggacagaggaggagaaaggaaaactaacatatatcgagtacatttatgaggcaatttacatatgaggtaaaattaatattaccattttacagatgaggaaactgtggctcagtgacctgcttagcaaatttctatagcatctatggcagtgacatgaacatggtatggatacatcatagaaatgtcatgataataaggataaaattctaaaatccgaatacccacccaactccaaatcttctctttgttcatgtaatgaccattttctgggactagccagtttgggttggattctgttcatattactgtcaaagataaacacagctggacattagttaaagtggtgagaatagatttttaattggtaataactattgcaacagggaaaagagtctagcttgaaccaaactcaatttccatttgtacagaggtgactgggcatattagtttttatttttttgagatggagtttcactctgtcacccaggctggagtgcagtggcaccatcttggctcactgcaacctccacctcccaggttcaagtgattctcctgcctcagcttcccaagtagctgggattacaggtgcccaccaccacgcccggctaatttttgtatttttagtagagacggggtttcaccatgttggtcaggctggtctcgatcttctgacgtcaggtgatctgcccacctcagtctccaccatgcccggctaatttttgtatttttagtagagacggggtttcaccatgttggtcaggctggtctcaatcttctgacgtcgggtgatccgcccacctcagtctcccaaagtgctgagattacaggcgtgagccaccgcacccgacctgtgactgggcattttaaagggagaatgagctcaagggagtcagggaagtgaaaaattacaaaaagtgggaaggaggggttggtccatgtgaaatccatctgggtttgcaaactggcatttatcaaagttaggctcctactctcccactgacgctagagggaccctatcttcaggcattgattgaaacaaacattgaattcttcaggcagccttgcgttttctcaggcgggcactttaagaggggctggtgttgtggtggtgtggcctcgagccattggaagcaatattagtgtttgttcaagtcgttacaggctgaagttgaaaggcctattcaagaagcagactctgagcctggctagaatttggtcaaagagagaatctatgtcactattctctaaatttaggaaatgaacagattattagaacaaggtaaaaaaaaaaagttggcacccaagtttatgctggaaaaatgaaggttaaatgccgtaggggaggggcagtgttagggaattgagctggaaccagcactgacaatatttgaaagcatggttaggttttgctgtggtttaatattttacaaatgttattccctgtcacatagctgaactaaataccccacatgtttgcgattaagcattatgagctgcagaacatatgtgctaataatatggttcatgcagcctgtgggcacttctcccatgacctaagatgaaggtgaggctttttgattttccttaaggtattgtgttttctgatgattcctttttgttccaaactttcgctttcccctttagaacgaagccttttacaggaatgatattttatttttatatatttattttttttgagatgcagtcttgccctgtcatccaggctggagtgcaatggcgcgatcttagctcactgcagtctccgcctcctgtgttcaagcgattctcctgcctcagcctcctgagtagctgggattacaggcgcccaccaccgtgcccggctaatttttgtatttttagtagagacggggttttgccatgttggtttcggactcctgacctcaggtgatctgcccgcctcggcctcccaaagtgctgcgattacaggcgtgagccactgcacctggccaggaatggtattttaaatactgtcatagcaagcccttaagaaaattcttcacagctgcatgttaacacactggcctgtccctgactttggctttgtttccaggatatacagttgtttctggaatgtacagtagctagattgcagccctccaatcatacaaaaacagactgagggtttggaaatgctgctaaagtctagttacagtgttgctcttgaggagtctggcgctatagggagtctgagaattccttatttgaaaaacagccaatggaaccgcacagacacactgaaattaagacattctttctgtagattatgcagcattgttagagagcaaagaaaagccacaggaataaaggactcaattcagccctctgctgaaggagagggtgttcctgaggcttgagtaggaattgacccaacagggacagtttggttgggctgataccaggaggctactgagaggtgtcgatgatgccttcctgagctctgctgaatacctccttggcatcagtcctcccccaacatctagcagaaacagaggagccagacattagggaccacattggggcgtgcttttccccacagatgcatactgaagtggggacaaagtcttcagctgccatatgacctggattgctgtttcacctatcacatgcatctaatctgacttcaacaatctacaggagaaggtagaacttcatatttacattttatttgagtggtttatgaagaaaagtagaggaaaactgcaaagaacggcagaagtagactcttgaggttggaggggagtaggggatgatggtgtgggagggatgaactttgcagggagttacacaaaatttggaaaattacagagaatactggaatcgccactaaaagagaggcagggcacctaaatctatttattagacaacaattctgagaaattattcatcactaagggcaggacagtcagttgatgcagtcaagaaggggcaggaaatagggcgagctgagttatgaaagccattctcagaaatgacccaaatttgtactgagctgttgttcttgagcaaccttggggaaaattatcagtctgcttttcccacagcctgatgtccaaggggcagatacgtgtggtgggcttgctggagaaataggctcttctcacgtgagaacagcatccttccaatctagagctcctggctccaggaagtggtggtggctctaccctggtgctatttcattagtgaagggtggggtggtggaaagtgcagaaaaggcaggacccctgacaccagcaaggcattggatctctctggacctccgggtggtggactttgggactggacagacctggtcacagtctaggttctacatcttactggtcgagcaactttaggcaagtagcttaactcctccgaacttattttccttttctaccaaataatgataatattacttcatgagtttgtgagtattaaatgagatcatgcatatacagcctacagcccttagcacaccatgaacacatagttatttgataaatgtttgttagtgtggttaattgaacagaaagccttaaatgtcttcctaaccctaaaatccagtgattctttgaactggggagggcagtagagagatttaatttgtggaaaaatgaaaagaccatttaaaattattcaatcagaaatgtattaagctttgtgtatttgtgtcaggcatttgtagacagtgtggaaaatgtcttatccaatgattctttgaactgggagggaagtagagagacttaatttgtggaaaagtgaaaagaccatttaaaattattcaatcagaaatgtattaagctttttgtatttgtgtcacaggcatttgtagacagtgtggaaaatgtcttaataaatgagacatgctctttccttgaaaaagcttcagtctgactcacaaagagtatatgaattttttcctatgatggcttgaaagattttatcttcaaattcctttttgtgagattgtttttccataccagtgcttcttatttatagggcttgttgcaagtaatttgcaatattgttacaggttgagtatcctttacaccaaatgctcagaccagaagtgttttagatttttttggattttggagtatttgcatccccaaatctaaaatgctcaagtgagcttttcctttgagtgtcatgttggcattcaaaacattttgaattttggagcaattcagattttgtgtttttgaattagagataatcaatttgtaataatatttaaggtattgctgtttgtgaaagatgtatttttaaacgatttagagtcaattcatgataatctccgtaatactcttacaagaattccaggctgggcatggtggctcatgcctgtaatcccagcgcattgggaggccaaggcagacagatcacttgaggtcaggagtttgaggccagcctggccaacatggcgaaaccccatctctactaaaaatacaaaaattagcagggcatggtgatgcacatctgtaatctcagctactcgggagcctgaggcaggagaatcacttgaacccgggaggtagaagtgtagtgagctgagattgcaccactgcactccagcctgggtgacagagtgagactcagtctcaaattaaaaaaaaaaagaattccaatatgatttcttaagtgggagaaaggggtggattgtacaaactgtgtgcaagtgcaacctttgttcgtgttttgtgtgaaccctcctattgctgatcaccacttaaaatggtagggacaattagttagttcagggcttccctaaatatggggagtgctaaattctgggtacatccaagagcacgtgctaggcttttgaatgccatttgtcacacatattgaggtctaaggttgcaaaccattgtatactagatccttgttattcctggtgtgaataggcatgtgtgcctacttttaatttcttcttgagttcagtgctttgaaaacagacagctgaagaaaatgtctaatagtctaaagaggaagcaaacactttcctagaaaccttcgaaactcagaaatggatttctagaaattctagccataatacatactccttttctttctgggcctcattcagaatcttgatgtctcaactgtctctgagttttttttttttttttttttttttttttgtctttccccagacagagtcttgcactatcccccaggctggagtgcagtggagtgatcttggctcactgcaacctccacctcctgggctcaagcgattctcctgcctcagcctcccgagtagctgtgaggagcaccaccacacccagctaatttttgtatttttggtagagacagggtttcaccatgttggccaggctgctcttgaactcctggcctccagtgatctgcccgccttggccttccaaagtgctgggattacaggcatgggccactgtgactggccttgtctctgaattttgtgtggaattgtcctctaggagtttgcagggtattccagattgaaagtagacctttgaaaagtatggggcatgcaggctgggatggaatccacagctgagggaaaagccagggaatcaaaatagaggaatctttgcttcagaggaaggcagctggggacttggtgccaggagtgtttggttcccagctctgcactaactggatttgagactttggggaaagtgcccagaagctgtggtctgctctggattgtcatgcagtttaaatgagacgttgcctgtgaagggctttctgggaggaacaggtacatatctagaccaaccctacttgtaatgcaggaacaaaacaaaactgaaattacatagatgctgccccttgaatactcttggattccagggtctcaaagtgcatagggtaaagtagcagatgactgaggaaaatgcatctaaacttctcttagccttcttatctctcggagacccaataggcttctaacagaccaaggctctggacagggtgtggccccctttcctatgagaggattaggagggaaggaaagggaaagaaggtgctgcatgaaattgatcttagttgttgactttgtgccaactggctggtgggggttttgagaccagaatagaaagatgaagtcatatagaaggatcagctgaaagaggtaagagaaacggaagcaagtgtaaaaaggattgataggctgggcacggtggctcacgcctgtaatcccagcactttgggaggccaaggcaggtgaaccacaaggtcaggagttcgagaccagcctggccaacatggtgaaaccctgtctctactaaaaatacaaaaattagcctggcatggtggtgggcgcctgtaatcccagctactcgggaggctgaggcaggagaattgcttgaacctgggaggcagaggttgcagtgagccaagatcatgccactacactccagcctgggtgacagaggaagactccatctctggaaaaaacaaaaaggattaataaaggaagatagcaagagattgaagaggggaggaagaggagggcagtgggaagcaggcctcccctcgacaatggggaatcagagctgctgactccagaacagtattaaacttccaggacaaaggtttgggttcctattgggcaccatatgaagttctatttggttgaataaactcacatcacatttgctgagtgcctcctatggaagagtcctggacgggggtgaaaggtggacagtgagggggtaggagtgcactttgcatagatctgggtttcaaggtaggagatgtttgtgtaaggtttgcttttaaaaaattcagggctgcttacaaagtaatgggcttgatttcttttctcctgcttatggaaatcagtttatttgtctcataataagcaaaaactgaagaaaccaacaccactgttgcaaattttgaagctacaaggaaaactgatgaggtgaaatttttggcatacatcagaatcgtattcagtctgaaacggaattatttcctctttttcttttctttttaataaacccaactaaagtaaatattttcctgagctctcacccctataggagggttattttggccttctgaagagggtgagatggagatatagtgctgctgatttcctacctgtgagcctcctcgtgggtcccatcgaaaccctgctctccctgctctgagggaaggtgcttcacagcaacttcagcctaagggcagtgacagtgaaatggcctccagggagccagcagcctgggctgccctccgctgtgtgtttttgtgccctcaggaatgtgtggatgcagcaaatgacaacagtgagtgctctgtccctagcggagccccaggccctgtcactttttgtcttggctggtttccaaggttgaatgattgcattggttgaagcttcattatccacaaggggaggcaagacagtgggctggagggagaaaaataggcctttcccacgggcatgattccagcagggtttgcatttttacatcagtagatctcagggactttcattttctgtcagtttgggccgtttgccctatcccagctacttgggaggctgaggcaggaggatcacttcagcccaggaatttgagaccagccttggaaacagcaggatcccacttctgaaagataaataaataaatatcccagcactaaagcccatgtatttagtggtaatacaatttctgcttttgacagcattttccactggatgtcagccgccatagcatcactttggagttggaaaggaccacagagctcattctagtgtaatccctgaatgtctggagaggctgtgcacacagctagtgagtgacagagtggtgcccagaatttgggttacccaagccccacatcagtgttgtggtccctacacttcactgcctctggtgtcattagaataatttcagtaatttgttgtatcaggttgggctgaagtgacctgtattcaaatcctggtttttccacacctaggtatatactcaagaaaaaggatcacacgaaacttatacacaaatattcagagcagcatttttcaaagtaactaaaaagtggaaacaaaccaaatgtctatcaactgataaatggataaacaaagtgtgatatttccatgcagtggactactcttcagccttgaaaaggaaggaagcagtgatatgtgctaccacatggatgaccttggaaacattatgctaggtgaaagaagccagacacaaaagccatatgttgtatgattcagtttacataaaatgtcctgaataggcatattcacaggcacagaaagtagtttagtggtttccagggcctgtggggaggggagtatgtggagtgactactaataagcatacagggtttattattgggatgaaaagaatgttgtggaatttggccaggtgcagtggctcacacctgtaatcccagcactatgggaggccgaggcaggtggatcacttgagatcaggagtttgagaccagcttggccaacatggtgaaaccctgtttctactaaaagtacaaaaattagccgggtgtggtggcgtgcacctgtaatcccagctacttgggaggctgaggcaggagaatcgattgaaccctggaggcaaaggttgcagtgagtcgagatcgtgccactgcactccaacctgagcgacagagtgcaactccatctcgaaaaaaaaaaaaagaaaagaaagaatgttgtggaatttgatagttgtgatggtttcacaattgtgttaacatactaaacatactaaaagccactgaactgacacttttttaaaagggtgaattcatggtataagaattatatctcagtaaagctgttatttaaaaaattctggctctacctcttactggctgggcgactttaggcaatgaacctaaagccaagtcatctcagctatgaaactggaataataatacacttcacagggtctttttgataaacgagattgtgaatttgaaaatgcttctaaagtgtaaacctcacatatttttggactgtcaatgggttataagttcattataaattggatttttaatcttctcctcctgtgtttttcacaatactaacaaggtctgggtacatagtgatcactcaaataaagatttattgagttgattcaaatgtatttcagttttattcaattgtggtaaatgaaactacacaacaggaaatctactcttttaaaagttttcaactgttaaaaacggtgttatgaacgatatgcacattgttgtacagcaaatctctagaaccttttcatcttacataactgaaactatatccactgaacagcaacttcccatttttacctactcccagttcctggcaaatgccattttactttctgcggtatgagttagactactttacatacttcgtataagaggagtcatgtaggatttgtccttctgtgatgggcttactgcacttagcataatgtgctgaaggttaatctatgttgcaacttgcgtcagaattttcttccttttaatactgaataatattctattgtatgaatatactgcattttctttatgcatccatccatcaattaacatttaggttgtttccatctgttgactattgtaaataatgatgcagtgaatatgagagtgcaaatattttttcaagaccctgttttaaattcttttggataggctgggttctgtggctcacacctgtaatcccagcactttgggaggccgaggagggtggatcacctgaggtcgggagttcgaaaccagcctgaccaacatggagaaaccccatctctactaaaaatacaaaattagccgggcatggtggtgcatgcctgtaatcccagctactcagagggctgaggcaggagaatcacttgaacccgggaggcagaggttgcggtgagccgagattgcgtcactgcactccagcctgggcaacaagagcaaaactccgtctcaaaaataaataaataaataaataaataaataaatgaattcttttggataaatacccgtaagtggattgctggatcatatggtagttctatttttagtttttgtttgttttttttttttttttgagatgcagttttgctcttgttgcccaggctggagtgcaatggcgtgatacccattcactgcaacatctgcctcctgggttcaagcaattctcctgcctcagcctcccaagcagctgagattacaggtgtgcgccaccacgcctggctaattttgcatttttagtagagacagggtttcaccatgttggctaggctggtcttgaactcctggtcttaggtgatccacctgtcttggcctcccaaagtgcctggattagaggtgtgagccaccgcacctggccctatttttaattttttgagggccttccatattgttccccataatggctgcaccactttacattgccagcaacaatgcacaagggttccgatttcttacatccttgccaagatttgttgttttcctttctttttttttttttttttttttttttgagacagagtctcactgtgttgcccaggctggagtgcagtgggatctctgctcactgcaacctctgcctcttgggttcaagtgattctcatgcctcagcctcctgagtggctgggatttcaggcacccaccaccacacccagctaatttttgtatttttagtagagatgagttttcaccatgttggccagactggtcttgaactcctgacctcaagtgatcctcccgcctcggctttccaaagtgctgggattataggtgtgagccactgtgcctggccatattatcctttttttttttttttttaaaagaaaataatggccattctaaaaggtatgaggtgatagatacctcgttgtagttttgatttgcattgtcctgatgattagtgatgttgagcatcttttcatatattttctggctatttgtatgtcttttttggagacatgtttattcaagtactttgccaattactaaattgcatgatttattttcttgccgttgagtttattgagttccttatatgttttggatattaattccttataagaaataccgtttgcaggccgggcgcggtggctcacgcctgtaatcccagcattttggaggcagagacgggtggagcacaagttcaggagattgagaccatcctggctaacacggtgaaaccctgtctctactaaaaatacaaaaaattagccgggcgcggtggcgggcgcctgtagtcccagctacttgggaggctgaggtaggagaatggcgtgaacctgggagatggagcttgccgtgagccaagatcgcgccactgcactccagcctgggcgactgagcgagattccatctcaaaaaaaaaaagaaaaaaagaaagacagaaataccgtttgcaaatattttctcctattctttatgttacctttttactctgttgattgtttcctttgctgtgcagaaacttttaagtttaatggtgtctcacttttctgtttttgcttttgttgcctgtgctttgctgtcatatccaagaaatcattgccaagaccaatgttatgaagattttcctctgcatttttttctcagagttttatagttttcaccgggcgcggtggctcatccctataatcccagcactttgggaggccgaggtgggcagatcacgaggtcgggagtttgagaccagcctgaccaacgtagggaaaccccatctctactaaaaataccaaaattagcctggcgtggtggtgcgtgcctgcaatcccagctactcaggaggctgaggcaggagaattgattgaaccagggaggcggatgttgcagtgagttgagatcgggccactgcattccagcctgagcgacagagcgagactccgtctcataaaaaaaaaaagaaaaaaaaacaggtttttttgtttgtttgttttttgtaggggaggagattcactcttgttgcccaggctggagtgcagtggcacaatcttgactcactgctacctccacctcctgggttcaagcgattctcctgcctcagcctcctgagtagctgggattacaggcgtccaccaccactcccggctattttttatatttttagtagagacgcgatttcaccatgttgcccaggctgatctccaactcctgacctcaggtgatccgtccacctcggcctcccaaagtgctgggattacaggcatgagccaccgagcccggccaaaaaaaaccaaaaaaacaaaaaaccccccagagttttatagtttcaagtcttatgtttaaatcttttatctattttttttttgagacggagttttgctctgtcgcccaggctgaagtgcagtgacacaaccttggcttactgcaacctctgcctcccaggcaattcccctgccttagcctccagagtagcttggaatacaggtgtgtgccaccaggcctggctaatttttttgtatttatagtagagatggggtttcaccatgttggccatgctggccttggacttctgacctcaggtgatccacccaccttggcctcccaaagttgttgggattacaggtgtgagccactgcacccagcctcttccatccatgttgagttgatggttgtgtatgatataagacaagcttgtccaacgtgcagcccacaggctacatgtagtccaggacggctttgaatgctgcctaacacaaatttgtaaactttcttaaaacatgagatccttttttttctttttttaactcatcagctatctgtagtgttagtgtattttgtgtgtggcccaacacaattctaattctcctttttctcctcctccttctccgcttcctctttctcctccttctcctccttctcctccttctcctcctcctcctcctccttcctttttttttttttttttttttttttgatatagagtttctctctgtcgtccaggctggagtgcaatggtgcaatctcagctcactgcaacctcctcctctcaggttcaagcaattctcctgcccaccaccatgcctggctaatttttgggcaggtacccaccaccatgcttggttaacttttgtatttttagtagagactgggttttgccatgttggccaggctggtctctaactcctgacctcaagtgatctacccaccttggcctcccaaagtgctgggattataggcgtgagccactgtgcctggccttaattcttcctccagtgtggctgagggaagccaaaagattagacatctctggtataagattacagtttagtttcactcttttgcatgtggatatcaagttttttcaacaccacttttttttttttgtttgagacaaagtttcgttctccttgcccaggctggagagtaatgacacagtctctgttcactgcaacctctgcctcccgggctcaagcgattttcctgcctcagcctcctgagtagctgggattacaagtgtgtgccaccatgcccagctaattttttgtatttttagtagagatggggtttctccatgttggccaggctggtctcgaactcctgacctcaggtgatctgctctcctcagcctcccaaagtgctgggattatagatgtgagccactgcacccagccctctttcttcctttttttttttgagacggagtctcactgtgttgcccaggctggagtgcagtggcgcatttgtggctataaagttccctgtgagtactgttttggtgtgctgtgttttcattttcatttgtctcaagatattttctaatttccttttttatttctcctttgatccattggttgttcaagagtatgttaattttcaaatatttgtgaattttttagttttccttctattattaatttctagttttattccattgtggttagaaaaaatgtttgtgtgatttcaatcttctcacatttgttaagatttgttttgtaacctaacgtgatctgctttggcaaatgttctgtgtgtgcttgagaagaatatgtgttctgctgctgttaggtggaatgttctgtatatgtatggcagtttagttgagtttatagtgttcaagtctattgtttctttagtggtcttctgtctggatgttctgtgtattgttgaaagtatggtgttgaaatctccaattattagtgggtggctatctatttctctcttcagttctgttaatgtttgcttcatatatttgggtgctctgatgttggatatataaatatatatatattttcagatggagtttcactctgtcacccaggctggagtgcaatggcactatctcagctcactgcaacctctgcctcccaggttcaagagattctcctgactcagctacctgagtagctgggattacaggtgcccaccaccatgcttggctaatttttgtatttttttgtagagacagggttttgctatgttggccagactgctctcgaactgctgacctcaggtgacctgcttgcctcggcctcccaaagtgctgggattacagttgtgacccaccattcccagctgggttaatatatatttataattgttgcgtcttcctagtgaattgactcttttatcattatattatgtccttctttgtctcctatgatagtttttgacttaaagtttattttgcttaagcatggctactcctgctctctcttggataacatttgcatggaatatgttttttcatcctttcactttcagcatatgtctgtctttaaatctaaagtgagtaccttatagacagcatacagttggatcatgttttttttttaatccacttagccaccaacagaattataatttttaagcatttatcagaagtaaagacatttagtaatgattccccccttcattttatatacctattttctctttattttatttttttaacagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtaaatattcaacaccccaagtttattttcatgggaaatagcttaaatattcttaccttcctccttgggttgaaaccaggtagagacagatggcaatttgtcagctgaggctgtgctttggggtaggagatggaacatttagctaaacagctggtttatttgtttccttttgcacctatttctaccagataagtttaactgttgaacattttttaaatatcatacgaaataccatgctaggctaggaatttgttgtggatggcggcactaagagaaaattcgttgatatccatggttgagattaacgcatcaacttcaaatgttaaaaatatttctaatatagctgagattccctaattaatctctaaagatctgtcatccatgaatatacctgaacttctttgcattctcagctgataccacttcttccttaggtttgctccctgctctttgaaataagactgctttcatttttacccaaattgatttttgttgactgaattcacccatttggtcatctcaacttgtattgtttttgtttttgacatggcatctcactctgtcatccaggctggagtgcagtggcacgatcacggctcactgcagcctccacttcccaggctcaagtgatcttcctgcttcagcctcctcagtacctgggattacagatgcataccatcgtgcctggctaattttttgttttttagtagagacggggtctccctatgttgcccaggctgctcttgaattcctgggctcaagggatcctcccacattggcctcccaaaatgctagcattacaggtgtgagccacctcatctggcctaaactggttgttttagaattaggtggacacacgtgagtgttaaaaattcagttaatttttaaaaattttgcaaataaaaattatctaaaagtcagaacttgaaaagacagttatagtaccacatttattttggagtagtaagtaaatagtagtggacataatataataaagtcaaaaaccaaattttaaaattagagctctttcctattttagttgagggttgttggttttttttttttttcccccctagcagagcactggtcactggtctctggagttaaattggaggtggggttgggggacctgagttgatgcattcatgcatccatcgatccatccatccattgatccaaatcttttttttcttttttttttttttttgagatggagtctcgctttctcacccaggtggagtgcggtggcacaatctcggcttactgcaacctccgcctctcgggttcaagtgattctcctgcctcagcctccggagtagctggaactacaggcgcccaccaccatgcctggctaatttttgtatttcagtagagacagggtttcaccatattggccagggtggtctcaaactcctgactttgtgatcctcccacctcggcctcccatagtgctgggattacaggcttgagccactgtgcccggcccatccatccaaatctttactgagtacttactgtataccaagtgccacatcaagtgctggggataaagataaataaaaatctgatccctgtttccagatggctcacagctgctgtagtccttcagagaaatttaagctcatctaggcccctccaggctgtggacttcagaggaagcatttttctttggggtggccttatggcagtgtttctcaaacctggctatattattattattattattttgagatggagtcttactctgttgctcaggctggagtgcagtgcgatagctcactgcaacctctgcctcccaggttcaagtgattttcctgcctcagcctcccgagtagctgggacgacaggcgtgagccaccacgcctggctagtttttttatttttagtagagacggggttttcccatgttggccagactggtcttgaactcctgacctcaagtgatccacccgccttggcctcccaaagtgttgggattacaggtgtgagccaccatgcctggccaaacctgactatattagaataacttgaaagcttttaaatcatctcaatgtttaggtttcacttcatgctaattaaatcggaatctctggcgggggtgggcggtggggagggagccagattccaagtattttaagatctctccagatacaaggtgtagccagagggaagaacactgctctccaggtgttgtaaagttgtagaaccagaagaacaagccccagactacaattgacttgaggggcagcactgcccgtaccctggaggccatgggaccaccttgtccatgactctctgtttgttggtttaacacctgttgactgatgagagcttgagctatgggcaggatccttcaggtgagagacacaggcctagtgagctgaggagctccaggaccctgtgcagaagggaagttcctacattgtctttcttcctgacaccccatacccttcttcattaatgccaaatttcaccccacagcgttctcaagactcagattaattatgttcagttcccccatactagcaaggatagctcaggcttagggcagagtgaggtggtgatggtgcagcctggtcacagtaaatggtctcaaacagcacattctgatcaactctgctgtgatgggagggaaggtcagtatcttctatgatataatccactgagatgatgtttcctgctttctttttttttctttttttgggatggagtgttgctctgtcacccaggctggagtgcagtggtgcaatcttggctcactgcaaccgctgcctcctgggttcaagcaattctagtggctcaacctcccaagtagctaggattacaggcccgcaccaccacacccggctaacttcttatattttgtgtagagatggggtttcaccatgttggccaggctggtctcgaactcccaacctcaggtgatccacccgcctcggcctcccaaagtgctgggattagaggtttgagccaccgtgcctggcccctgctttcttttataacttggctagagaggcaaattgaaccatttgcatcatcatgccagagaaaccagttttaaggtcttcatacaaggttccaaatggtctattctaaaagttacttgtgctagttttaggttagagggtttaaacaaaatcagagtattagcttttgttttgctcaacaaaaagggaaagagaggcaggcagaaagtcaggcaggctggaatgcctattggaaactcctggatctgcaggtttcccctgaaatctgggtgataaactaactcctgttgttttccgttgatcctagagatggtctcgaggactagaacaaaaggtccaaagcagtttttgcatagacttgaagtggtaattatgcttttgagagagaagcacaataggctcaggctgtgggcttgcccacgtggtgtgagagggacaagagcacaggctccctttgtagtccattcctattgctctacttagagcaggtgctccgggaggccctgaaggaaataagcacttggctaaagcctggccagggtaaccacacttatttttcaaactgagaacccataccaatcatcttttctaattttgggagtgcagacacgtatgaagctttttgtgaaaatgatcctgtttataatactgcatttttttcagagtcattggtgtagttaactgattcaatcaacaagaatttattgagaaggagtctcactcatttactccacaaacatctactaaagttcttctaggtataggttctgtgctgagtgtttaagagatacagacacaaacatgattcctactctaccagaaacttaacagtctagaaggtgagacagactctgaagcagctacccaaatgcactgtggaaaagtgcatagttccaggcttggacaaacatatgcacttagggatcccagaggaaagggtaataaactgcctggggactagggagggcttcgctgaagagctgatggctgggagagtcaatagagtttccatcaaagaaagaaacagcagaaccacaggtgtgtgggtgggggatcttacctaagttttggggctgagggagtggtcggggaagagaccagtgtattaagaccttgtgggccatgctgtggggtgtgaagtttatctgtcaacagggcctcggggttgttttcggcatgactgctacagaatcatatcttgtttcagaaaggctggcatgcagtgcagaggaaagatttaggagtagattatagacacagggaagttgggaggaggtaagggttgctgagcaaaggcagtggcagagagagagaggcaagagatgggtgagcgaattcaggggaggtgcccctaagtgatgacagattctctatgggcatgagggaaagggagggaatgggacaaggtcaggtgctctggctgtggtggataggtgggcaatggtgccattagccgagatagcctgggatcttctcatcactcatccttttaaagtctgtttcccagtcctggccacatgttagcatcattaaagcttcaaacacatacccatatttgggccccatcccctactaatcgggctctatgaagatgaggctcaggtgttgatgtttataaaggctcatgcagccggggttgagaactactgacgtgatcccctaggcagagatcattcctccctgctctgcatatgcctttgtcttccagacctctgttattgctctcccatgagtatttatttatttatttatttatttatgagacggagtctcgctctgccacccaggctggagtgcaatggcaccatcttggctcactgcaacctccacctcctgtgttcaagagatttttctgcctcagcctcccaagtagctgggactacaggtgcgcaccaccacgcctggctaattttcgtgtttttagtagagatggggtttcgccatattggccaggctggtctcaaactcctgacctcgtgacctgcccagtttggcctcccaaagtgctgggattataggcatgagccactgcgtccggcctcccatgagtatttattagcagtggagctcaccaagaacaatgacaagaatggacatttccagggaaactggctggacctgatcttggccttcaggaattcttttgtaaaaccgtcatatcaccaggcccacagaggacaacattttacaggcatttcagtcaattacacagtgataattcactgaacaaatcctttgggatcacagctgctttattgagatcaggtctgtgcacaaagaggaggcccagggaaaacacagtggggctgtgtcaggtggcgtccagagggcatggtgcagctgtgggcctggcttggggcaggacatttctgggattacagggccctgccccaagcttctccgttgagggggtagggagggcaatgcagagagtgagagggtgccagggcaggctataagctaatttgcctcttgagaagtagggtaataataaggttggagcagagaggaaatctttgtcctaaggcagtgcttctcaaacttttgtgggcccaggaatcaccttgttaaaatgtggattttgactgagcaagtgggatctggaatactgtgtttctaacaagtgctgatgtgacgccaatgcatctggcccaaggaatacgcttagaatagcaggatcccagaatgcatctctatttttctatatgacttttagatcagttgtgtatttagagaacataaagtttttaaaaagctctttaaaattttatccttttcaagattgtctcggaaaactttgcattatttgaaaagatacttcgaaaatggaaactgaatgaatagcactggagtgcagtggcgaggtctcagctcactgcaacctctacctcccaggctcaagccatcctcccacctcagcctcccaagtagctgggaccacagcacgtgccatcacacctggttaattttttgtatttttggtagagatgaggttttgccgtgttgctcaggctggtctcgaacttctcagctcaggcaacccacccgccttggccttccgagtgctgggattataggtataagctacctaccgcacctggcaagaacatataaactagtctactatgttctaattataaaacttttttttaaattttttttccttcctgggaatttgagggatcaggattgaccttttttactggggaaatcacctgtgatttctggaaaggtggggagggctgctggtcccttaatgtcccttctaaccagcttgtcaatgcttagtattcctttgacagtgggcaggtctttcattttgcaacaaaggtttgcctgaggcactagctcacagacttcattcatactaaggtgtgaatgacagcagaggagcttaggctttgttggggtgatagagagagaaagagaaaggaagaaagagaaagacagctgaagacaaatgaggatgctggttagccagaggaggtgtatatggtggcacagaattattaaggggaatgagagtggtggaggagcaattaaatatatctacctctaacttcccaatttttcgacttttctctttttttcttctgccctgtcatcagcacgttggttgctctctcctcctccactctgtcatcctcttgctattctttcccttcggccctctaacagttcagtttcaggtgtaaaatattttggttcaggagggactggatatcaactagacctaagattttgtgatttacattccccgtcctaagaaaaggaattatgttgagtgaacaatgaccaaagctggacagttccccctggtggtcagcactgcgacaacacgattttcctctatcttttattcattaattggtgaatttgaaaataatctgttaagccccaaacatgacagacattgtgctaaggacagacatgacacctgtccctgtggggcagaaagtctgaagagggagtgtgttactaaacattgtagagcatttagcattttcaaaagccttaaaaaataagccagaaaacttgaaaggaaaaaggcttttaccatttttaaagaaaagcaggtagaaaggttttgtttctgacattttttgtaccactaagtcttcaatttgggtttagttcttcaattttcatcgtaaaatttccccaaataattttttcttataaagtgtgagtatcaaatcagatcatgtgtagtataatttttaactccgaatgtgtaacattcacagtccctttattagcaaaattatagtaattaaataatactggctttataattgaatagcactttgcaaaataatatgtctggctcatctatattgctatagaatactactgccccagtgctgtatgcatatgaactggttaatcctcacaacagcccttataaggttcaggttatcctcattatccacatttttagatgaagaaactgaggctcagagagataagcaatttgtaaccctagccttaaccactttgccataacaagacagaagaatgcctgcagtaagtgtaaatgaacttactgtatcctcactgcagacagaggactaaaaagagtaatggggtttgcaatctttctgggtgtgtgtgtatgagaatgaagttatcacttgcctccagtgatcaggttgttaagagcacctcagaggccactgttgtcctacccttcctgtaagtggtagagatggctaatgagcatctgttggttaactgattgatgatttctcaaggctttttacagccttagaattctattagtcactctacaagaaacaggttgtatggaacgaaaggtaatttatcttttaagaattaagtgaaatcctttaaactcttgtttttgtgcctaaagctatattctgatggaaatgctctttctctagctatgtcagtggtacagtaatttaatctggttcttgaaattactctttatctcatacatttatttaagtaaagatagccacattagatatggagatgctatgaacaatgcaacagaatcatggaatgtttgtaaagctgctgcagtgattacaatgaaaatattgatcatttccttataacacacacacacacacacacacactatatgacccccatctaaaatctttgaaatatatccagtatctctgggtctggcactgaacctggcctggcatagcacagatgctcaataagtgacaaattgagtgaaaaccaatattagattaaaatattaaaggccaatatgcccatttctactctgtatagctgttccagtcaaagtattttggaaggatgagtgagaattacagtagggaaaaataatttgttccactgaaaaaagaattcttggcctggaacattttctgaaagttaagtttaacttttaaaaatcagaattttaaaataatgcgacttaatttgggctgaagtttatttttgagttatctgtaaatagatggtaaggaaatgaataaattaataattataagatgttactcagtctaagagaaagaggcttgtacaggtcttgagcacattgtagccaaataattatgtttaatataaatattactcatatcttttaattaaggaaaacaattaagtttaagcatattactatattgtttaatataaattaaacattaatattaaaaatattgcttaaaataaatatttagcaaattatattagtataatatagtaattatattgttatatactaatataatttgctaaatatagtaatatttctaattaatattagtaatatttctaattgaaaacatttttaggagttcatctgtgcctgcatatagtaatatattttttatttttatatttttgccattcttattcaaaatagtaatgaagttgtacttgtttttaaagctagtacttaaaaatggcagacagctttccccctagttggtgcaaaattgtagattttcatggtatgttgtttaaatggaatttgcactgctgcagtgctaatgaaattccttattaaggagagagatgagtgccttttatgttcaagagaaatgttcaatggccattaaaatactttgactatttgattttttttccctcgaggtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggtacatcccaaaacttctagaactgtgacctgatttggctttaaatatttgttttgctgtcttttgtgatcgtgtatgtgttgtgtgtgtgtgtatatgtgtggtgagatttgccctagagaggatctcagctatggaaacttgatggccaccattgagcttagttcttcctatccattctggagaatgttgggaacacttaataatttagctctcaatgaaaaacaggacattaaaaatgaatctacattttagaagcatatttataataaaaattatgatgttaggacaccatttctcaaaatatgtgctgcagaacatgtgtcccatataattatccaacaaaagaataagttggggaatgccgtatactaaattaatgttaaataaaggctcccaagaagtcctgcaataaggaaacttgttaaacttagttaacccagtttttcccaactcattggctattgtgtcttgtctttgtgggtatgtgtatgtaaaacacttatccctatcttgtggaatagtgttctgtggagcatgctttaggaaatgctgagttactctattatggtagttttcagtttttttttttttaagacggcatctcactctgtcacccaggctggagtgcagtggcattatcttggctcactgcaacctccgcctcctgggtccaagcgattctcctgcctcagcctctcaagtaactgggattacagccacccaccaccacacccagctattattattattattattattattattattattattctatttttagtagagatggggttttgccatgttggccaggctggtctcaaactcccgaccttaggtaatctgaccctctcggcctccccaagtgctgggattacaggcgtaagccaccatgcctagcctattggtagcttaaagttttattttaaatttttaaatagagatgggatctcactatgttggtcaggctggtctcaaattcctggtctcaagtgatcctcctgcctcggcctcccaaagtgctgggattacaagcgtgagccaccgtatccagcctggtattatggtagttttaaatgtttgccatcagctcttctgcattcttaggcagatgaactaaaggaggacatacacttacatctgtttctaaacttgttttcccttcttatcctcaagtttagtagatatatggatgtctcctgccacatatttcccacagtatcttgaaatggtgatgcatcttgctgattttgtttaaaaggttttctttattttgagacagagtcttgctctgttgcccaggttggagtgcagtggcatggtctcggctcactgcaacctccgcttcctaggttcaagtaattctcctgcctcagcctcccgagtagctgggattacaggtgcctgccaccacgcctggctaattttttgtgtttatagtagagatggggtttcaccatgttggccaggctggtctcgaactcctgaccttgtgatctgtctgcctcggcctcccaaagtgctgggattagaggtgtgagccaccacacctggcctaaaagtatttttaactagaaaatatttcaaaaatcacaaaaattaaatagtgcattacagacaggtggttcagtttagaatgtatgtttcccttctgtctttcacatgagcaacattttataatttctaatagcatttattttatttttaaaaatttaaattttgcctgttacacagccctcaggaggtcctgagaacatgtgcctctcaaatagcattttaaaatctatgtgttgcttgacttgcagcaaagattaatgccattctgattttctactaatttatttctattaaaaatagtgatattatacatgacatcgctaatatcaactgggtttcctatactatagtaatgtgagtcaggatttttctttattttggactatctgtttagaagtctatgtttgggtccagttatctttttctactgataaaagtaatgataggtagtgctgtcctgtgcagccccttcagacctgaaggatgtatttccccagcaggtgggaattgccgccgctgaagatagctgcctttcctgaggtcatgcctccttcctggaatctatgcaggggtgtataggcccctttgcatcaacttgggctaacgctgtaggtcagcccagcttcagctctccagggcatggacagaagccttcattctgactacattgcatcccagcttctctctctgcccatttagcttcatttcctgcctcactcccccatgaatgttgaactcaacggcactctccagtaaactttctgcacacagatctccatctcagagtttatttcttggggaacctgacctataacactaggtatatatatattatgtgtgactgaaatgtgggtcaagtggcatggagactgtgtttatacttattttcctattcacagggcatgccaggttcatgcaattttagtggacaattaaaaattactttacaaagtatctcttgctttagtagcatttactagttgatgtgcacctggtggcagtttcaaaatgttttcttccatttagtaattatctgttgccagatactgctccacatgcagggacacagcagtgtgaacagagagacaaagtccctgtcctcatggagcatagtttctagtgggggtaaacgaaaaatagttagtagataaataaataaataaatatgatttcaactaataacaaattccaagaaggtaataaaatagggtaacgggatagagagtgactggagggctttatcaggggtagtcctggaggacctccaggaggatgtgacatttgagctgagacaaaaatgatgaagagcagatggtttactattaggttgctgcaaaagtaatcacggtttttgccattagttttgcagcaacctaatagtttgtaagatggcttgtttcaattagataattttgggtgcattataaatcttaagggggccaatggctagatacatgatacagccatatattcaggtagagggataattgatcatatgtctagtcagatctgtaaattttttttcagtatacatattctgtatacattttataaaaactacgtttgacttagaagacagttttggtgctcttgaagacttgaccctggcggggaggatttgaggggctctgttgttcaaaaggagagcagagcgcctcacttggaagctactgtaggagggtagagggctgtgtctgtgtccaaagggtgaggtttgtgcagtctgtgccacatgtataaaataggactgaagaggtgtgagtgctgtgttgcatttgttaatgctgcctgtgttttgcttttgcataacaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaactattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggctgaagcgggtggatcatgaggtcagaagatcaagaccatactggctaacacggtgaaaccccgtctctactaaaaatacaaaaaaaaaaaaaaaaaaaaaaaaaaaattagttgggcgtggtggcgggcgcctatagtcccagctactggggaggctgaggcaggagaatggtgtgaacccgggaggcggagcttgcagtgagcagagattgcgccactgcactccagtctgggcaacagagtgagactccatctcaaaaaaaaaaaaaaaaaaaaaaaaagaaatatatgaaatgaatacatgcataagattaccactattcaaagcctttcacaatttttccttgaaaacaggaaaaactttgtccacagaattccatggaattttcaacctttggcaacttgtagagtagtcctgtagaattaatgtgcacctaaaagccacatttttaaagtttagaaaaccagttttacaaaattgcacagaatatatatcaggtaagatatacgtgtgggtggtagggagttgggggagagtggaggagagttgtgcgggagtggagggaggctgtaggagatatgaagggaatcagtgcttataaaggacgaacctaacaacctctccaccctcctttttataagaaatctgccttgtgttgaaattaaatttttattgagctactaaagttaatatttcaaaaaggcatcagtacttcatagaagacagagcatgaagcaccattttagccactgctagcactcacaaggcttggccctagttcttcaggaacagcaaaaggattgactggcaaaaactgaccatatttgtaacaacagtcctcaaaatcccatcaatcaattcttccctgttttgtctcaactctggctagactgtcccaccgcttttgtgtagacacagggtagattttgatgttgtctctcctagaccctccccatcctctgcaactactgtattccaaggaacttatacccttagccagggccctaaaacacagggttatgtgtattctgttgaatcatatgtaatcgccaatatttacctttcttgatgggaatttcacgggctcaatctaattatccacatatttccctaggtcatatgatacaagcactttttgttatcctgcttagaaatggcaatgaaatatgaatttgactaatttttaaagcaagacagagttgctagtcaagaagcaaatagttgaattacaaaaatccatagatacaagctacagataatattgtgcctttaaaatcatctgtaaggaatgtaatcattttcctctgtaaggaaaaggaaaactgattagattaattgccccaagttttaaaatatttcagttcatttccgtgagacttcctggggaagaaaggcacagcatcattagactctgggttttgctgcttacccttcatgtatctgcactcgcacagccttccaaacttcagagggaagagtggcttctttaaataatatgactgtgcgtgttgacattttcctgagaagtcccttttgtagaatccagaattgtgaactccatgaaatgtaatttgcagtacattctttaaacagaagagggtgctctcgggcaagctgatgctacccagctctagaaatataagcatttaaatttggtggtgcttgtattatgattagtgcaagatcttgggggcatttaataaagcatttcaaagcattgtgagtccagtggagtataattaaaattaatgcaatagacaaacacattaaagtattcttaatgcctagtctaaaaatgctgtcaaatacagttttacacatccgaaagatttaaatactatgcttgtctctgaacatttctaactgttacagagaaagaaaaacagtgtcttccttctccacaggtttcaaacaaaatttttctaatgagagttaataaaatcttctttctttaaaagatttataagatattataattaattcatcctgctttggcatgtgtcaaggtcaatgtggtctctaaaaatctccagtccaggattgtactttcagcttcttaggtaagaacaagcaaagatatatgctttcaggagaatatttcatgctgccttgactcagggacaagccttggttctgtttcagtcctcagaaaggagtaatgaatattgttcttttcaagatgggctctgtatttctctcagaaatctccctgggtggatgttgttgttttttgtaaagccagttaggacactctctttccaaaagtcttatatcatgagtagtctatgagtgtagctgtacgcacgcagcattcccaaagccttctgaagtacagaaggcttcctaaagacattggctgccagtttggcactctgagtcacctcaaaatgctatgtgaccttcgttccaaataatcatcttgctgatcattctaattttcttaagtgcttactatatgtctgcatttttctaggtactagggacaagtaattacaaaaacagttaattcctgctgttatagagagcatataatagtgggggaagtcaggcaataaatatcaagttgtgattattgctatgcagaaaaataaagcagggtaaaacaataaagagtggtagaagcgtgccattttagataggttggtaagggacgttctctttgatgagatgacattctagcagcgagacctgaaagaaatgaggtagagtgccactcagatccccagggaagagtgtgtccagcagagggctctgctagtgcataggtgcgggactcggggtgctaacccgtcagaggaacatcacagaggacagatggctgctggatggccatatcggagtgagcaagggggtgggatggaggtggaaagagatcagagagattgtggggaggtgggggaggcagaccacctagggttttgtgggccatggattttactctgagtgagatgggagcccctggaaggctttgtgtagaggaggggtagaactttgttacatgttaagatgatcgtgtggacataaaaaggaggtagaggcagaagcaaagaaagtagttaagagtctattgcagtatctcaggtgtcttagtcctttcttgctgctatacctgagactgagggatagcagaaatttctcacaacacaaatttctcacaatcttggaggctgggaggtccaagatcaaggtgccaatagattcagtgtctggtgagtgcctgtctgtttcttatagtaggcacgttcttgccgtgtcctcacatggcaggaggggcaaaagggctccctgaaccctcttttataagggcactaatcctgttcataaggacagagccttcatacctaattacctcccaaaggccccacctttcactaccatcatcttgggggttaggtttcaatatatgaattttgcgtgggacacaaacattcagatgatagcatcaggtgagaggtgacggtgattgagagtggtgacaggagatgaaaaatggttgaattcagaacatatttgaaatatggagccaatagtatatgccgatggattagatgtggcgcgtgagggaaagaagggaaccaaaacaactgccagatttttggcctgagcaacgaaagagtggagttgattttatggacgaggggaagggtgttgtaggagcaggttttggggagaaagatcaggaattcatgtttggatgtgttaactttgagatgcctattagacgtctaatggagacagcaagtagcaattgaatgtacaaggcaggaaagagggctgggataaagatgcgcctcttagagatatcagcgctttcagccatgggactaactgggatcacctgggagtaaatatacactaggagtgggctgagaattgagcccttgggctccctggagtttagaggtcaggaaaatgagggcaatgtcataaaggacactgaggaagagtagctggagtagaagaaaaaagagaatggcattcattccaggggtcaagtgaaaaaggatgtaatgagtttcctcaaatgctgctgctagagtaagatgaggactgagagttgactactgaatctagcaacatggaaatggtgaccttgacagaaacagtgtcactgaagtgagagcaatggaagcaaactcaagcaggtttggactcagggagtaaatggctttgtaggggaagcaaaatttccttctaccctcttcagttctgttgttggtccaagaattaaactgacataagacagattaacaggagaaaagcataccaattttattaatatttttacacggacgtggcagtcttcaaaagggaaatgaagaccctaggaagacagtaggccgtgaagcttatatacattttcacgcaaagaacaataaattatggggatgtgacaagacaaaggggcttgggcttggggcattaaattgtaggacagtgcctaggaaatacatgggggaaattaacgaaagacagggtcgttttggtagtttgttgtggaagtccatttcggcatcaactcctagtctctggtgataagaatgttctcttcctagtacagggaaggcacctttttcatggaaaattttatgatctgtttttaggtagaaatgaggaggtcagagagcctatgttagtttgttttgcatcgctgtaaaggaatacctgagactcagtaatttataaagaaaagaggtttaattggctcacagtttggcaagctgctcaagcatggaaccagcatttgcttggcttctggcgaggcctcaggaagtttttactcatggcagaaggtgaagcgggagcaggcatgtcacatggtgagaaagaagcaggagcgagaggaggagcttccaggctcagctctgcatgaatgaacagagtgagaactcactcattatcgcagggacagcatgaagacattcatgagggatctgcccccatgacccaaacacctcccactaggctcatctctaacactggaggtcacaatgcaacataaaatttggaggggaaacacatccataccatatcagagcccttctgcatgagctgtttctcaagtgccttcagattaaaataatcaatatgccaaaacagcatattttgggatggcacgaatcccttcagccccctttttttttgggaatagagtcttgctcttgttgcccaggctggagtgcagtggtgccatctcagttcactgcaacctccacctcccaggttcaagtgattcttgtgcctcagcttctcaagtagctgggattacaggtgtgtgccaccactcccggctaatttttgtatttttagtagagacaggggttcaccatattggccaggctggtctcaaaactcttgacctcaggcgatccacccacctctgcctcccaaagtgctgggattacaggcatgagccagtacacctgttccccttcagctcttttgaggagttttgctgtcaatatgaacactggaacagtggctggggaggatgagatctcaatacttccctgacatcccttaagactcaagtcttgatactttgtctgctctctggctctttctttgtcattactattatttttatcttcttgatgttgactcttgctaaaattttttgtcttccttattgttaatgcttatagaaaatgattccttgttatcttttagcccatgtcatccgaatcatttgctgtttctagcctaggtgctttgactatgccagcttgtatttcttcagaattttcattaactatatgtgtggtattgtaggcattacatattttaaaataaatttagccattgcttcaatcacatcctgctttgttttaaaatttttcttggttgaatttcactgggtcaatgtcatttcatattaggatggtaatcccacttcaaattttcttatcaaattcagaataattataaaccagttgctggtttcataatcttaagaatgccaacaaagttcctgcaggataaaaaaagcacacctatttattcatagtttttatatctacctaatagtttgaacttcgattctttattatagatgatacactaatattctatgtaaataattgtccagtaattaataagtgaattttaataaaattaaagtatctgtgaaaggtacaatttaggcaactgtgaaatcatactattagtgggatattttattgttttgattcattatttattttaaagctgttttgtatggttcaaataaggaggtgatcaaaatattatttcacgactcacatggcttattgtcacacacagggaattttttccatgatgtttaaagagggaaagaatcacaagaacaaatctcatagggaatacacttgatagatgaagtacattaaccatgtaatgaatgagttccaaaattactaaagcctagttgctcaattaggatgaatgcaggctctatggaaagtgaaagctagttgaagtgtcaggtatgagtgtaagagaggattttgggagagatagcttgatcagcacaacagagatccatgcagacacaggaggtccctccatgcaagagtgtgggtgttgctgctgagtcttcggagatgaccccaaaggctaacaggatgtagtcctgccatacctggagctcacgatctttggagaagcaactcaacagagtgcagtcatgccatggcctaatctctcaaagtgtctgccaaactattagatttgtaggtaagtcatgcattacttaccaatgggaaaatgtacaaaatgagaaatgtgttgttaggagacttcgttgttgtgcaagcatcatagaatttactgacacaaacctagatagtatagcccactacacacctaagctatatagtatggtctattgctcctaggctacaaacatgtttttggtaacagcatgctactatactgaatactgtaggcagtagtaatacaatggttttgtgtatcgaaacatatctaaacaaagaaaagatacagtaaaactatggtattataatctcatgggactaccattttataagccgtccctcattgacagaaacattgttatgaagcacaccactgtattttggagtccagtagttgaagtcagtagttcacatatggggtttgataaggtgtgatgtaacattctcggaggaagtgggagtacatcgcaagttcttatcatagtaaaacatatgtcactcatagcaaactatacatgtgttaggaataatttcaaagctgtgcaacaaaaacagttcacaattaaaatagaagaataaacttcaatttaaaaatattattactcaaaaatagtaaatatttaatgtataaagtaatgaaacaaaacttactaaacaaaaatattacatcttgcaattcacactccattttagtcttttaaatttaaagatacaaataaaaactccaaatggtcacatagaatgacagaattgaagtaacctaagtttggctgggcacagtggctcacgcctgtaatcccaacactttgggaggctgaggcagatggatcacctgaggttgggagttcaataccagcttggccaacatggtgaaaccctgtctctactaaaaatacaaaaattaactgtccatggtggtgggcatccataatcccagatacttgggagggtgaggcatgagaatcacttgaacccaggaggcggaggttgcagtgagcagagattgtgccactgcactccagcctgggaaatagagtgagactctgtctcaaacaaacaaacaaacaaacaaaaaaattggccaggcacggtggctcacgcctgtaatcccagcactttgggaggccaaggcgggcggatcagttgaggccaggagtttgagaccagcctggccaacatggtgaagccctgtctctactaaaaagaaccaagaacaacaacaaaaaaaactagccagacgtggtggcagggtcctgtaatcccagctactcaggaggctgaggtaggagaactgcttgaaccggggaggtggaggttgcagtgagccaagatcgcaccactgcattccagcctgggcgacagagcaagactccatccaaaaaaaaacaaaaacaagaagtaacctaaattctatttcttcatctttacaatcacagtttattttaaatctattgtttaaatccaagaatacatggtaccaaaggaatagagacacaaattgcacctggaccattatgaatcccgagacgaatatgggtatcagtccacatgtgtcagaggtccaagtgtataactgggagttctccaaattaacttctatgtaggatacaatgtttattatacgctaagaaactaaaaaaaaatgctgatttgaatctttcatttgcattattaaaactcaacaattattatacttattgtttagaatgcgtgccaatattaaataaaaaattggtggggaggggagatagagtatttaattgtggacattcttttgccagaattgccagaacatggtgataatcaaaagctgactgactttctgttgtttcatcattgtgtttaaattatcagtaaacaatgcttctcattattgcctgtgcccaggactgcccacttccccatacttggtacaccactggattggcagtgatccactgttgaaaggaattggcaatgatccactggtgaaaggaaaattaatgatgcagcagggtgcagtggctcatgcctatagtcccagcactttgggaggctgaggcaggtggatcatctgaggtcaggagttcaagaccagcctggccaacatgtcaaacccgatctattctaaaagtacaaaaattagccaggtgtggcagtgcatgcctgtagtcccagatactctggtggctgaggcaggagaatcgcttgaacccgggaggcggaggttgcagtgagtcaggatcgtgtcactgcattccagcctgagtgacagcgtgggtggggaggggggaggaaaagaaaagaaaattaacgatgcaaaggagagagagagagacaattgctaaggccatatctctgagcagatgagaggggaaaggacccaaggcgccagcagaggggctgacagataaaagcacaaacagttcatccacggcaatgaggcaagacagagtctatgggtacggatgaatgcaggcctgtcatctaaggtgttctttcttagtttctttcccagaagtggaacaggggattcagagacttttcaccatcccagagatggaggatcctgtttctttaaggactctttattaccgattttaattttctttttttccccctgggtttttttgtttgtttgtttctgtttttgttttttttttgagagagaatctcactctgccacccaggctggagggcagtggtgtgatttcagctcactgcagcctctgcctcctcggttcaagtgattctcctgcctcagcctcccgattagctgggactacaggtgtccgccaccatttctggcctatttttatattttcagtagagacagggtttcactatattggccaggctggtctcaaactcttgacatcaagtgatctgcccacctcggcctcccaaagtgctgggattacaggcgtgagccactgtactcagcccaattttattttcttgaaaagtttgatcacttcctttaatatgtgttctttaaccgtattttttttttcatggtagaggttgccgtggatgtcactggtattaatgcttcaatatcagctatactgactcaaaagaggacattattgtgattttagaactgagatgatcaattccctctaacagggaataaatggttaaggcagctctgatttgggaaatacatttgtgagcactctagagttcagtttctttttctgcttttcatctctgagagagacgctacagagctgtgagtggccgggtgggggtgggagaggccgcccgggagcagtgcttgtccttttctgtagagttttattttgatattttcacactgctcagagagaattccatccaaaggtcctcaagtgccatgaaaaggacaaggaaagagcatctttgaacagtggcattgttaaatgccaagagcctgcctctccagtggataattttgagatattctgaaacacttttcaaaggctttgccaagtactcattgtggaaaaggacacattctatattaaactctcactgggatcagagatggccttgggtaagactgtgacctagacgatgtttgtagccctctttttcttgcctcttcctccatcagtgatgctccagtcccttcccccacacctcctcaaggcttttagggtctccctgcctccttctttttgtcttatatgattgagtgccacggaagggtagatgtcagtaacttagatcttggtgttcttctgctgcaggcttttccagtggagctacttattcctccaaaccccacagacctttaactgcttctctaccttcagtgtggctgtcctccatcctccagtccaccctttgtgctgcagtcaggaagggacacattatcttgcatttgcttaccagtgagccttagctttcaccacagcttgccttattctctaccctctagccaaaccaaacaaactgctctgttttcctcaaacccatcatgttctcaaaccctgcatgttctcaagccccaagttttggctgatacagtaccctctccctggaatattcttccttgcccccttcctctgtctcctactcattccacagacctcagtttaggggaccaattctaagaagccttccctggccctccccattcaggttaggtgaacctcacaggtattttttttggtactaatcctgttatattgtaattacttgcatctttttctttttgcccaccctctttgggattttgactggggtggctctgcccagttatttctctttttctgggaagagaaccatctgcaggggtggtggtaggtgatggtaggagcaatgccagtgatatggggctaatcccctggccagagattacgacctatgtgttcaataagaaacactacatgaatgaatgatcggataaatttagatcaatgcactacttttctccctatgatagttgcattttaatccgtaattttctcccacatataggctagaaattccattttataagagcttaagaataaattcatatcaataacttttaatgagtgtttttcatatttgaggtactatgctaggaactcaaggggcatataagaatgaataatacacagcctaagccctcaagaaatttaaaaatctattacacttatggttgcaaatgtcctttaaaaaataaacacatacacatatccaaggggttgaaaaatattaaaatatttgttttaaaatttgatttaatcttgtttttgaaagctggtaaaagtggagaggaagcacccttagctttttagcacctgttgtttgtctgggactgtgttttctcatttaatagccagcaacttatgaaggaagtgttacttttctctctctctttttaaatttttttttgagacttaaaaaatttttttttgagtcttcctctctctcccaggctggagtgcagtggcctgatctcggctcactgcaaccttcccctcccaggttcaagtgattctcatgtctcagcctcccaagtagctgggattacaggtatgcaccaccatgtctggctaattttttgaatttttagtagagaaagagtttcactatgttggtcaggttcgaactcctggactcaagcaattcacccacctcggcctcccaaagtgctgggataacaggcgtgagccaccgtgcacggccaaggggtgttgtttctcatcatgaaatgaaaacatctctcttgttaaaggtatcttggaacgcttgtgtggctgtagatggctttttttcttgtacttgaaacaatatcccgtgcttaatttccttgacctgtccatgtaacaataagatgtaacttcaaatgaaaaacattcacataaagaatcattcactagctcatcccatgtaaacacatataagcaaacactgacgttgccactttcaaagccaaaagaaaatgcaatcacaagtagggatgatagtggtaggaaaggggccacagtggttttctgtggtgtttggatagaatacagtggttattgtctaaaagttttctgtcttgatgaccctttcttggtcctttggctagaaaaagcaagcttttttatgtttcctctctgaccattggtatttctgggttgccagcttctccagcacccaatctaggatatgggaggcaaaaagaaaatcagagaactcactgctatgtggctgttgggattgcgaggtccataattggcctgccatattctcctcacttttcagagtcttcttatgtttgtttagatatataacattttagctgttcatagcagaatgaataggaagaagtgtgtttattttatgttgtccctgcctctccgaatatttgaagcatctaagacaacagaatagaacagtcaagatgctgccacttacctcttataaaatgagacaaattaggaaaaaagaaaagcacagttatcgagggaacaaagctggttggttttctgcaggtcatagccttaagttcaaattatttgtctttatctccaccttgtctaggttggagaattaactggagacaataaacattattgttgctaatattttatgtacatgtatgattatatgcattacgattaaagaaatgaaagtataaccatttgttaggtaggaaattactgaatccttatcaagaccttgatgagaatgttgaaaaagtagtgatgaggaaaattgtgtttgaagtcatcccacatactttttatgagttaattataattagtaatacgtgcacgatatatacatctcttgaatattaaaatattttgaagtaggcagtcatatactcattaacagtgttccattgcattgtgtcacatggtcactttaactgaaatcttgttggagtgggaggaggaattcatcatggtggaatagaatcagatgttcaaataaagcaagttgattttggagctgtattagaaaattgaaaatgttacaaaagtgcagagtataaaataaatcagaactgccaacactgtaaccatttcaaagttacagggtgaggcagagattatctggattttcatttcctgtaagatgtaaaggatgaaacagggtcagagaaacaccctgggtttagtgcattggttgcaaaatgttcagaagttaattatgaatatttgctgcctttagtcatatgctcaaataccaacttgtattttaatcaccaataaataattagagtctatacaattattgaaatactttgtatttgactggaaagtttaatacgtaaaaaataatgggctgcctctaaaatatttttctttcctttttttcttttttgggacagagtctcactttgtcgcccaggctggagtgcagtggcatgatcttggctcattgcacctctgcctcccaggttcaagcaattctcctgcctcagcctcctgagtagctgggattacaggcatgcaccaccacacctggctaatttttttatttttagtagagacggtttcactatgttggtaggctggtcttgaattcctgacctcaggtgatctgcccgcctcggcctcccaaagtgctgggattacaggggtgagccactgctcccggcctttctttacatttttatccaacaaaaggacttcacaaatatggcctttgctcacaataagcaaagtgaaattatttctttactttcagaagagtatcactaacacctccaggcaaaagtagtgaggacacatggggaagaaaattaatctgattattaagatttgcttaaatgttgcaaaaactggtattgattatcagtaataaacatatatattatatattatggtctctaaacaaagtaggagaaaaatgaaaatctgatgctccaaattgtgttggccagttaagggggagctttatgctttggcagaggtgtaattcaaaggaataggtacttaaagaaggactaagttttggcatttcttttttattcattatttactaacaaaaaatagccactgtaaaattgcctcactgaggctgtaggatcttgaaatttcaattttaccatcaaaagtaccttgtaggctggatgtagtgactcatgctcataatgccagcacattgggaggctgaggtatgaggattgcttgaggccagcagttcgaggctgcagtgagctatgatcataccactgcactccagcctgggtgatagacctagaccctgtctctctctctaaaaaaagtggattgtttatgcaacatacttcctctctgagtttaaaaaattgacaaaagaaatgtaaccatcatgactatactattctgcatatttcatgataatttgataagctatcaaacgtaagtgttaaaagattcttttacatacttttcaaatgctcttgtgactggtgaggtcactcaagacacttgagattacaatgagggacagtccaatcagagaatgggtgctggtttagttatttcacactgtgtaacaaattatccaaaatgtaactgcaaataaaattacagatattcatgatctcatatagcttctgaggatcaggaatctaggagatgcttagagcgtagatttggttcaagataactcaaagatatgtagtaaagcttgtcagggctgcaatcatctgatagttcaactggggaaggatctatttccgaacttacttatgtgactgtttgagggtttctcatacttgctgactgtgggctggagtctcagttccttgccaaatagacccctccataagctacctgagtatcctcatgacatgacagctggcttcctccaaaatgagagagtgagcccaagaaagaatccacagctatgaataaccttatctcaaaggtgatatgctactacttcttcttttttttttttattttaatttaatttttttttttattgatcattcttgggtgtttctcacagagggggatttggcagggtcataggacactagtggagggaaggtcagcagacaaacaagtgaacaaaggtctctgttttcctaggcagagtgtttgtgtccctgggtacttgagattagggagtggtgatgactcttaatgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccattcgatttctcaatcttttccccaccttgcccccttttctattccagaaaactgccatcgtcatcatggcccattctcaatgagctgttgggtacacctcccagacggggtggtggccgggcagaggggctcctcacttcccagtaggggtggccgggcagaggcgcccctcagctcccggactgggtggctggccaggcggggggctgacccccccacctccctcccggacggggcggctggctgggcagaggggctcctggctgggcagaggggctcctcacttcccagtaggggcggccgggcagaggcgcccctcacctcccggacggggcggctggccgggcggggggctgagccccccacctccctcccggacggggcggctgctgggcggagacgctcctcacttcccagacggggcggttgccaggcggaggggctcctcacttctcagacggggcggttgccaggcggagggtctcctcacttctcagacggggcggcctggcagagacgctcctcacctcccagacggggtcgcggccgggccgaggccctcctcacatcccagacggggcggcggggcagaggcgctccccacatctcagacgatgggctgctgggcagagacgctcctcacttcctagatgggatgggggcccggacgaggtgctcctcacttcccaggtgggatggcggccgggcagagacgctcctcactttccagactgggcagccaggcagagacgctcctcacttcccagaggatgggcagcccggcagagacgctcctcacttcccagacggggtggcggccgggcagaggctgcaatctccgcactttgggaggccaaggcaggcggctgggaggtggaggccgtagcgagccgagatcacgccactgcactccagcctgggcaccattgagcactgaatgaatgagactccgtctgcaatcccggcacctcgggaggccgaggctggcggatcactggcggctaggaggtggagaccagtccggccaacacagcgaaaccccgtccccaccaaaaaaacacgaaaaccagtcaggcgtggcggcgcgcgcctgcaatcgcaggcactcggcaggctgaggcaggagaatcaggcagggaggctgcagcgagccgagatggcagcagtacagtccagctttggcccggcatgagagggagaccgtggaaaggagagggagagggagacgggagagggagagggagacgggagagggagagggagacgggagagggagagggagacgggagagggagagggagacctacttcttctttattttagtggtaaaataaacctaccatggtacaaggtaggaggggacaacaccaagtggtcaataccaggaggcagggatcactgggggccatcttgaaaactggctaccacaggtccacgtggcagatttgcaacttggatttacctagaacttgtgttaaagcatacctcctctagtagtcattgcctgttattgggaagaaatgactagtgaccattcagacaaactgcaaggggcaaatgaaatttgctgacatttctctgctaacattacatagcctctccataacttgagtatactgactgtactaagaaataacaattcaacttttagttacactttttatgggtaccaagatccaagaataatttaaaaaatatacatgatctacgtatagttctgagaagggcagaatgtgtaataaagtaaaacagtatgctgtcacagaaagttaggtgattaccaatcctaagcatttagaaataaagctttaaaaccttcctatgaaaaagatggaaaacaagagacacttttagctttcttatttcccagcttgaataatttaattggattttataatatcagtaggaatcaatgactgcttttagctttcctactttgggtgaaagataagtcactttgaacactcctggtagtaaattgccaggtggagagatatgaccattaaaatgaccatatatagttcttggctttttgtaaaagaaatttctaatagttttcaatgtaggaaagttttctaaagggtatcatataaatcagctacttgaaactcacaaaccataaggtacctgacccaggcaaatcacatacacagtggtaggggataaacagctctactgcacttacttgcacaaataaataaataaacagccaattttaaatataatagagtttttaatcatcaaataacgtatccatctggttaggtcaagacctatttgcaggatagaaaggctgtttagaagagttgtggccaagtgcggcgagtcatgcctatagttccagcactttgggaggctgcggctggtggatcacttgagaccaagagtttgagaccagcctgggcaacatggcgaaaacctgtctctacaaaacacacacacacactcacacacacaaaatagctgggcgtggtggcacacacacctgtagtctcagctccttgggaggctgaagtcagtgggttgcttgagcccaggaggtagacgctgcagcgagctgtgatcatgccactgcactgcagcctgggcaacagtgtgagaccctgccaaaaaggcagagttgtggcaacagatggtgacttcttcccttttctaatcctccaggttatctgtgcttacatcttccctcagtcttagctaggtaacgtatgccccaagatgctctgcccttcaggagagagaattattgtaggtagacagctggtgatttctgcctaactaagaaaaggagataggaacgtattagctgctgactttcttttagcagtggttttccaccttggctgcatattagaatcagattttgccgagtgggatccaggcactaaacttttttttaaagctccccgcgtgattttaatgtgcacccaaaattgagactctttgtcttaggtcagggggtctcatgtcagcgcccattggaatcacctggagagcatgttaaagttacagaatgctaggctccatcctccagtctgattcaggagggctggggtgggacccatcatttgcatatttaacaagttcccagatgctgctgatgctgctgtaccacgctgacaagtcttagaaaaatttggctcttgttatatttttatacaacaaaaaatggagttcagctgtgagtggggtgtagggggaggaatgaaaattggtaaatgcagaggacagatatcactagtctcccctcttttctttccccatcttcttcaaagctgaagttagactgagatctacccctgcatttcccctcctcgattttcatctttcacggattgaggaaacaacctgtgaacggcccaaagccggctagacccaacctaaccatccgttttagcgggtctcttttctcacacaggccgaccgcctctccgccttgacccccacctccactcaaacccgctccatctattaacgttctcttctgcccagccacgcccccggcgttctccgtggttgcgcacctgacgtacatcgttcaaaacgtgcccagtgtttccctccgagggcactgcgtgccgcgcaggcgcaaagggccaggtgctggaggtgctgtcatggcctgcctcaacccggtggtaaggaagacctcaggctctgtgtagagggagcgccctgggactccgggttcacggcagccgaaccctgcaccttttgtttccccctgacactttacagattgtcataaaccctctctcttccttaggggctggggctcttcttcacgtctgtgttggaggaagctgctgagggccagtagttcagcaggaagttgggccagccccgccaaaagaacaagtgccctttttctctttttacccaaactgaggctatctagttggggtgtttagaggtggaactgatcctcaaccctgctggtttcctagatactagaaaacctccaagttcggttgtgttaattttaccgtggacattgttaattccaagctgtattatttactgcttgaaataacaatgtgatatctcatgttacctccccacatgtttttagtgtctttcactacccgcccatttcgttgtcctttaacaacttaatgcttaagtgtacaacctacattaccctcctacctctaacggacacttaatttgcacagtgagaatttctagtctcagtggcacttaggagaccatcaatcttaaaaacctgaatcaaagaacaaaaatcaaggattcatctttattaccaattcatctcaacagacttcacatttcgtgaaaggcaatgtgcctgtccagatctgtgtaattttatgggttccgggtattatatatgcagtataacagctccatttttagagacatgctactttaattatatgtgttttatgatagtgcgttttaagatacataaaatacctatactctgcctgaatataaggttactatgtatgccaatttatctgattgtgaattctatgaaggagtgtctgtattttaaatagaggagttaagatggactagacatagttttaataacagggatgcaatacaaagtctgtggtcatagaagagaaaatatgttcaatacctattttgatttctgaaaaactgtgttctaatgggtactttttgactactgctgtgttaagattttttagacctaagagttttttccttcggtgttaagcgtgatcacactagctgggactaccactgaagcatcaatttagtatgcctttatcaggataaactgttttagaagaagcacctaatttaggggcatttagtcttaatgcatgtgcttgtgaataacattatttaaatgttactgattggcctattcgtataggtttaccctgggtctttagaaggattaaagcatagctttaaatactaaatactcttaggggctgggcacggtggcttacacctgtaatcccagcaccttggaaggtcgaggtgggcagatcacttgagcttaggagtttgagaccagcctggccaacatggtgaaaccccatctctactaaaaatacaaaaaattagccaggtgaggtcgtgcacgcctgtagtgccagctactctggatgctgagacaggagaatcacttgaacttaggaggcagatgttgcagtgggcccagattgtgctaccgtactccagcctgggtgacagagcaagactccatctcaaaaaaaaaaaaataataataataataaaaaaaaagcacagctactcttggcatgaacaggagtatttaggagtatttatttagtactcttaatgagtactgaatagggtaggatgaaaaggcaatcctagagtgccacaattttcattttggcgtgattaagcaatttgaaataagagcaactcaactaaattcctgctttgctgtttcttgccggtggaacttccactaagtcagtattgtcagcacatagcattgccattttggcctgggggcatagtttatatagatatgaagggctgagttttttcacataccctcttttttgttgctataactagtgtttaatctgggtagaaatctgcttaatttcattgtcatggcatgtttgactaggaggtattttagaatgttatttggtctcttcagtatgcacactgtggatgggtaaggttgttcgtgcccttcttaggttctggtaggaaatccgttttggaacaggtgtatttgataatggtccagaatatatattttttggactttgtgtattttggaagtgagatgagctttaattgctctattttaagtgtttaccccagttttctggcttggagtttatttatatttgtggaaataatatagtgaaccctaaaaaattctcctttggccactttgataaagaggtaaattgaaaacagaaggtctatttctggttgacttacattaatttcccttttaaaaggagttgaggaggttaaatactgacacaaaaggcaagtaacatgacaataaccatgcatctttgagattattagctcatatgttattgtagttctgtaattcagtcttgtagataggctgagactatgggtctgaagctaacacagtttatggaaagctaagactatattgggaataggaatgtacatagtaaaagttttaatggtgacttcacaagactagaaggtatgcactgcatatcttttaaggccaaatatgttctaacttgagaagtcagaactttaacaggccgggtgtggtggctcatgcctgtaatcccagcactttgggaggctgaggcgggtggatcacgaggccaggagttcgagaccagcctgaccatcatggtgaaaccctgtctctctaaaaatacaaaaattagcggggcatggtggcatgcacctgtaatcgcacctactcaggaggctgaggcaggagaattgcttgaacctgggacgtggaaattgcagtgaactgagttcgtgccaccgcactccagcctgggcaacagagcatgactccatctcaagaataaataaataaataaataaataaataaataaataaataaaatgaaactttaacaattgcttttatgtagcctaaactctacagatctgtaattgaagatgtaattgaaggagttcggaatctatttgctgaagaaggtatagaggaacaagttttaaaagacttgaagcaggtttgtagccgatacaactttttcttcctgtcttttgttgtttttttcagcatacaaaactgatatagttctgatctctcaaattatagtttagtacttacccattcattgtgccatcaggatgacgttagtttttaagaaactgaaaaaaagagaagtatcattatatgtgtatatatttttttaaagtaaactttttttttcccctctgcagctctgggaaaccaaggttttgcagtctaaagcaacagaagacttcttcagaaatagcatccaatcacctctgtttactcttcagttgccgcacagcttgcaccaaacattgcaatcgtcaacaggttggataccattagtaaatgagtactgttagtatcttcagaacaaattctcatttgggaatgtttttcagttagacagggtaatgttcttagggtgagaaggcttggacacctaaatcatttctattaaatgaacacagtataaatcattgccccatgtaattattgattaaaaactcaggttattcgaactagtttttattttaaatattaaattttacaaagatgataaagcctttctttagaggaaagtcacatagtttgtcagctgttgggagcacccattggtaatttcagataatttgactgggtctagtcaaggattagaagtggcagagggaaaggtgagtgcttgcaagtttgtgtgttctctttctcttattttttgtgtatattataaatctgatatattgggagcaaaatggagagttcagaatatggagattattcaggctacctcactgttttggatatataaaataatggctagaaattgatcatgtgcatttatctttattcttggacttagcaaatctagacttctgcttttaagggaaatgtttgtccacattatgcgtatcaatttaaactggaagggactagctaataaaagataaaacttaagagttttctatccttgtatgcttgattcctttctttttcttctgattcttataatctttatgttactcatatgtgtatatataaatgtatactcgcatacaaacaagttttattgggtttagctgaaattcagcagagtagtctgcaagaagtgagggtagattttggattggattatcagtaataagcagatagttctttgcatgcttgggaaaattcacatgaaaattacatgggccaaggtgaagagaacattgtaaggatgcttgtacttcttctattacaaagtgggagaatttacatgtggcagcaattctaacatataaaaatgaataaattaacaatgaatgttgaattagcaaatacaagttttatcgaatactgtgttaataaagtataattttgctctgtaagaattagtcttggcagttttaattgttgacacattgaaacatttttcatcagttgggtttttggctatgctttaattttaaactactatttcattgggacatctccttctctgtttaaataacattcctttggagttttgttaatcactgttttatttattacagaatgctaaagatgtttttttaacttatggttggcatgagggtgtggtgggtatggaagaggaaaatacttgactgtcttttatcagaagaggccgaggtgggtggatcacctgaggtcaggagttctagaccagcctggccaacatggcgaaaccctgtctctacttaaaaacaaaaacaaaagcacaaaaattagccaggcgtggtggctcatgcctgtaatcctagctacttgggaggctgaggcaggataatcacttgaacttgggaggcagaggttgtagtgagctgagatcgcgccactgcattccagcctgggcgacacagtgagactccatcttaaaaaaaaaaaaaaaaagcatggtgaacacttctaagattctgtcattcaaaattgcaatactagattttgccgcaagatggtaatattaccagtgatttaaataacaaaagtcttgcaactagtgtatcaagtttgtttttactcagctccttattctgtatcttagcagttagaataatagaaataattacattttaaatagtttttctccttattctcttctacatcatttataatgaagaggtttcagaggaattacatgtatcccttaaaagtgctttataggcttgttcctgtctctcttcatctttaggtaccaaacagtaagattcttgaaataaatagtctcataaaattgaagtacttcttaattatatcttctcatggtatgcttttaaaagcctgattaaaataacttaaacttctagaatttttttatctcttttgatagcaagttcaaattaaatctacaattcaataagtcatttgcctttgtctgtaccatcttaaaacttgtttgctcagtcaaaatcacaatgagataccgtctcacactagtcagaatggctattattaaaaaactgaaaaacagatgttggtgaagctgcagaaaaaagggaccacttatgcactgttggtgggaatgtaaatttgttcagccactggaaagcagtttgcagatttctcaacttagagctacaattcaactcatcagttctattactaggcatttacccgaaagaaaataagttgttctaacaaaaagacacccacacttgtatgtttattgcagtactactcacattagcaaagacatggaatcaactcaacccatacatggtggattggataaagaaaatgtggtacatatataccatggaatactatgcaaccttaaaaaagagagaaagaaatgtcctttgcagcaacatgggtgttgctggggccattatcctaagtgaattaacacaggaacagaaaaccatatattgcatgttctcacttataaatgggagttaaacattgggtacatacagacagaaaggtgcgaacactgggtactccaaaaggagagaaggagagaagggggcaagggttgaaaaactacccgtcaggtactatgttcactatttgggtgacaggatcaatagaagcttaaacctcagcatcatgtgatatacccacgtagcaaacctgtacacataccccctgaatctaaacccagaaacttgtttgctctatcatatgttcttcgttttttatttgtgtagtaatttcctgtatcttcagttctctactttgtttggtctcaggacccctttaagctcataaaaattaaggaccccaaatagcttttaaaatgtgggttgtaagtatctatttactatgttggaaattaaaacaaaaatttaaaaaatattggtttatttaaaaatttaattacatgttaacataatagcatatatttatgagtaataattcttcgagaacaaaaatatttagtaagaagagtgtcatcaattaatgtcggcttaatgaggtttgcagaaatgagctggattcttatctatttctatttatttacattttattgtatgtaaggtgttcaccatagtgctttgatatagatagatagatagatagatagatagtgaagaggttggtatagtctagcaaattaacatatctgtcatctcacataggtgctcattttaggtacttttagtatgccttaagtcttctcttttagcaaaaatcccaagtgcagcacaacattattaagtatagccctcatgttatctattagatatttagacttattgatcctatgtatctgtgactttggatcctttcacctacatcttcttattttctcccttcctgcctctggtaactgctattttattctctatgtctgtatttgtggttttttttttttaacatataaatgagatcatgcaatacttttctttttgtgtctggcttatttcacttagtataatgtccttcagtttcatctatgttgtgacaaatggcagactctccctcttttaaaaagctgaatcatattcctctgtgtgtgtgtgtatacagacataccacaatttctttatccatttgtccatttgcagacacttcggttgtttacaaatcttggctatcgtgagtaatattgcaatgaacttggaagtgtagatatttttatgaggtagtagtttaatttcctttgggtatatatccataagaaggattgctgaatcacgtggtaattctatttttaatttatttaggaatctctgcacagttttatacaatggctgaccattctgcattcccaccaacagagtacaggggtttcctttcctctgtactctcaccaacacttgtcgtctcttttctttttggtaatagccatcctaacaggtgtgagttgatatcttaatgcagttttgacttatattcctctgatgaatagtgatgttgagcacctttttgtatacctgttagctgtttttatgttgtctttggaaaaagatctattcaagtcctttgccaatttttgaaaaggttatttgtttttctgttattgagttgtgtaaatcttttaatatattttggatattaagccctttatcagatatatggtttgcaaatattttctccgtatctgttggctgctgttttattttgttatttgttttctttgctgtgcaggagctttttaatttgatgtctgtatttattttattttattttatttttttgagggagggtcttgctctgtcatccatgctggagtacagtggagcaatcataggtcactgtagccttgactttccagggtcaattgatcctctcacctcgacttcatgagtaactgggactacaggcatactctatcatgcctggctaattttcacattttttgtagagaccaggttttgctgtgtcgtccaggctggtcttgaactcttggaatgaagcaatcctcctgcctcggcctcccaaagtgctgggattacagatgtgagcgactgtgcctggcttatttattttcgcttttgtagcccgagcttttggtgtgatatccaaaaaatcattgccaaggccattgtcaaacaggttttcctctgtgtttttgtcttggagttttatggtttaaggtcttatggttaggtcttttgtctattttgaattgatttttatgtatggtatgaaaataagagtccatttcattcttttgtgtgtggaaattcacttcttccaccaacaaccatttattgaagaaactatcctttccccattgtgtcctcttagcacccttgttgaaaatcagttgaccatatgtgtttgggtttatttctgggctctctatactgttctgctggtctttgtgtctgtttttgtcagtgccatactgttttgattactacaggtttgcaatatagttttaaacaagaaaatgtgatacctccaactctgctttttttttcttcccctctgaattgctttggtatttaatgtgttctgttgttccatatgaattttagacttttttttgtatttctataaagaaagtcattggaattttgataagagattttgttgaatccatattttgctttgggtagtatggacattttaatgatatcagttattccagtccatgaacatgggtattttcccatttatttgtgtccttcagtttcttatatcaatgttttatagttttcagtgtacatatctttttttttgaggcagggtctggctctgtcatccaggctggagtgcagtggcacaaccttggctcactgcagcctccaccccctgggcgcaagccattctcccacctcggactcccaaagtagctgggactacaggcatgtgccacaacatctgactaatttttgtattttttgtagaggcagggtttctccatactgcccaggctggtctcaaactcctgagttcaagcaatccacctaccttggcctcctagagtgtgcatatctttcaccttcttggttaaatatattcttaagaattttattttttaagatgctattgtaaatgagattgtttttatgattttttggataggtagttatttgtgtacacaaatcccactgattttttttgttgattttgtatcctgcaactttactgagttcatcctctttaaatatttggtagaattcagccatgaagccatctggttctgggcttttctgtgttgggaggtttttaattactacctcgatctctttattttttatatctgttcctaaattcaatctgttgtgatatgttgtttttgtgaaagtataggaagaaaatctagccttccacagatacatagttggaaaaaagggaagcattttaatagtattttcagataattgataactacactaaaactcaacaaatggtagtttctgagaggttagctgcatgatggaatctggaaccacaaggaactttttggaatatttcattagggtttattggtataccttgcactttgaatggctttttaacacgtgtaatgttacagcatacattggttatttggaaaaattggtttcctgtcatacagttgaaacgttgttcattatacaagtttaaaaaaatcatattcattgatataactaggcctctcatccattgtggttgatatgaattttccaaaattaaatttttgcttgaaaagttgagttttatcattggcaaatacatgctgttagtttttcttaaagtgatgggcatgcttagtttatgtttaaaaaaatgtctgccagatacccagtttgaataactatagttgctgtcagatattctttcaagtaaaaatggtgtttcttgaaaaaagaggccatgtttttttttcttttcaacttttattctagattcaggggtacacaggcaggtttgttacatgggtatattgcatgattctgaggtttggggtacaaatgcatagtacccccaggtactgagcatagtatccagtagttagtttttcaacccttgccttcctctcaccctcatccctctagtagtacccattttctcttgttggcatctttatgtccatgggtactcaatgtttagcttctatttgaaagtaagaatatgtggtatttgtttttctgttcctgcattaattcacttaggataccagcctccagcagcattcgtgttgctgcaaaggacatgatttctttgttttttatgagtgcatagtgttccatggtgtatatataccacattttctttatccaatccactatggatgggcacctggattggttgcatgtcattgctgttgtgaatagtactgtgatgaacatgggagtgcatgtgtcattttggtagaaagatttctttcttttggatatatagccaataatgggattgctgggtcaaatggtagttctattttaagttcttagggaaatctccaaactgttgtccacagtggctgaactaatttacattcccaccaacagtgtacaagtgttcttttttctctgcagccttgccagcattggttgctttttgactttttaataatagccattgtgactggtgtgaggtggtatattcttgtgttttgatttgtatttctctggtgattagtgatgtggagcattttttcatatattggccacttctatatcttttgagaagcatctgtacatgtcttttgcccactttttaatggggttatttgattttttgtgaattgttttaagttccttatagattctggatattacaactttgtcagatgagtagttcgtgaatattttctaccatcctgtaggttgtctgttcactctgttggtagcttcttttgctgtgcagaagctctatagtttaattaggtctcacttgtcaattttgtttttgttgcaattgcttttgagaatttagttataaattattttccaaggccgatttctagaatggtgtttcctaggttttcttctaggattcttatagtttgaggtcttacatttagaactttaacccatctttgtaactgaatgcaagttcagtcactcactgcttgcagagtccagttaacaagagggaggtgtggtaggaagaaagtgactttgcagccaggtgcggtggctcatgcctgtaatcccagcactttgggaggccgaggtgggcggatcatgaggacaggagtttgagaccagcctgaccaacatggtgaaacctgtctttactaaaaatacaaaaattagccaggcttggtggtgcgtgcctgtaatcccagctgctcaggaggctgaggcaggagaattgcttgaacctaggaggcagaggttgcagtgagccaagatcatgtcaccgcactctagcctgggcaacagagcgagactccgtctcaaaaaaaaaaaaagtgactttatttccaaagctggcaaggaggaagtggcttgattcctgtccaaagcaatgattttgaattttgatgagggaaggcaagggtttaaaaaggtaaaacttgatatggaaggcatgtaagaattgtactgagtacaacgtctgtgtgtcttgttctgttggctttcttgggttccagtccacctggagcatgggctggagtcatctcaacaatggcaaggttgtggactagctgccttgcatttatcactgcagttttgcagctgggtccccaggcttggtctgtttgtctcaagattagcccctagaacttctaactaggcacataattagatactagcatacagttagatagatgtgaagggagtatatgcggtgagaaagggaaggacatgaagtctattttcaggctaagggaaaaggcttctgaagtttgcttcaaggttaggtcttgaatccaaagggaaaggaaaaaaaaagttttaaaatgtattttgaatttaagctgcccagttacatcttgagttaatttttgtatgtggtaaaaggtaggagtctagttcattcttctgcatatggctaccagttgccccatcaccatttattgactagggagtcctttccccgttgcttatttttgtcgactttgtcaaagatcagatggctgtaggtgtgtggctttatttctgagttctctattctgtttcattgttctatgtttatgtttttgtactgttgctatgctgtttggttactatagacttatagtatgggtgaagttctgtaatatgatgcctccagttgtgttcttttttgcttatgattgttttggctgttcaggctccttgttggttccatatgaattttagaacagtttttttctagttctgtgaaaaatgacattggtggtttgataggaatagcattgaatctgtagatttctttaggatgtatggccattttaatgttattgattcttgtattccatgagcttggagtgtttctccatttgtttgtgtcatctatgatttctttcagcagtgttttgtagttctccttgtagagatctttcccttccttgagtagatgcgttcctaggtattttatttttgtgtgtggctattgcaaatgggattgtgttcttgatttggcgttcagcttgaacgttgttggtgtaaagaaatgctactaattttatacattggttttgtatcctgaaacttaactgaagacatgtattagttctaagagtcttttggtgaagtccttaggattttctaggtataagaccatattgtcagtgaagagagatagtttgacttgttttcctgtttggatgccttttactttttctcttgagtgattgttctatacctccagtattatattgaataggagtggtgagattgggcatccttgtcttttctggttctcagggagagttcttccaatttttgcccatttagcatggtgttggctgtgagtttgtcatagatggctcttattattttgaggtatgttccctcaatgcctagtttcttgagggtttttcttttatcatgaagtcatgttggattttaccaaaagctttttccatgtatattgagatgatcacaggtttttgcttttaattctgtttattgtatttgtcaataaatcatatttattgatttgcatatgttgaaccaactttacatcccaggaatgaagcttatttagttgtggtgagttaacttttgatgagctgctgggttcagtttgctagtattttgttaaggatttttgctctgtgttcatcagggatgttggcctatacttttctttttttatcatgtctttttcaggttttggtataaaggcgacgctggcttcatagaatgagttagagaggagtcccttctcctcaacattttggaatagttttcagcatatttggaatagtatcagcactactttgaacatctggtagaattcagctgtgagtctatctggtctggggctttttttgggtggtaggttttttattactaattcaattttggaactcgatattggtctgttcagagttttaatttcttcctgattcaatcttgggagattttatgtttctaggaatttatccatttcctctagattttctagtttgtgtatgtagaggtattctaatagtatctgaggatcttttgtatttctgtgattggttgtaatgtcatctttgtcatttctgactgtgcttattggaatcttccctttttttctttgttaatctagttagtgttctatcgatattgtttatcctttcagagaaccggtgtttggtttcattgattctttttttcccccttaatgatcactgtcagaaaatcattgattctttgtatggatttttgggtctcaattttgttgtgtttcactccgattgtagttatttcttttcatctggctctagggttagttcttgtttttctagttcctctaggtttgatgttagattgttaatttgagatctttccaactttttgtggtaggcatttagtactatacagtttcctcttaatactgcttttgcttcatctcagagatttttggtatgttgtgtctgtgttttcatttatttcaaataattttttgatttctgccttaactttgttgtttacccaaaagtcattcaggagcaagttttaaaatttccatgtaattgtgtgatttggaaaaatcttggtatacatttgtttttgtttttgttgttgttgttttttgcttccaactgttattagtctttttattctcttggcaatgtcttccagagttaactacttctgttgtaggtgataaaaatgtataaggctctacttcagatgttggtactgctgtgagcgtggtctcttcctttactcaactgagaattaaaacttgattcttttttatattccagtcccagaagtaattccctctatagaagttatctaatgatagtcttattcatcctagtagtggcttacaaccaggctctaacctctccaggaatactataggatggatttagcataaacatatattaaactaaaaaggattctttcaaatgagtttaagtgcattttatttttagacaacctacttgacaagttttttgttttttttttttgacagagtcttactctgtcactaggctggagtgcagtggcgtgatctcggttcactgcaacctccgactccctggttcaagcgattctcctgcctcagcctcctgagtagctgggattacaggcatgcaccaccatgcccagctaatttttttatttttagtagagatggtgtttcaccatattggccaggttagtctccaactcccaaccttgtgatccaccagccttggcctcccaaagtgctgggattacaggcgtgagccaccacgccagccgacctgtttttcttaaaaacaatgcttccactccaaagatataatggtcgaaataaatgaagagctcaagttgacatcagtccaatttatcttaagtcattgtgtcatgtgggtgataggcagcaagcagttgtgatgacaggtgatagagccaaagtaattgccaattggttaacatttttccatttctaaaccatctttaaagaaaatcatatacagggtcacaccatcctcatggtagagcaactatgccatctggattcatgtttttactggtaaaaaactggtagttgttgaaattagtaagatgtgcttggtttgttctacagcttctgtcataaaaggttttactgtttaggtctctgttcttcatgttggcctttgattgattttatgtaatctttgatgtacttcttgtaggcttctttttgaagtttgtttcctgcaagtgatggttcatgacagtatcaacataagtgattaatgtgctttcggtaccctcaccctcagggccttctgcggaggcatttctgtcaatgttaccctctgtcctactgactatcttcttccccacccccccgtcccacttccaggcacagccagtctgcaatctcccagatattgtaaatgttggagaacagctcatcatggctgataaggtccgggtagataatcttgatggcagctgaagggagatgcggtggtgctggcttagcaggattccagagattagagtgaacatgatgcagctggagcagtgcttggtgggtgggaggagtgggtggaaaaggagatttctgtttttattcctctgtggtctatgagtatggttggtatgataatttttttgaacttattgagatttgctttatggctgagcatacggtcaattgtggagtatgttccatgtgcagatgagaaaagtattgttctatggccaatgggtggagtattctgtagatgtccatgaggtccaattggtcaagtttaaattcataatttctttgttagttttctgcctcgatgatctaatgttttcagtaggatttcaatagggggaagtcccccaccattatcgtatggctgtataagagttttgtaggtctagaagtacttgtttgtaattctgggtgctccaattttgggtgagtgtatatttaggatagttaagacttcttgtggaattgaatgcttatcattatataatggccttctttgttttttattgttggtttaaagtctgttttgtcttatataataatagtgacctctgctctttttttgttttctatttgcttggtggatcactcttcagccctttattttgagcctatgggtgttttatgtgcatcttgttttttatctaacttgccactttgtgcctttttagtggagtgtttagaccatttacattcaaggttaatattgatatgtgaggttttgtttttattgagaaggagtcttgctctgtcactcaggctggagtgcagtggcacaatctcagctcactgtaaccttcgtctccgggttcaagaggttctcctgcctcagcttcctgagtagctgggatggcaggcgagcataaccacgcctggctaatttttgtatttttagtagagacgggatttcaccatgttaccaggctgatctcaaactccttacctcaagtgatctgcctgcctcggcctcccaaagtgttgggattacaggcatgagccactgtgtctctggctgatatgtgaggttttgatcctatcatgaaattgttagctggttgctttgtagtttctgttgtgtggttactttatagggtctgtttataggcctaagtgtgttttcatggtagctggcatcagtcttttgtttccgtgattagaactcccttaaggagctcttgtaatggtggtctagtggtaactaactcctttaatgcttgcatgtctgaaaaaacctttatttctcctgtgcttatgaaacttaacttggcagggtatgaaattcttggttggaatttcttttcattaagaatactgaaaataggcccctagtctctcctggcttgtaaggtttctgctgagaagtctgcttttagcctaaagggtttccttttgtacaggatctgacctttttctctagctgcctctaagattttttctttagcattgacctttgacagtctgggagggcaggggccatgaagagtggggccagattgggcacatccatctacaggtcccccagtggcaggtacaagcactgaagctgagggagaatccagtgggcagccaccaggtgcccagaggtatatctaggcatggaactgggaaacctccttggccccaagttctctgcacagtgatgaggggcagcctaaaattctaatccagggtagtgagtgctccagatatctggagatctgcctgggcatggagtggagagggccttcctgcatcaagatctctgcataggaggggtgggatgactcaggctagtggaccaggcaagcaggtgctatgaatacctggagatctgcctaggtgtgtagcagagagggcccccttgcaccaggatctctgcacaggaagggtggagtggatcaggctgttaatcaaggtgagtgggtgctccaaaggtctagacatctgcctgggcatggagtggagatgacccttctgcagcatgatctctgtccatgaaagatgagtggctcaggctgctggtcacgcaagcaggtgccctgaatgcctggatttctgcttggggggtggagcagaggggaccccacttcacctcgatcccaggggaacagcaggggcaccaagtgatggcacatgcagttcagtttcagattgccaagctggccctggctgcaagtctcattgcccaggagagactgcaactgtagcagctctcctcccactccaggcttgcaatagggaagagtataattccaatacctacttctgaggtgctttccacctcagaagtggtggaggctgtggaggctactaccctgctccagagcaggtgcttcagtctgtggcgcaagagtaaaatgcttgtatggccatgcagctgggttacctagaatggctgactttgtatgcaaccagattaaaaatggcatcctgtgcttggtcctatgtctgggaaagtgtctgcagcttctcctagtgtttttccctcacagcgtctccaaccctttccccaagttagcttcagggattgggaggaaaaaaaaagttctccctcagcctgagttgctctgatctcctgtggaaaggtgagtcactgagggaggctgtctttctctctcatgtactggggcttcacttacttttatcagccaaatgccatcacagtggctgtttggcaggattctcgtctttgggatttggagtatcctgcatgattccattagattctcattttccttcttgaattaaagctcaaaccattgatctttatttactattttgttatttccaaatggtggaggcctgctaacaggctttaatctgccacctgaggaaaaaaaggctatattaactcccagcttaaacaatgacacaaatgcttttccttgtacttttgcatgctgcagaaatgctttatccttctatttcatctcgtaaaatattaaaaggaagtatacttgctagttgaaatttagtataataattcttagattatgcaaaggactttcttaccttaagtgaaatatctttgtggttgttcctgctgtttttgtctgttgtgtttttttaactgtgagtagcaattgagaataaagtgaccacttgcaaggtttggtgctactaacttaattcatgctaagatgtctacagttttacttgttattgcttttgcatcatcagttcaaatgtcaacaaaaccaaataaaaatactaaatgagaaaaaggcatactttgtcttggtatcatgaaaatagttttgaccttataaacaccctgaaaatggtcttaggtagcctcagtggtttgtatattacactccgagaactgttgttctgcatgtagggtgactatatgtaatttataatctagttttgagagagagacaaatggggttctattaataattacctcagaataacaggtgtaaactgggactgtcctgggcaaattgggacgtgtagtcaccctatgattaccttatttctaggggacttcaagtcagcttctgtatttggtcttcatgtcacatgatctttttaaaatgatactatcagtcatgatggaaggaagggaagggaggaacagggacactgagaggtttgtggttgctttcatatttgagcattaaaactcctaaagtataggtgtaaactgtatgtccgattgttcttgaacttagatgtgttgaaaatttcagcaatgtggttggttctttaggtgatttgagagttagaatattgtttggtcatcaggagacatcttttatgctaatgcgtattcacaaagaagaaattcacctgtttctatatttcctgaatcatgtaattttattattaaaatttggattggttcaaagaagatccaagaatcataaaactataactgccgcaatgtatcaaagaatttttgatggtgaataagaaacaatacacttatgaatgtggatattgttatgccatgttagtgtattataacattcttaaaattatgtttgtggagttgaattcttgctatgttaaaatttattgttaaatttactatttctaatgagaacaaagatacaatataccagaatctctgggacacagctaaggcagtgttaagagggaaattcatagcactaaatgcccacatcaaaaagttagagagatctcaaattaagaacgtaacatcacaattgaaagaatcagagaagcaagaacacttcagccccaaagctagcagaagacaagaaatgaacaaaattagagctgaactgaaggaaatcagggcacaaaaaaccattcaaaagattaatgaatccaggagttggtttttgaaaaaattaataagatagataggctgctggctagactactaaagagagaagatccaaataaacacaattagaaatgaagggaatgttaccactgaccccacagaaataaaaataaccatcagaaaccatcagtctagctgctggctagactaataaagagagaagatccaaataaacacaactagaaatgaagggagtgttaccactgaccccacagaaataaaaataaccatcagaaactattgtgaacaacacctctatgcacacaaactagaaagcctagatgagatgaataaattcctgaacacatacaccctcccaagacttaacgaggaagaaattgattccctgaacagaccaataaggaactccaaaattgaatcagtaataaatagcctaccaaccaaaaaaagccaaggacctgatggataaacagctgagttctacctgatgtacgaagaagagctgctactattcttactgaaacgatttcaaaaaattgaggaggaaggactcctccccagctaattctgtgaggccagcatcatcccgataccaaagcctgggagagacacaacaaagaaaccttcaggccaatattcctgttgaacatcactgcaaaaatccttaacaaaatacttgtaaaccgaatttagcagcacatcaaaaagctaatccaccatgatcaagtgggctttatcactgcaatgcaaagttggctcagcatactcaaatcaataaatgtgattcatcacataaacaaaactagacagaaaccaaatgcttatctcaatagatgcagaaaaggctttagataaaattcaacagcctttcatgttaaaaactctcaagaaactaggtattgaaggaatatacctcaaaataatacaagccatctatgacaaacctacagccaacattatactgaatggggaaaagctgaatgcattccccttgaaaacagcacaagacaagcatgccctctctcaccactcctattcaacatagttttggaagtcctagctatagcagtcaggcaagacaaagaaataaaggacatccaaatagaaaagaagaagtcaaactgtccctatttgcagatgatatgattctatatgcagaaaactctatagtctcggccgaaaagctccttcaggtgataaacaacttcagcaaagttttggatacaaaaatcaatgtacaaaaatcactaacattcctatacaccaacaatagccaagcagagaggtaaaccaggataacaaaaagaataagacacctagcaatacagctaaccagggaggtgaaagatctttacaatgagaattacaaaacactgctcaaagaaatcagaagacacaaacaaatgggaaaacatcccacgctcatgggtaggaagaatcaatattattaaaatggccatactacccaaagcaatgtacagatgcaatgctattcctatcaaattaccaatgaaattcttcacagagctggaaaacactattttaaaactcatatggagctaacaaagaacctgaatagccaaggcaatcctaaacaaaaaggacaaagctggaggcatcacattacctgacttaaaactatactacagggccacagtaaccaaaacagcatggtactggtacaaacagacccataggccaatggaacagaatagacagccaggaaataaggctgcacacctgtagccatctgacctttgacaaagtcaacaaaagtaagcaatggtgaaagcactcccaataaaataaatggtgctgggataactggctagccatatgcagaagactgaagctggacccctttcttacaccacatacaaaaatcaactcaagatggattaaagacttaaatataaaaccccaaactgtaaaaaaccctagaaaacaacctaggcaataccatcttggacataggaacaggcaaagatttcatgacaaagacaccaaaagcaatcacaagaaaagcaaaaatttacaagtgagatctaattaaacttaagagtttctgcacagtgaaagaaactatcaacagaggaagcagcctacagaatggaagaaaatatttgcaaactatgtatctgacaaaggtctaatatccagcatctataaggaacttaaacaaatttacaagagaagaacaaacagtcccgttaaaatgtggataaaggacatgaacagacacttttcaaaagaagacatacatgcagccaacaagcatatgaaaaaaagctcaatattactgatcattagagaaatgcaaatcaaaaacacaaggagataccatctcacaccagtctgaatggctgttgttaaaaagtaaaaaatgaacagatactggtgaggttgcagagaaaaggaaatactgatatactgttggtgggagtgcaaattagttcagccattgtgtaaaacagtatggcaattcctcaaagagctaaaagcagaactgctatttgacccagcaatctcattactggatattctcagaggaatataaagcattctaccataaagacgcatgcgaatgttcattacagcacttttcacaatagcaaagacagggaatcaacctaaatgctcatcagtgactgactggataaaggaaatgtggtacgtatacaccatggatactatgcagccataaaaaagaatgagatcatgtcttttgtgggaacatggatggagctggaggctattatcttcaacaaactaatgcaggaaagacagccaaatactgcatgttctaagtgggagctagatgatgagaactcatgaacacaaggaaacaacagacactgggtctacttaagggtggagggtgggcgggggcagaggagtagaaaagataactactaggtactgggcttaattcctggataatgaaataatctgtaaaacaaaataatctgtaaaatctgtgacacgagtttacctgtggaacaaaccttcacatgtacccctgaacttaaaataaaagttaaaaaatttagtatttctagaacatacacatgaagaccaaagttatgacacttttagtttgagtaaaaatatatactcatttaaaacttactttgttattaaaaccatcttgaatattaaaatttgtttgatgcacatttaaaggtataacttgtgagcatataaaaataagttattatttttatatgttcaagtatataacttgttagtttagtatcaaaattaagtaggagctgcatgaaacttcattataaaactgttcaatgcttttattccaatgtctataaagaaactttaaaaactctcttattgtactgtttgatttatttaaatatagagaattatcttacaggatttattgcaaggtacctaaaagaggatgattgttgctattttttctcaaggaattcatttaattgctttagacaatgtgttaacagatttttatttcctctccggctattacttaagctgcagcagcttaagctttgctcacttcagctaatgaagactaataccactgtgttcctgccagttcaattctttctaatttagcttttctaaaataatgcctgttaataagcaaggtcgtagatgaacagaggataaaaataattctgtgcttcattaaccatcaatctgtagcctttcttctgttgtcttaacgtggaaggaatggttagtttaaaaaaatgtttgcttttatgagttgtttgttttatgtgacggagccattctaatgtcaggaacagatctttggggcaattttccttaatgcagtttgtgaaaaacaggccataataaatattacattaacatataaacatgctaaagtttgtgtttttattaaagatgagggaaaatgacattctaacagctatatttagtcatgttcaggtaaaatgaaccttgagtatctaaggtatatggttacattgatcaactaagatccttctactgtagttattattttttctttatgcttatttttaaatgatagattacatttacaactagctggtcaatctttgagatgtattataaatgaaaggctggttagcatagaaaactggtagataataaaggaaagatatatgggactgtaggtctaatgtaggtcgagttgtcattctggggatttgttttcttacatatttttagcaattgtacctgttttattgcagagacttgaggagacatgttcttattcatttgttcctaaaactgttcaggtgtgcttgcttacttgaccaaagtactgtaaataacttttcataaaataatgaattggaatttatgttgaacctatacaatttagaatgggtttatgttgggttaacatatttatgctcaatattatagtctcacggaaatgtgccactttaataaatatttaataaatattacttgacttaataaggacaatctaggtgttttgttatggatttccaaagtacagtatagttgattacaatgagatattttctttcagcacttaaaggagtttatttgtaaagtctttatgtgaagttgttgcaaaaaatataattactttttaccgcacttggaatcaggaagtttagaattcaccatggtttaacctgttagtgatagaaaatattttttaaaaataagctatatttagtgattttattaaattggtaaattctaatgaatgtatatttattttgtttcctatgcagcatcattagttattcctgctggtagaactcttccaagttttaccacagcagaactggtatgtagcttacttaaaatatattttaaaagacatgtcccactgttagcgagtggtggcaaaatgctgaacatagatgtaatttcttaccctccagttgaaagtgaaaagatgtggccgggcgcggtggctcacgcctgtaattccagcactttgggaggctgaggcaggtggattgcctgagatcaggagtttgagaccagcctggccaacatggcaaaaccctgtctctactaaaagtacaaaaattagctgggtgtagtggtgggcgcctagtaatcccagctactcaggaggctgaggcaggagaatctcttgaacctgggaggcggaggttgcagtgagctgagatcatgccattgcactccagcgtgggtgacaagaacaaaattctgtctcaaagaaaaaaaaaaaaagatgtggtaaagagtggggtgacagaatagcatctgtagcatagatgtaataaaacgcagaagttccagaattgacattttcttgccaagttttcctgtctttcagagcagttgttagcatcttccaagactgtacctacaaggttaggaaatgtctgaagttatgttgtatggggttttaatacactatataatgttatatgcttgttacatcctaaataaataattttgaggttttttttcagattttttttcccctctagaatggagcaacatcatagttttgactttaattaaactggaatatttttgtcattttgtaccttcgtgaagtatagcttgtttatattttcccccttagtacttgaaggcagaagatacatttacaagttaacatagaaaaccaagtagtttttcgggtagagaagaatagcagcttttcacttttatctttcttccatggtactgagagtagtacataatctactaactgttttttaattttctttcagcccataggttgcctttgtagggcaaatgcttagtgggctagttatttccatttcttcactaagaacagccaaaaccacacaccttaataggatttttggaaagaatggtgctgcttttgataggagaccaatgaagaaatacctctgcctttggaattcaaacaaatattttttttcctgttaaaataagtaataagcttgtattaataaaaagtaaaaatgggctgagcacagtggctcacacctgtaatctcagtgctttgggagactgaggtactgggcaccatagcaagaccatattaatacaatttttttttttttttttttttttgagacagagtcttactctgtcacccaagtctggagtgcggtggcatgatctcggctcactgcaacctccgcctcccaggttcaagtgattcttctgcttcagcctcccgagtaacgagattacagacgcccgccaccatgcccaactaattttttgtattttagttgagatggggtttcaccatgttggccagggtggtctcaaactcctgacctcaagtgatccacccaccatggcctcccaaagtgctgggattacaggcgtgagccaccgtgcccggcctgtacaaaatttttttaaaaaaattagccaagcatggtggtgtgtgcctgtagtcctggctacttgagaggctgaggcaaaaggatcacttgagcctcgtaattggagattacagtgagttatgattgcaccactgctcttcagcctgggcaacagaatgaaaccctgtctcttaaaaataaaaatgcaaaacatttataaataaaataaagagttctgtagtcttatactccaagaataaatgttttaactctttgatgtttattcatccagacttctttcatgaaagctatattagtttttaggataaaaagtagggatactctttttactgtttctgtaatttctgttttctaatttagtaatatagatggactgctttcaatttcagttagtacaaattgaccttcgtggatgcagcacagtttaattaacaaacttttgttggtgaacatttaaattatttccagcatttttctaatatagtattctattgattatgcttgtgtatatgtctgtgtgtttctgtgataatcaggataaatttctaaaagtagagttcatgggtcaaaggtcatttgtattttcatttttggtatatatattgcaaaaattatcctccaaaagggttgtaccaatatacattcatacaaacagtagtttgagagaaccaatttttatcacattctcaacaacactggatgttatcagtctttcaaatttttgcaggtctgagaaccaatggccctgcaaagctatgtcttgggcaagttttttgagttaatgtttatactgttcattaggacttactagcttcattgctaataactgtagaataggattcctcttgatccttaatgggatgatcgatattgaaaactattttattcaaagaactcagccctaatattaaatgttaagtattgtcaaactattgtccagaatcagattttttgactccctgtgagatcagggaaaaaaagatacaagtaaagtccttttctaactttctaatataaatttcttatatctagggcacttcaaactccagtgcaaactttacttttcctggttatcccattcatgtaccagcaggtgtgacactacagactgtatctggtgagagtatattctaagaatctttttgttttcagcattggtactattttttggacattaagcttcatgatttttaaataaactatataccagaagttataagaacttttaataaaattgattttaaaagtaatgataaatggtggttttgattgttatagagacaatctaccacaaaaggcactgtactaggcctgtcctatatttgattcccagttctctttcccaacattgtataggggttctttgtatatattttttctaattcaagtcagttatctaaattttaacaaatacaaaataaaataacttacctgcattcctgctagctctaattacggattaaagattaggatgatcaacctttgccccctttcttattagggattgcatggtctgataggacatccaatagtttggaggttaaccggtttctgcttttccgagcaccatctcttgattttgaagaggatcatacctcttctttgggttgttgtaaagtttaagtaaagcacctaactcaacactcaaaaataagtccttttttttgagatggagtctcgctctgtcgcccacgctgtagtgcagtggcgcaatctctgctcactgcaagctccgcctcctgggttcacgccattctcctgcctcagcctcccaagtagctgggactacaggcgccggccaccacgcccggctaattttttgtatttttagtagagacagggtttcaccgttttagccaggagggtcttgatctcctgacctcgtgatccacctgccttggcctcccaaagtgctgggattacaggcatgagccaccgcgcctggcctttttttttttttcttttatagtgttattttagaggaagaaaggagaagaaatttgattacttttgaaatcattaaactctcttttggatagcattgtcttgctatatggcattttaaatatatgaagtatattttacatgattatgtttgttaaaatccagttttttggctgataacattaatttatcaaacaatggaagaggttcatggattaaatattggtgtcctttatgtatctcaaagtgtgccataaaagcaattgtgggaaaagtctggaattaaagcaaaacatatgtaattaaaaaaataagaatttatatattgattgtagaaatccaaaaatgtctgaagaataaaagaaaaacccctagagataaccaccattaacatattggtgtatttttttccagcctttgtggatgagatttttttttttttttgtggtggttgtcaaaggaaattttaattctattatacttacaattttgctttctcctttttaaggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggtatagttctgtgtccaacttcttggtatcaggggacagatagtggccagtaactggatatcctgaatattttcaagctgtaatgttaatcagaattatatatattttgtttttttctttagaagattatttcttttttctagtgatttaaaaaaatttttaattgtgataaaatacacgtaacataaagtttaccaacttaaccatttttaagtgtacagatcagtagtgttatatacattcacatgtggtacaaccaagaagattctttctttattgttgtttttagtataactgtcagtccttgaaatattcatgcttagcatttctaaatttttcatttcaataaatgaattataatacttcttcagagaaaatgcgtttgttttaaaaggtaatctgtttaccagtctcttatactgggaaacttattttatgtctgcagataaaaattaaaagacccagaaatccagaccagtagtttgtggaatgttttgagataattaattatcaaatgtaatatacaaaagaagcccacaaagttttttttttcctgctctacctaatttttctgaattcctatatggaaacttttccctacatgagggattatgttgctagtaattttgtttctccctgcctactaaaatactagttttacttaatttcttttggtattgaaaccactaaaaattagcttctagttaacttttgatattgaaaataggtctgaatttttaattttcaaggaattcatagtaatggcagaaagactcatggagaattttggattataaaaattaaaaaaattgcattctttttacaaatataaaatacatcttgtggctaattctatttacacaatttaggacatgtgaaaaatacttaaaggtttttgctccagctagtggtttagccatcatctagacccactgtacaaatctgtagcaatggatagttaagcacaaccttaatattttatcttcatgatatttaaattttgctagttagggaaagacatagggcatagtgaaaggccaggaacaaagaaaatgacaatcagaaactatttggcctgttttagaatgtttcagatatttattgaaacctgttcaagatctctgagcaaatctgtttttagtttttctataagtgttcatattaaaatgttttattgaggttttttttacgttttttaacataacatataacacttagtaaataaatgtaggttaaactaataagtatgaaacatttgattttgaggtaaaactaactacaaatgtaaaatgtttgttttcatcactactacttttggaggcactttttacctggattctgtgtgaattttgcagatgtttggtgtgatgagtcaaggacttattctactgttatgtattgtatgtcatcatgtactttttctgatatggggaaatagattagttaagggatattaatcaaggattgattgggggtagtggttgagaacataagctttggaaccacagtaggttcaaattctaggttcactacttgcaagcaaactatataacattactccctgaaattcaattttagtctttaaattggcccctaataccaatcttgtaattttgagaattatcagagataatatatatgaagtatttaaagcttctggcaccatagtaagctttagattagtgctattatgctctatgagcttgtaatatattgggtaacttttcatgtaacttgtttgttagttttaaaaaaggtctatgtctaacacacaaaatccaaacgtacaagagtatatgtaaaatgcttatttatttattgtaagttacctttaagatagtaagcagtttggtaggtttatgctgaactaattttcaaagactttacaagtagtttttctttttataagtaacttaaagcaagttataatcaactatacttgtttacttttcctgtgttgtaaactactggagagcttatggatctataggtttaagaggtaaggatctatgttgtttgaacattctgtttcacaaaatatattcttgatagcttttaattctgccccttgtaatttctgttctattttctttgtctgaatttgactcttctaggtactttaaaaatggaatcatacaatatttgcccttttgtgactgtcttatttcacttagtataatgttttcaaggttagtcgatatcgtagcatgtgtcagaatttcattcctttttaaggctgaatcatgtgagtttgacaatttttaaattttgtaaatattcctggaatctgttccttcatctccactcctagtgccattgccctaattgtttctcatgtgggataattttatctaactaatttatcagtgtgtagtctcttctacctcttactctgctcctgccaatccatccatcctagaggtcaaaggcctaagcttcagggatcagaattgttttgaatcccttctctattccttaataattgtatgacttagagaagttactcatttgtaaaataaagataatagtatctaccatgtaattgtggtaggattagttaagaaaattaatgtaaagtgctcagcagcacactggcaccgtggtaaatgctcagtgcatgttagcactctcttcctggtggcttccagagatctgtcccaaatgcagcctggttgtgtcttttctccacttaacacatcaccgactgcccttcacctataataaataaacttcaggcaccttaatatacatatacaaagcatattacgcgttctttctctgccaaagtttcctatttactcttccttcctcacatgaatatactttactgggaacaccaaaccgtgagtgattcttggttttcaaccttgttatttcctacttctctttttgctttttgttatcccctctatttgatgcctggagtttcttcccaccatcctttcctctggttaattcctgcttattcattacttcctccagaaatcttcagtacttctccacctaatttttccttcattattaaattggatgtagctcttctgttttgtcacctgaagtatgtctgtcataatgtagttcaaagatacattgatatgttctctttgcattgacagttacatttatctttgtatatgcagtaatctaagaatatatacacactcgtgtgtagtggagtataagcttttaaggataggatctagaattacgtttatttggctcagtggttctgaatcctggctgaatgatcaaatcattgggccattaaaaaaaagtgcaggtctaccctaagagattaaatctaattgatctggaatgaggcttagtcatcaatatttaagagcttctggagtgattgtaatatatagtcaaggctaagaaccactgatgtagctcaaaatcaatgtatgagtgaaaaatggagtgagaggataagagaatatataacttctaagtaagagttttcatttttcttctaagtccacacatattcctctaaaatataaaatgtcctatcaataattgactttagaattcatttaaattgagtaaatactttttgagtctctatatgccattgtgaaattaatatatcaaaatcagagatgtttaaaccagatatgtgactttttcttcattataagaagaaagccaatttaacaaaataattttttatatctgtcaaaatatattaagatatatttcattccaaataagagtggagtggcatgggatgctactgtacatggtcaggcaatatataattatcattgttactctattgtaataaattaaattcctgttaagaattaaagaaaatatgccctgccattacaattatagaccactgaatttgatatagtttacgttgaaaatgtgaaaagaatgtgtattgtaggttaggcttatcttgttttatatttatccccacatatgggtatgaagttctgcaaatttttactagccattgggaaaatagggttctttcattggagggaagcttaaattgcaaagactggaagctggatttggcgaacaaagctttatcatgaagcatcctatttacttgcttattgtactacccagtcacagaagccacatacaatcaaagacaccttggttaagctgagaatattggacattattgagctggtttgttttagtgcagagaaaataaaaaaaaaggaagcatttcctctgtcagatgacatcatctgcattagaattgttgacatttctttcacgtttggctggaattcatagatgtatcagcagcgactttcctttaacattcaacaggctaaaaataccagtgtttcttagggctgccaacatctgattttaatcattatttgtacattgataccatcaaagaatttttatgttgtgagttcttttttttttttttttttaaattggaaactgacatctttgtaataatgaaaagtttggttagtaaaatttggtactctataccattggagctcctgagatgcttggcaaacatggttttgctgctttagtaaagaaagcgttgctgtctatttcagcacatggcatgcattagtgctaagacacagccaataattctaaaagaagtctcatctgctgacataaaactcaaatatattagagccacggttttgaattattgtgtttcccaagacatttatcaaaaaatgtaggcagaatattaaattcttcatgcagaatttttctggcttttcaaaggacaatgcttgaagcccttgtttgatccttggggagacatttactatttttgagagggagcaaaagccccctcataacaatttgatctagaggagttcattgatgatctatgtggtggacgtttggctatatgaaagacttaaatctttgttttcatggtcctgtggtatcagttatggatgttgctgtacaactcctggctattttggtcaaattaccacttcagaagagattggagtcagataatcatgtgaatttttcaatgcctggtggaagtgcttctgaagaaaaaagttgagaatgataactcttttgctgttttgaaattaagtttagatttgtaattttaatcctctcccagagtaaagagggcctcactgattgaaggaaaatggtatgaggctacgtaaattcaagtagaagagtcctggaatcttcagtattcctttataagcttatccttgtctggcaaggtaacatagaagctctgattcatttttcaacagaagatcttgtggcttaaagttttcagtacttgttgctattaaaatgaaaagccaggccgggcatggtggctgctgcctgtaatcccagcactttgggaggccaaagcggatggatcacttgaggttaggagttcgagaccagcctggtcaacgtggtgaaaactcgtctctactaaaaatacaaaaattagcggagtgtggtggcaggcacctgtaatcccagctactcgggatctgaggcaagagaatcacttgaacctgggaggcggaggttgcagtgagccaagatcgtcccactgcactccagcctgggcaacagagcgagaccccatctcaaaaacaacaaacaaacagccaatttcaacatgtggtttaggcctaggacaaatcttatactaattgactttattattattatcatttatttatttttgagatggagtctcgctctgtcgcccagactggagtgcagtggtgtgatctcggcgcactgcaacccttgcctcccaggttcaagagattcttctgcctcagcgtctcaagtagctgggattacaggcctatgccaccacgcccagctagtttttgtatttttggtagacacgggggtttcaccgtgttggccaggctggactcgaactaattgactttaaaataactcaaatttaggccgggcacggtggctcacgcctgtaatcccagcactttgggaggctgaggcgggtggatcacaaggtcaggagatcaagatcattctggctaacatggtgaaaccccatctctactaaaaatacaaaaaattagcctggcgtgcggctgtagtcccagctactcgggaggctgaggcaggaggatggcatgaacccaggaggctgagcttgcagtgacccgagattgcgccactgcactccagcctgggtgacagagccagactctgtctcaaaaaaaaaaaaaaaaaaaagtaaaataactcaaatttaaagaggcatgatatatatacaataaaattcatcttttaaaaggtagcttttagatttaccatatgaattttggcaaacatgaagttatacaaccctacctgagatagagaacattttcattacctcccagtttcctcatgtgcctttgtagtcaataccctctttcaacccccagttcctggcggtcactcactgacctgttttcttttggggtaggtttaccttttccagaatattagacactatcatgcagcatgcatttttagcacaatacatttgagattcatccatgttgttgcatgtatcagtatattccattgtatggttataccacatttatttaccagtttgacatttgggttgtttccagtttttggtatttgtgaataaagcccctgaaagggccgggcactgggtgatcccagcactttgggagactgaggcggttggatcacttgaggtcaggagttcaagaccagcctggccaacatggcaaaaccccatctctactaaaaatacaaaaattagctgggcatggtggcacacacctgtaatcccagctacttgggaggctgaggcatgagagagaatagcttgaacccagtgagctgagatcatgccactgcactgtggcctgggagacagagtgagactgtgtctcaaaaaaaaaaaaaaaaaaaaaaagaaacagccccgaaaacatttatatgtagattttatatgtgtaaatacctaggagtgggattgttagataagatgataaacgtatgcttatgagaaacagtcaaactcatttccaaggtggctgtatttccaccagcaatgtatggtggaattttgcatttctaccagcaatgtataagatttgttgttggtacaccacatccttggtagttaacactatcttttggtaaggagaagtttttaattttgatgaagtccagtttattatttttatcttccagtttatttattttgactttcagtcccgtatattattttgacttctgcttcatgtgtcttatcaaaggctgcaaagattttataatacttctaaaaactgtatagttatagttttgtcatttaggcctgtgatctattctgggctagttttgtatatggtgcaaggttaggatggaggttcatttttttttttggagacagagtctcgctctgtcgcccaggctggagtacagtggtatgatctcagctcactgggttcaagcgattctcctgtctcagtctcccgcgaagctgggattacaggtgcccaccaccatgcctggctaattttttgtatttttagtacagacagggtttcaccatactggtcaggctggccttgacctcctgacctcaggtgatccccctgcctcagcctctcaaagtgctggggaaacaggggtgagccaccgtgcctggatagctcatttttttttacatatggatattcaattgttttagcattgtttgttaaaaagactgccttgtctcactgagttagctgtctgtgcacattatgtatctaaagcacttcacctttagtgaaaattactacatctgtgttggtttattactgaaggttcactctgtttcattaattcatgtgactatctttttgctaggaccacactgtcttgattatggtaaatttatagtaaatcagagagtgtgaatctctcaaatttgttcttttttccaaattgtttgggctattctaattcctttatatttccatataaatattaggatgcgcttgtcaatttctaaaaagaaaaattgctaagactgatttgggtttgtgttgaatctatagatcagtaaggggaattgacgtcttcacaatattgagtcttccaattcatggacataagttttttttttaatttaggtttttgacttctgttactaatattttctagtttttagcatatacatattatacatattctgttatatttttatctaaatatttcatggtttttggtgctattataaatggtacctaaaactgccatcaagaacatttttattcttatttttaagcttcatttgcattgcatttttaaaaatatatttttatttttaattagttaattcattagtttgtagagacagacagagtctcactgtgttatccaggtttgtctcaaatgcctggcctcaagcacttgtctcactttggcttcccaaagtgctgggattatagacgtatgagccaccatgcccagcctaaaatacattttttaaaaggtagaaaaaactgaaaatttctaaggcatttgaagtacattgccacaatattttaaaaagaggttgtgccagtttttcctgccaccagtactttgatcagttttgccacatagtatagtatatcactactgatttttaaaaattcaatttttctcctgtgctaaagtacacataaaattaactatttattttatttttaaattatttttacaatttttaactgtatagcttagtgacagtaagtatattcacattgttgtgtagctatcaccaccacccatctctagaaatttttcatcttcccaaactccatgcccattaagcagtaactccccatttctcactctcccagtccctgacaaacaacaattctactttccatctctatgaatttgaccactttagttacctcatataagtggaatcagacagtacttgcccttcttcatttagcgtaatatctcagggttcatccatgttgtagcatgtatcagaacttatctccttgttttaaggtgaataatatctcattgtatgtatatactgcattttgtttattcattcaagtgtctgtggatacttgggttgcttccagcttttggctattgtgaataatgctgctgtaaacatggcgtacaaatatctcttcaaattcctgtctttaattttttcggatatatatggagaaatggaactgcaaaatcatatgacaattctacttttaatcttattaggaactgccatacagtttccatagaggctgcaccagtttacattctcaacagtagtgcacaagcatctgatttctccatatccccaccaacgcttattttctgtttttttttttttttttttttttttttttaataattgctaccctaaggggtttgaagtggtatcttgtagttttgatatgtatttccctaataattagtgatgttgaacattgttttatgttcttctggccacttgtatgcattctttgtagagaagtctattcaagtcctttgcccatttttttaaaattggactgtttgctctgttgttgttgacttgtagttctttatatatcctggatattcacctcttatcagatgtatgatttgcaaatattttctcccattttatgggttgcctttactctctgttaataatgtcttttgagcacaaaaggttttgattttggtgaagtccattttatctatttttttcttttgttgcctatgcttttggtgtcatatccaataaattattttcaaatccaatgtcatgaaattttcaccacctgttttcctctaagagatttatagttttagttcttatctttagctctttgatccattttgagttaattttcgtagatggtataaatttagggttcaactccattattttcaatgtggtgctagttttcccaaaatgatttgttgaaaagactgtccattccacattgaatggtcttgttacccttatggaaaattgacgttttatgtaacggtttgttgctgggatctttattttattggtgtatacacctgtctatacattaataacacactggttttattttttaatttttattatttatcgtttcagcttttatttaagattcagggagtacatgtgcaaggtttgtgacataggtatattgcatcatgctgaggtttggggtgtgattgatcctgtcatccaggaactatgcatagtacccaaaacagttcttcagcccttgccctcacttccccttctccctttttggagtccccaatgtctattatttccaccactgggtgtccgtatgtgcccaatatttagctcctatttgtaagtgagaacatctctttatggttttctgttcctgtgttaattcacttaggatgatggccttcggcagtatgcatgttgctgcaaagaacatgatttcttttttttggggctgcatagtattccacggtttatatgtaacacattttctttattcagtccaccatgtatgggcacctgggctgattccatgtctttgctattgtgaatagtacttcaataaacataagagtgcaggtacgtttttggtagaaatatttcttttcctttgggtatatatccagtaatgggattgctggattgaacggtagctctattttctttgagaaatctccaaactgctttccacagtggctgaactaatttacattcccaccaacattgtacaaacattccttttcctctgcagccttgctggaatctcttgttttttttttttgactttttaataatatccattctgacttgtgtgagatgatatcttattgcatttttgatttgtatttctctgatgattagtgatgtggaacattttttcatatgtttgttggctgcttctatatcttcttttgagaagtatctgttcatatcatttgcctactttttaacgtggtcatttgatttttgcttgttgaattgtttaagtttcttataaattctggatactacaactttgtcagatgcacagtttgtgaatattttctctaattctgtagattgttcactctgttgatagtttcttttgctgtgcagaacctctttagtttaattaggtctcacttgtcaattattgtttttgttgcaatagcttttgaataattagttataaattatttcccaaggctgatgtccagaatggtgtttctcaagttttttctaggattgtttatagtttgagatcttacatttaaatcttcaatccatcttgagttaagttttgtatatggtgaaaggtaggagtccagtttcattcttctgcatatggctagccagctatcccatcaccatttattgaatagggagtcctttccccattgcttatttttgttgactttgtcaaagatcagatggctttagatgcatggctttatttctaagttctctattctgttccattggtctatgtgtctgtttttgtaccagtgctatgctgctttggttactgtagccttataatatgggttgaagttaggtaatgtgatgcctccagctttgttctttttgtctgtgattgttttggctgttcaggctccttgttggttccacattaattttagaatggtctagggattttttttggctggtaagttttttattattgattcaatttcataattaggtattggtctgtttagagtttcaatttctttctgtttcattcttgggagattgctttcaggaatttattcatttcctctagattttctagtttgtgtgcatagatgtgtttataatagtctctgaggatcttttgtatttttgtgggattggttgtaatgtcacctttgtcttttttattgtgcttatttggatcttctctctgtttttctttgttaatctagctagtgcttgcttgtatgaaaaagctcttatatctccttaacttatgaagcttagtttggtgggatatgaaattgttggttggaatttctttcctttaagatgctagaaataggcctacaatctctcctggctggtaaggtttctgctgagaagtctgctgttaatctgatgggtttccctttgtacatgacttgacttttttctctagttgcctttatatatatattagcagtgtccttccatagtctggtaactatacaccttgataatgttgattttgtatagtgtcttgaaggtgttctctcaatttcttgtatttggatgtctacctttctagcaagattagggaaatgttcttgaattattccatcaaatatgttttctaggttgtttagtttttctctttcaagaatgccagtaattcatatatttgattgctttacataatcccaatatcacactatttttattattgtaattttgtagtatgttttgaaatcaagaaatttaagactttcaatttgattcttctttttcaagattgttttggctatttggcattccttgagatttgaatttttggatagatttttttctttttctgcaaacactcttgttgggtttttgatagagattgtgttggctctttagatggctttggataatattcacatcttaaccttattaatttttgaatccatgaacttggggtgtctttccattgatttttgtctttattttctttcagcaatttttgttgttttcagcatatacaagtcttttgcctctgtggttctgtttgttcctaaataacctattctttttggtgctattgaaaatgaaattattttcctaattttctttttgagtttttaattatttgttgaaatgcagctgattttggtgtgttgattttgtattctttaacattgtggaatttatttatttttcctaacagtttgtttttgtgtgtctgtgtgtatggaaactttagaattttctacatataaaggcataacatctgtaaacagagataattttagtttttcctaattttgatgtcttttatttcttttacttgcctaatcatcctagctagcacttttagtactgtgttgattagaagtggtgaaagtagttgtcctttccttctttctaatcttagagatttcaggggtttaccattcagtatgattttttttttatcttgaactatccttgcatcccaggattaaatctcatttggccatggtgtaggattcctgtaatgtgctattatatctatttgccagtattttgttgaggatttttgcatgaatattcatcagaagtattggtctgtaatttttatgttttgtctttgtctttggtatcagggtaatgctggcctcataaaataagtttggagatattttgttcttccattttttggaagagtttgaggatgattggtattcatctttaaatgtttggtataattttctagtgaagacatttggttctggatttttctttgtaggtagggttttgattacttattcagtctactttccagttaatatacttattaagattttctattgctttctggttcagtctagattgcgtatttctaggactttgttaatttttaaaatagattatctgatttgttgtggtgtaagtgttcatagttttctcttaaagttctttatatttctgtaaaattattaatgatgtcccctcttttatttataattttattttattattattattattgaaacagagtctctgtcgcccaggctgaagtgcggtggtgtgtgatcttggctcactgcaacctctgcctcctgagttcaaatgattcttgtgcctcagccgcctgagaagctgggattgcaggtgtgctctactatgcccggctaatttttgtatttttagtagagttggggttttgccatgctggccaggctggtctctaactcctggcctcaagtgatccacctgcctcggcctctcagagtgttgtgattacaggtgtgagacaccatggccgaccctcattgataattttagttgagtcttctcttcttcttatcagtctagttataaaggtttatcaattttattgatctttttgaagaagcaactcttggttttgttgatttttctccattgtttctcattctgtgttttctttttctctaacattattatttatttcattctgctagctttagttttgatttgttctctcctttatagttttttaagatgtaaagttaaactgttaatttgagattgctcttttaaaatgtaagcacttatacatgtccctccccattgttttcactgcatccccaaacttttttttttttttttttttttttttttgagacagtttcactctgttgcccaggatggagtagagtggcacaatctccgctcactgcaacctttgcctttgggtcaggtgattctcctgcctcagcctcctgagtagccgggattataggtgcccaccaccactcctggctaatttttgtacttttagtagagacggggtttcaccatattggccaggctgatctcgaactcctgacctcaagtaatctgcctgcctcagcttaccaaagtgctgggattacaagcatgagccactgcacctggcctgttgcatatatctgggggctctgatgtttggtgcacatgtatttataattgttatatcgtcttggtatattgattattttatcattatgtgattaaaaattattttttcctttttaaataacagtttttgacctaaaatccattttttttctggtggtaacatagccactgcagctctattggttatcatttgcatggaatttatttttccatcttttcccttccaacctattcatatcctggatctttagtctcttatagagagcatatagttggatcttgttttttatccattcttctaaactatgtcttttgattggggagtttaattcatttgcgtttagagtaattactgatcggaaagaactaactcttgccgttttgctgttttctatatgtatttaggttttctgtgatttcctcctttattaccttcctttgtgtttaattgatttttggtttcccttctcatttcctttgtgtacattctatagatattttctttgtggttaccacgggtattacatataatattttaggcttataataacctgttttaatcagatagtcacttaaattcaatcacatacaaaaagtttactcgtttacaactttgccctcccctactttgtcttattgttgttacagattacttcttcatattttatttacacattaacatagttttttaatgcttttgtcttttaaatgatgtagaagaataaaatcaattataaactaaaattatgttaacactgatttatgtatttgtccatgtatttaactttaccagataattttacattttgtgtagcttcaagttactatctagcatctattcattttaacttaaaggactccttttaatatttcttgtagggaaaatctaactataatgaattcccttggtttttatctaggaatgtcttaatttatctttcattttttaaaggatggtaaggcagagtttattcaaggggatccatggcaataggaactactctagctgggttttgcagcggcagagagagactggaaggaattccctcccttattgttgaaagataattttgccagatacagaaatcttggttgatcttttttttttttttttttttaacactttaaatatatcatcccactgccttgtggtcttcaaacttcggctgaggaatctgccaaaacacttactggggattccttgtacatagatgcgttgcttttctcttgatgctttaaaggtatatattttttaaatttatttccaactaccacatgttctcacttataagtgggagctaaacaacaagaacacgtggatactaggaggggaacaatgaacacgggaataattgagggtggagtgtaggaggagggagacgatcagaaaaaaatacctgctgagtactatgcttattacctgggtgatgaaattatctgtaaactaaacccccgtgacacatagtttacctacataacaaacctgtacatatacccctgaacttaaagtaaaagtgaaaaaaagagagaggtttatttaggaaagaggtctcccttgtagatagattaaaatattacgcattctaaactgaaacttggctggaaacagtggctcatacctgtaatcccagtactttgggaggctgaggaaggaggattgcttgagttcaggagttcaagaccagcctaggcaacattgcaaaaccccatcaatataaaaaatacaaaaaaattagctggccatggtggtgccctcttgtagttccagcttctcgggaggatgaggtgggaggatcgcttgagcccaggaggtcaaggctgcagtaaactgagattggaccactgcatttaagccggggcaacagagtgagaccctatctcaatcaatctgaatcaatctcaatcaatcaaaactgaaacttaatccttcaaatatgtttattttacttgtcctaaaacaatgtccctagaagtattaaagtgtaaagcactgttattttcccattttgagatctctaatgtaaaaatgtattttttgaaaataatttaaaacataaaatgctatataataaacatttaaaaattttttttatttttatattttgagacagggtcttgctgtattgctcaggctggagtgcagtggcaggtcatagctcactgcagccctgatctcccaggctcaagtgattctcctgcctcagcctcctgagtagctgggactgtaggcacacacaaccatacctggctaatttttagtagagataaggttggtcttgaactcctgaactcaagcgatccttttgtcttgtcctcccaaagtgctgagattacaggcataagccaccacacctggtctaaaggtattgtttttaaatttcaatttctaattgtttattgctactatatagatatgcagttgaattttgtaaattgacctaatatcctgtgacctcgttaaacccacttaataattttagtagttgttttgtagaccatttggggttgctttatgtagactataatctattttgatgaataaaaaaaaatatttcttcccagagtgtttttttttcttggcttattgcactgactaggacttccagtacaaaattaaataagagtgccaagagcagaaatcttgttcctgattttaaggggaaagcattctatctttcaccaagtgctatgttagctgtatggttttaatttttttttgtagatatcctttatcagatggaaacagttttctttaatgtagtttttttttttttaaatcatgagttgatgtttaaacaattttcccctctattgaaataaatgggtttccttctttcatgttttgatatggtgagatacactgattgatttttgaatgttcagctttcattttatatattgctggattcaatttgctaagatttcgttgtggatttttgcttctatgttcatgaggagtactggtctgtagttttgttattttgtgctgggtattagggtaatattagtttcatagaatgaattgctatgtatctgtatctcttctgttttctgatagagtttttagctttctgaatttagaatttttccttgtgggaaggtttttaatggaattaaatttctttaactgatacgtctctttaggttatctgtttcttcttgagtaaattttggtaatttcttgcaatggatttatccattttacttaagttgtaaaatttattgaaagttgataatatattattttaatgcctctaggatctatgtaacatcccttctttaattcttaatactgtttgcttgtgtcttctgtctgtctctctctctttctctctctgtctgtcgtgctagaggtttttctatttatttatttgtttatttattgagacagaggctcactctgttgctcgggctggagttcaggtggtatgatctcggctcactgcaaccagcacctcctgggttcacgtgattctcgtgcctcagcctcccgactagctgggattacaggtgtgtgccaccacacctgactaatttttgtatttttagtagagaatgggtttcaccatgttagtcaggctggtctccaactcttggcctcaagtgatccgcctgccttggcctcctaaagtgctgggattacgggtgcgagccaccctgcctggccaggtttttcaattttattgataatttcaaagaatggacttttgaccttactgatttctctctctctttttttttttttttggtttttaatttcactttttttcccttttaaaattttcattatttccttcctcctgtttactttggacttattttggccttctttttctagtttcttaaggtgggatattatgctattgatttgagacgtacttattttctgatataataatttaatgctgtaaatttccctctaggcactgctttgggtacatctcaaaagtttggacattatgttttcatttgcattcaattaaaattattttctaatttatcttatgatttagtctttgaccattgggtatttataattgtgttgtttaatttttaaatatttgggggattttccagatatctttctgttactggtttctagtgtaattcttttgtggtcagagaatatactttatatattttaaatttgttagggtttgttttatgtttcagaatatggtttatcttggcaaacatgatatgtgctcttgaagctatttggctatttttgggtggggtattctctatatattaattaggttaagttggttgattgcattgtccagggtttccatatctttactgaatttcagtccactttttctattgactactgagagaggaattttaagtcttcacctgtaattttagatttgtctattttttatttttattactttttagtttagttttgaagctatgtttgtaggtatataagtatttaggattgtcatcttcaatcgatccctttattatatttaatgttttttatttatctctgataatatttctggttctgaagttaacattttctgatattaatatagcagtttcaggtttattttgattagtgtttgcatggtatgtgttttttctgttcatttacttttaacttacctgtgtcattgtatttaaagtgagtttctttctttctttcttttttttttttgagatggtgtctcgctctgtcacccaggctggagtgcagtggcgcgatctcagctcactgcaacctctgccttccaggttcaagcatttcacctgcctcagcctcctgaagagctgggattacaggcatgtgccaccacgcccagctaatttttaaaaaacatttttagtagagatggggtttcaccatattgaccagactggtcttgaactcctgaccttgtgatctgcccacctcggcctgccagatagacaccatatggttgggtcttgctaatttaacccagtatgataatctctatcttttaaatgagatgtttaggccatttatattcaatatagttattaatcaacttgtcagggtgtgtgtgtgtgtgtgtgtgtgtgtgtttgtgtgtgtgtgtgtttgtgttcttccttttttctgttttcctgaatgcttttgattcttttttgctgtgtcacatctactgatgaccccttcacatgaaatttttactctcatattgtggtttttattgttagaattttgtgctaaaattcttgtttttcttttttctttattttcctaactccccaaacttgttatctgtgctgaaattctttatttgttcatggatttttttccacttttttccctaaattatttggtgtatcaatcatagtttgacatttctaactgtctctgagtctggttctcttgattgctttgcagtgtgatggttggtttttgttgcttttagtttgtattattatttttgagaagagtctcactctgtcacttaggctggagtgctgtggtgcaatcacagctcactgcagcctcaacctccctgggctcaggtgatcttcctgcctccacctcttcagcatgcaccaccactcccagctaatttttttttttttttgtattttttgtagagatgggatcttgctatgtttccaagactagtcctgaacttctgggctcaagcaatctgccagcttcagtgtcccaaagtgctgggattacaggcatgagtggccatgcccagcctcattaattttgattgaatgtcagacatcttatatataaagagagactgaagtaaatagtatttatagttgggaatggacattactcttcttatagagagatatgtttgtatgtcccatctgtaagggctgtccctccttggatttcaggctgcttcaagaaaagttgtgattttgtaatttatccagcttttgttcattgttagtatggtagtggcattcttttcagcttttacattatgggctgtgggccctctaagatttctctaatttattcgtaacagaatacaaatttatcttatttatgtaatttggacttattttcatttttgagcacatagccattaatttttgcatacatgtgatattccttatatttcatctgtgaagcaaatctgtttccaatgtagtaaaaattaattacatgtaaacttacataattttagtcaatttgaatttttctacacagtattatttgttgggtatacttttttgagggttcattattggtaatattcatatgggtttgaatcctagaagggcagttgtccactcaaaaaataagttgagtatatgcatattattaaagttgtatcttaagttattgagatgtgtattattgtattaaacatcacccatgacttgcaaactcagaagaaatatgaataaagggcatctgttcaaaccttagtaaaacttcttggcttctgttaggagccttcttgactctgcaaattcccaagactttccaggctgatacgatgaaggctttttgggtgctgtatcactcttcattcccctcttcatagcccctggtaaccttgattttactgtctgtttttatgaatttgcctgttctaggtacctcatataagtggaatcatataatatttgtcctgtgtttgccttatttcacttactataacctttatatttctgattgtaaaggatggaaagtcatcctttccatttgcttgggctacatttctatattccagtcttaaagctaatgtaacctgttgcttatgtaatatgtgtgtcaacattatgtatggatttccaaaacaaccagcattatagcatctggagctttcaccaagttttcaaggggcctcttacttttccaaagaggttaagaactactgctatagattctgaagcatatataatcatataaaacagcccctgatcttaaggagcttgacattttattgatctttgtcctgtctatgacaaactaatgggttggggtgggtagtattgtatgaccaatatagaagcctacactgaagagtgaagcgcagtgacttacgcctgtaatctcagcactttgggaggccgaggcgggcggatcacgaggtcagcagatctacatcatcctggctaacacggtggaaccctgtctctactaaaaatacaaaaataaaattagccgggcatggttgcgggcacctgtagtcccagctacttgggaggctgaggcgggagaatgctgtgaacccgggaggcagagcttgcagtgagccgagaacgcgccactgcactccagcctgggcgacagagcgagaccccgcctcaaaaaataaataaataaataaataaataaatacacaaataaattagaaaatgcctataaaatacttagcagaggggtttatttgttagctgtgctggatgaaggtaatgataaaataataaccatctacgtgaccagaggtgattactaaatttcctttatatattttttacttttgttgtgctgaattatctataacataaaaatttgccattttacccatttttaggtgtacatttcagtggtactaagtacattcacaatgttgtacaaccatccccactctgtatttccagtactttttcatcttctcaaacagaaactctgtactcattaaacaataacttttcattcccctcttcatatcccctagtaacctcgattttactttctgtttctatgaatttgcctattctaggtgcctcatataagtggaatcatgtaagatttgtccttctgtgtttggcttatttcacttagtgtaatcctttacatttttatttatccattaagcacaatgacatttgtcttttctatttcattgaattactgtttaaagtcaaatgaaatagttaaatcctaataggtactatataaatttaagacggtatgtataaaaactggtaaatattacctgaaagtaataaactcatttgctgtctccctgtgattgtaagtgggttactttatttataatttaaaaaattattcctatgttacatagaaatgctaggcttattctaaaattcaaagttagattttaatgtcataagagagaagtttgcttgaactgaccatttgtggaatgtttgttaattttaaatttggattcaatattttatataccttatttgacttgaactttattgtatttctttctctttttaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggtgaggatgacttttgagctgagacttcctttattaatttataacatttctactttattatgccttggaaccaaaaggaatagcaagattaatcttttctttactcttttgaaataagacttatttggggccgggcacggtggctcacacatgtaatcccagcacttcaggaggctgaggcaggtggatcatttgaggtttggagttcgaggccagcttgggccaacatggtgaaaccctgtctttactaataaaacaaaaattagcagggcatggtggcacatgcctgtaaacccagctactcaggagactgaggcaaaagcattgcaggagacaggttgtagtgaaccaagaaatgccactgtattccagcctgggtgacagagcaagactctttaaaaaaaaaaaagacttattatatgcttggatttaaacttttaatcttcaactgtaatttaaaaccaataataaatatttgggaatgggcttctgtattggtcttaactagaggtagtaggtgatctaggcaatgggagtggctgttaaagaaggcagcctaggtagaaacatatagtatctgctctaattctagtaaatgtcataaaatccaggtagagtgtgcttattaaaaagtgtgtaagtagtattagctataatttatggcagccttatatatgtgccaggcatcatattaagtcttaaatgccttatcttaatagtcccaaagtcctgtggttcttactgctatcctgattttagatatgaggaaactgagatatggagagttttagtaacttgcctaaggtcagtcttgtaattattaaatggccaaacgggatttatttatttatttatttttgagacagggtcttgctctgttgcccaggctggagtgcagtggtgtgatcttgactcactgcaacctctgcttcctgggttcaaatgattcttatgcctcagcctcctgagtagctaggattacaggcacaccaccatgcccagctaatatttatatttttagtagagatggggtttcaccatgctggccaagctggtctcgaactcctggcctcaagtgattctcctgccttggcctttcaaagtgctgggattacaagcatgaaccactgcacccggctcaaacagggatttaaacccaggctatttgacttttagtacaattatattctgctgctctaggttcctttatttctttgttttgttttggtttggtttttgagatggagtctcgctctgtcgctcaggcttgagtgcagtggtgtgatcacagctcactgcagcctcaacttactgggttcagatgattctcctgccttactctcccaagtagctgggattacaggtgtgtgccaccatgccaagttaattttttgtattttcagtagagatgggatttcaccatgttgcccaagtaagtcttgaactcctggcctcaagcaatctgcctgcctaggcctcccgtagtgctgggattataggaatgagccaccacgccgagacaagttcctttatttctatatgtctctttatctttaaacaatttaaagcatcataaaattccttaatgtgatcatctttcgtctttaggaccctttaaattctggagatgatgttagtgaacaggatgtgccagacctgtttgacacggataatgttattgtctgtcagtatgataaggtactgtatttaccttttggactttgggtttattaactgcatttatagtagaaaggtatgtaaaatgatgggaaataagatgaagagttacacttcacaattaatcaaaacagcagtttaattctggaaattctgagtgtgtattttgggtctagcgctgtgctatgtgatctcagtgataccagaaaaagtgacagtccttaaggaagtaatgatcttattgaaacaagatgtttcttttggaaaactagaaagacatacaatgagatggtaggtaaatcaacagctaaaatatgtgacaggtaaatcaaatgctaaaatatgtggaatgtaatcaaatgctaagatgagtggcaggtaaatcaaatgctaagatatgcagcacagatagtaagccctagaagtggctaggaaatgtaagaaatcatttgtagttggagttccccataaatccatgggtgatgtggggttttgaaatgggtcttgaatgacttgtaggatacaggtaaatatggagaataagcatcagatagaatagcccaataaaaagcagagaaatgaatggatgtagtatgtacaagggacactgaagagatagctctggcttgaacaaagtgtcttttattggatgtatagtactaggaagtgaagctgggtgggagacagaataggaagcagattagaatatcctgaatgctagtaggaaaaatctgaacttggtctgagggacactagccttctgagaaggttattgagaaaattgtaattgggtttaaaagccagatgtgtttgatttggaaaaagcaaatggtaaaagtgggtagggcagacgtgaagtgcccagaacccagacagaggatggcagtgtaagaacatggagaagtcagaggttatgatggaaaaatcggtgggacttggtcattagttgaaggtgtctctcaggtttccagcctagagattatgttagtagcagtctaactctagcaactaaaaataatactgctttttaaaaaacactacagctgtgattatgtagtcaaatgggagtttttgtccttaattcatgaatatttatattcttaaagtggctttgagatataatgaacatagtatacaattcgcctatttaaagtatacaattcaatggtttatttagtgtattcatagatatgtataacaattatcacagtcaattttagaaccattttatcacctcaaaaagaaaccccatactttttgtttcttagtgcagtattctccccattttccctactccaagcctgtaggcctaagaaaccactgatctactctctatttctatggattttcctattctggaatttcatatgaaagaaattatataatatgtggtcttttgttactggcttctttcacttagcacagtgttttcaagagtcatccatgttgtaacatatatcacgtcttcgttttttaaaaaaattgctgaataatagtctattgaatggatataccacattttctttttccgtttgtcttttgagggacatttgggttgtttccactgtaggggagaaaaaagtaataccttttccttacccattgctatttccctggttgaggcacctataaaaaagacagattaacaagagaaaatcattcaaatttattttaacgtacattttactgacacaggaaactttttttttttttttttttttgagatggagtctggctctgtcgcccaggctggagtgtagtggcgtgatcttggctcactgcaagctccgcctcccgggttcaaaggatcttcctgcctcagcctcccaagtagctgggactacaggcgcctgccaccacgcccggataattttttgtatttttagtagagatggggtttcaccgtgttagccaggatggtctggatctgacttcgtgatctacccacctgggaagtgctgggattataggtgtgagccactgcacccagccgacacaggaatatttagaaatgaagacccaaagaaacagggaaaactatttttctggacagtcataccgaagtatgataggaggaaaaaaggatatgatctaatgacaataaactggaggaaacgtagtaaggcctgtttgttcagatttttgtgtctctgtgtcttcagagataaggacacttattttcctttgtgtatagggtagggacctctgtaataaaggttttatgacttactttaaaggaaggtcagataatccttttatggcctggttcaggggagaagggtgagggcaaggtcagaaagactttcctgcttctgccattttttcaaatgtcaggatgccagaacacatatggggtaatgtgttctgaaccccatagatacctttttgctgctatgaataatgcctctatgaacatttgggtacaggtttttgcgtggacatatgttttcatctgtcttggcatatactcaggagttgaattcctgggtcatgtggtaacagcttaaggaactattagactattttccaaagtggctgtactattttacattcttattagcagtgttcgagggtttcaatttctccacatcctggccagcactggccataatccgactttctaattctaaccattctaatgagtgtgaaatggtatatcattgcggttttgatttgtgtttccctgataactaatgcgtatttacatatttagccttttttttttccagtcacaatttgaatatatttagggggaaacaaagaataatgttttgaattgctgtaaaaagaaatctttttctctgaaaataaggtcactttctccactataacattttatacaaatagaaaaccgcaatttagatgctgaatacaaatataaacataagaaggaataggggatagaaaaggaacagttcttagtttgaaacttgttttagtttcttataaacaatatattgccttctataaaaaaacattataaggtacttaattatatatacattccataaagtctcatgcagaattttctagaccattatggatgtggtatcctttgtttgccgcaatgtgggagataccttgtaattaattatgtagtactttgtatttttgcggtgttttatcatatattatcttttgtttcttataataaccttatggaatagatagaggtgatattaaatatacactgctaacaaatctagtatctgagaacccttctacttagtgaatattttaagaacagtggtaaaaaattaatggaaagcagggcattggggaaccattgaaacattttaaaaggggagtgatgtagtcagaagatagccaaaagaatgtatctaaaggtcaaagtggggtgaggaacactgttatagtgaatctttatgaaagaaaaactttccagtgctggtcactggttgatttgtttcaaatagtattgaatgtaacccaactcaagtgaattgaaagaactttcagtagtctcttttagagctttactaattcagtgtgttttatgggcttagcacgcttttgttatgccactctgctaacttactcagcttattttaaaggcaggtagtatcagttcctctgggaaactattacaaatgcagaatcctgagtcccacgccagagtactggataagaatgtacattttaacaagactccaaaatgatttgtatggccgttaaattttgagaagcagtgtttggtttctttagtatattttatttggatttgattaacagatggaatttatctttaaaatttagagattaacaattggggggaaaactttgaaaatataaacatgtacagtgcaaaagggctaaatgaaggccactggtttacatactgggtgagaattagttaaatggtatagatattttgtttcagaggcctagagaatgtctaaaattaatataaggatttaaataataaagatattatagcgaaaattaatggtgaaatgaaaccttttactacagatggaggtgttctgtgctacaaataggacactatttatagtggaatgtgaaaccatttgaatatcctatatcttcgtttgacagtttagcagacttgcttatagctgactttatcccttagatgctatacaatgattaatttctaggtgtgtagcatggtttctttatatatacagagagagatatgtatatatgtgtatatatagtctctttatatgtatctatatatctctctatataatagtctatatatatgtacatttcctttgaatagatagtgcatacacatggttaaaaaatcaaaatactgtaaaaaggtatacaatgaaaagtctggttcacattccttcatcatttttgctttctattagtagctccttttcctgttttgaatgcaaataagtagttatattagttttcatcgaatttctttattcaaatacaaatacaaaagatagcataaataacactatattctgtaccttgctttttttctttaaacaacgtatctgtcagatcttcccatatgaggaggctttctttgtgatgatattttaatggctgtataatatcctattgtaggattactaaaattcatttaaccaatcctctactgatggatatttgtgatttttcagtcttttgatttgaaccactatgtatataagacattttcataatgtgtgcagatatatctattaaatccccagaaatgggattctgggtcaaagggcaaatgtacgtggttaggtattcccaaaatgctctctaagagcattttgccattgtgaaagatgaaaagtgataccttgttggaatttttaactttccatatgttaaagggccttttgtatttacattttgtgaactgtttgttcataatctttgtctatttaaaaaattggattatttggtcttatatttagtgatctctaagagctcaatattattttggagaaaatgagctttttgttatacacagaagtactttttactcagttattttcattgctttttcttttcaatatgtagattttggatctgtcaatctttaattttatgtcttctgcattttgagccatgaataaaaagttctttcttacctcagagttttaaagggaagctcatgttttcttcaagtatttcatatatatctatatatctatatctatatctatatcatctatatctatatctatatctatatactcaagtcttgattcatttggtgtttgtcttggtgtataatgtaacatatggtttcaactttttatttttttttttccaggtggctactcaatcttcctaacattttttaagaaatctatttcgtccctaatgttaagacatgatttatcatctgctactgcatttctaaatgtatttgggtctacttattgattttctgttttgttccattggtttgtctgtccataggcctatgctactctgatttaattattaagatttttaatgtctggtaaggttagtaattctttactaatttttttgcagagttttcctggatattcttgttcatttttcatattaactccagaatcaacttgtctggttcaaaataaaaccctgttggtattttcattgagatcacattaaattaataaaatttgttattttaatgatgctggggaggaatagattgcaattttagatggagtgtctaggggggccttattgagaatgtaatagggtaaagatcagaaggaagtaagggaatgaactgtgaggatattagagtgtaagcattttgaacagaaagaacaagaaatacaaaagtcctgaggtaggagtatgcccgtgtgttcagggaacagtgcagaggccagagcagtaagtgaggaaaaataaaggattttgtagtccattgtaaggactttagtttttggatgggaagtcattggagagtttcgacaagagaaatgacatctgatttatgtttttagcagacactctgggtatcctgtttatagtagactgaagtgggtgttgtcagggaacaagggtaaaaacaggaactagttatgaggctattgtattgacctgggcaagagaagatgatggctgagataagagtaacagtagtggaagtggtagaagtttttggaatatgaatatgttttgtaggtagaactaacacttactgatggatctggatatgggatgtaagtagcaagcataaagaatacctctaagatttttgacttgagctcttagaagaataagtggtcatttcccagtgagatggggaagattgtgaggtttggggaagacagtataagtgtcatagttgtaaactctgagatgggtgtgtgtgtgtgtgtgtgtgtgtgtgtgtgtaatacacagtctttaatattttttctggagttttaaaaaatctaatatgcaatagttttattaaatactttttcaacacaattagaggtgattatatgatttgtcagtaactgaagtaatatgatttttatattaataagttcctaacattgaactattgttgtatatctagaaaaaatatagtcactagataaaggtaccacaattagttgttgcttctgttgttctcctaatgctgcttatattttattacctgtgctgagtttgggatgtttgttgtcaccgttgtattcccgagagatttttaagacacgtgcaagtgactgtgcaagacaatttgggaataaaactcagaaaaaatttattaggactttaaaacccccccacaaaaataggggtttatcctgtgtgttttcttatgcttcacaaaatgcatctgaataccagtcacagcctttgttcttggatttgactatttgtagtcaacaactaggtttaaattttactcttgatctcagatcatatattcctagggcttttaaatagtcacttgcagtttacttagaggtagcaatgattttatggcttgttacctcttgaagtattaaaatttcttattttttattgtgtctgtgtctaggctgatttatggaatctagaaaacagccagcagagtcttacagattataagctgtatattctgaccttgttcagtgctttattgggactttcttcctcatgatgaagtatcactttttcatttctgataatattggctacatcttccctgtttattcctttgcagacatactggactctgtgctgttcttgaacaatccaggcatgcccctctttaggactgttcacttctattccttttatctggaatgctcctgagtaaatatctgccttgctttactccttaccttcttcaagtttttgctcaagtgtcacctcaaatgacagcttaatattctacataatttacttatgtattaggtttctgtccttccctattaaaatgtaaactcttaaaaggcagggattttttttggttttacatatacaggatgtgtgtttttatatataatatatacagtatagaaatatatgtatcttaaactaatatatttccagtgcctaaaacagtgtctaacacataggaactcaaatgtttatggaataaacaaactatcttgaggagattttaattttaaggcactcacatttcgggtgagaataatcccatttactgtagcagagaaatgcaggtgatcctttaacttgtaaaattaattaatgtaaactacttttctccctccagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattacacaattttatatgtattttgttttatgtcttaacagggttttttaaaactctcattctataccattacaaagcatagatgcatcaggataatggaacatgaagaagtatcacatttcttttttcttgaagtaaaatttaaatcacacttcagttccccttcatggtaaagtcagtatcagttattagattgggatcagcattcctcccacctctcaccaaaccatgttatagaacgtccttgggagtcttttaagtagtgggatattcaagaaggcgtctttgggttttaattctgtactgatcactggaagtatgttgactgtttaagcccagatagtcccctggaggcaggcgcctatactattatctgaacatgaaaatctttgctgaggctaggatccctgtagctaaggatcagcctctctggacttatcatttggctaggccattcttctttatatttctggggaattgtgaggaagtaggttaggttcctgttctacttcttgaaatttcatatgtctgtatttttcctaatcatggtgcgttttttttctctctccctactttttctgtttttcgtgcggtggaagacccctttgcaaaccctttcctcttcaaaggcagtacctcactctctttttcttaacagggatctccttcattgattttaggctttctgaaacaaaagtcaagaagagatgttctcttcaggaatttctgctttggcagtctcatttgagatacggaggactggataactgtcttgaaatcacagagagaaaacaaaacatcagataaatagccctcattttcctgtggcaataaaaaccaaagcaaattaatattccgataagttattctataatactcttttccttagtagattcacgtctctcaaagaaatattttccccatcactctgctgctcttaacaggtggggcacatatggtctgtaagtctaggagctctgtttttatccctgaatggtgtttttaaggacagtaactgtcataaaaagagcagtgcagggatgagtaggttatggcctattaaagctccttaaggattcgatgcctggatctgactggttacagggcaaattccctgtatctttttggaaagcaaccctattggggagtttaatttttttccaacacttttctgtcctacccaggaggctcagctattggtatatcttcttgaaatctggatggatctcctctgggtcctgggcaatgtggatggggtattgtctccagcctaaagtaggcagctgcatgaggattcagttagtactagtgagtgggctggtcccctaactgtattctcccactaggccctcttcatccttagagtgattgaccttttccttattaccagtgctattctagatccttctctggatcttgagaactcccaggagctgtgggttcttttcaagggtgttgccttccatgaaatgtctgtattctctacatggaaagcaaaaagagagccctttgcatctgtctctgaaatgtacccactccagggctgaggagtgtactttcttcttcctgttttctttcaggcccacccagtcattctgtattttccccaggcaaattttattgcaaattaagggctgaatttattgataaggtgtacacacctgggaactgggaattaatgtgttggttcaagtgcctgggggaggcaataatatttgtttctaaaattcttttcctctttttcactgtgaactttaaaatctcattttactttagtgattttttaaatggtatattacaaatactgttatgatattgggcctctttatttgtgtagtatactttatcattaaagaattagtcatggttgttccatttgtgtttctgcttgccctcatgcccctcatcttttaaaaatgcaaaaaatcaatttaaatgtacgcttatcacaaaacaataataataattttccttgcatgctaacataaaccaattacatagtttcactggtgactacagagagaattaagagatcaccaaattattttggatctgttacctttttattggtctcagataatgctaggaaaaatcctagttcttgagaagtcatctgaacagtgactttaacattttttggccagaatctaccctaagaaatacagtttagcaactcagtatatatttgcatgtctactgacacacataacacaaatgaaacaaaagtttcagaaaatcatgctgcctttagcatatgatagccttcccgacatcatctatttgattctgttttgtttcattaaaaaaattgatggtgttgacccactaaattgatttcactacctacatttttaacctgtgtagtaaagatagggtgagacactagttaattttaaaagagaaaattattctttaaaagccctgtaagtcaggagagtttacctgagacttggctttgatatcatattacttttactttcaggaacctctttattatgtccgaggtaaacatttcctattgcatttttataacaaaatactctaagtttcttaagttcttataaagacagtctcttggcaaatgtcatttctaagctcttttataggtagagaaatttctatgtcagtatgctttgagaatttctcaagtatttttgttagcatgctgtagttctttcttccctccctgtcttcctccttcttttcctcctctcctctcctctcctctcccctcccctcccctctgtttctcctcccttccctttctcctcccttccctttctcctccccttctcctcccctccctttctcctcctcttctcttttttgagacaaggtctggctctatcacccaggctggagtgcagtggtgctatcttggcttactgcaacctccacttcccaggctcaagagatcctcatgcctcagcctcccaagtagttgggattacaggcatgcactaccatgcccggctaatttttgtattttttgtagagacagggttttgccatgttgcccaggcctgtcttgaacttgggagctcaagtgatttgcctgccttggcctcccaaggtaccaggattacaggtgtgagccaccacacctggcctatgctatagctctttcctacatactttcttcttttctctgtagactaagaagatcttgctgagttcgtacagttagtctcttagggactgaccaactgaccttgtctggtacatttacctattttattcgatgtgcagaacacctcagtcatggctataatatatgtaaataatcacctctgtagctcagtctccatagagcagcaagaaatctattgacacactcagtttcagtcacttaggttgtgtaggaaaaagaataacttttagagtgaatagcatcagttaattgtcgtgggtaaaaagggaggggatttagtgggagattttattttgactcatattagtaggttaatattatcctggttttcatgtaaatacacactaagccaggtgagaatgttgtgatttataactagaaagctaaattataagtagaaagccctaggtaataactcttagggggaaaaagataaaaatattgctcattttgaggaaaacattatttctaattataaacacatttattgaaatatttgtgacagagattcttaatttacatgtggacccactacaatttgaggaaaccaaaatcatgccttttacagcaaatgttataaatggaggaaaaaataccattgccctttaaaatcattttgtaaatttagatgagttattccagatgaattaacccctcttagccattttgcaacctactagtgataatatcaaatgttggttaaaaaatacaaaatagaaatataaatttatcaagtattgcatttttatgatttaggtatgagagattatacagaataaggatacacgttttctatgagaccatctcatataggaaatgcttcttaactaggacaattttattttcagttataaaagtgaatcagctaaaaaattattaatcatctatgatgtgtaagactctagatatagttggaaacagagatgagtgtatcactaaaaaaactcctatcataggtgaataagtggtgtgcttgtaaagataattaataatacccagcagtgtagggtaagagacaaatgagtgatgcagaggacaaatgctaaagaagtccaaagagagagaccactgtgggttatacattatttatgccctactttattttggataaaggaagagtcctgactatagtagattaaggagaaagtaaagagagtttaattttttaaaaataaaaaaggccgggcacggtggctcatgcctgtaatctcagcactttgggaagacaaggtaggaggatttcttgaagactggagttcaagaccagcctgggcaatatggctaaaccccatctgtacaagaaaaaaaaaaagccaggcatggtggtgcatgcctgtatttccagctacttgggaggccaaggagggaggatcacttgagcccaggaggtagaggctgcagtgagccttaatcacaccactgtcctccagcctggcttacagagtgagactctggttgttttgttttgttttgtttttctttaagaaaaaagataaaaaagatgaacctatggttgttttagggccttaaaggatgcagggaaggacaggtaaggggtaagatattcagacagtgagaatggcatgggctccagcatggatattcatagggcatggctagggaaaagtgattagaacagtttgtttcatgtagaaaatcagcaggaaataaagttagtagatttaaagtagatcagtagaattaaagttagagctctctgaatgttaggctaagctctgaaatttaaatttataggtctgatgaattgctcaggattttttttgcaggtatataataaggtgaaataggattttatgacaattaatcagtggtagtgggtatgagagtatggacatgggaaagattggataggaataaaaattagggagatactccaggagtaaggggaaaatgatctgagatgtgggtgtggcaataggaatacaatatttttttcagtttacatttacatgggaagtttttttttcttttttgagacagggtctcactttgttgcccaggctagagtacaatgacatgatcatagctcactgcaacctcgaattcctgggtttatgtgattctcctgcctcagcctcccaagtagctggtactacaggcatgttgccaccacacctggctaattttttaattttaatttttgtagagatggggtctcgctatgttgtccaggctgatcttgaacttttggcctcaagtgatcctcctgccttgtcctctcaaagtgctgggattacaggcatgagccaccatgcctggccctggaatattaactggtgtagaagacaattcaaaagaataactggtagatcttagcaactgaagaatatgggaatatgggaatgagaatgagggagacaataaactgtaactccatgtgttaaaacttataatgtagaaaataaacatcagtttttgtgcaaaggtcatgaaagttattgagagtatgcgtacaagtagcttggtctcaaactgcatttgagtgtgtaatttaaagtttctccacaagaatagattttatttcccttttttcctttgtgctttttttgcttacttagctgttttggttctgggatttatatatgaaacagaaagtttgtgttaggtatacagcaacatgactaattagtattctgttatattgctgagacaaattttagaacactagcttatgagagaggcctgcatctgaataaagacaagtaacttgttatgcagcagaaaaatcagaaatgtgaaaaacacagtacagagaacagattttataaaatttataatgttatgatctctttgaatcactttgcacagtggcataaggattgaaaacagattggatgtgtagagtgtctagttatgtctatacatttatataataaaatctcaaagctaaaaattggaaataacacagatattcattaatagaagaatagaaacaatattctattcatacaatgtaatattaatcagcaatattcaagcagtaacatggataagtagcaaacacattgggttgagtcaagccttatacaaaagagtatatactatatgattctgtttatatgaagttctagaacagacaaactaattggtgggagaaaaataaaaaaccatccttccctgtggggctgggggtcaggaattaactgggaaggggcatgagggaactttctgagggtgatgatattatattactatgccttgatagaagtttgggtcagaagtttgggtcacatggtgtatgcatttctcaaaactcattaaatggtatgcttaagattcgtccatttcattatatataaattttatctagaaatgtaaatatcttggttagtaataaaagtgccaaaatgtttagggctaagtactgatgtctacaaattactctgaaatgcatcaaaaataagatgaattgataaataatgaataattatatacatatgtaatgaagctaatgtggtaaaatattgttgaacctaagtggtgctctatgggtgttcactgcacaattctttcaatttttctgcacatttgaaaagataataaaacgttggggaaaatttaaggaactttgaatgcatattaaacctttagatgactgttttaccaatatgggagtcagtaaaatacagtgattaagaggctggggtcctgaatcagagctttgagtttaaattctattagttggatcttttattcgttttgagaactttgacaaattgtaggttttgctctcctataaaatgtgaatagtatctacatcatagagttttatgaagattaaatgggttaaattatataacgtttttcaagatgtttggtatagaattagctttcaataagagttactttaaaaaagtcaaaggagcatataaaaaacactgtagttaaaaccatagttttgttgtcctataagagacaattctagtaagtaaaaatatcttccagcaaatattgaatgtcttttcctatactctccaaaggatagaaatgatgaaacttaattatttttaaatatttaaacattttatttcattcaaataaaaatataagctctagaaaaaattgttttcattatatgtttcataacttcagagtaattctaactcagcacatttgtagtgtaccattgccaagatcttgaggtaggaagcaggaaaacaaaatgcactgagacagggttcctactcacgaggagtttacagtctacagcttaatgtttcactaagcaaataggctgaaatgtgctttcagatgtttaccttaaattataaataagtagaatccagatagggcatagataaaagtctctataatagaacagatagaactttctgtggtgatgaaaatattctgtgtctgtgctgtccagtatggtaagcactagtcacacgtagccattgagaacttgaaacgtggctagtgcaactgagaaactacatttctcattttatttaattttaatttagccacatgtggctagtggctaccggattggacagtgcatctctagagtgtgtttttcaaactacctgaggaaaaaggccagttattttaaatttctgatctgttatgaactaatatttttatagaatgcaatacaaattacgaaaatgaaaaaaaagatatgcaaaatacctcctcagttttttaaaagattcatcaaacaaaattactgtgtcaaaatttctataaaaatttctaaacactctcaacttcagtatttatgccatgtaacaatgacaaatagtttttagtgtggcagtggtcatagactacactttctactaggtagaggtctcttgcctaatgtacctaaaaataaataatttcctaaatccaaccctttatgttaaaattactggtacaggtaatttttttttacaggtttaagaacaattcaataatgcagttactgatgtaacagttaacactctgtgtagcgagtcttgtctaggagagctgtaccttgacagtgcaatgtggacaacttcaaggtggattgagaaggcttatttgatccagtgaagccatttttgcagttggaggtgtaagctgaaaaatctttccttctataaagttcagcccgacgtttacagcagccaaatttgctcagcaaaagaaagaaatctctttggaatgtcttagtgaatattgcatacagaaatggattggcacaagaattgatgggataaaaaagaaccagtaaaactttagagttggttactgtgataagaggtactttgaaggcagctgagatggcaaaaaaagagataggtgccatgcaggtgaaatcggtgaagatgaggattgccattttcttagcaatctttgtatctttattggtagccattaattctgggtttcgaactgcaaaataaattttaatgtagcaagcacaaattatgaagaaggccaccacattgagaatcaggatggttaatatatagacttgtgagagagtggtttccacatccatggggaagcaaatactgaccttcatgtaattgctgacaccgacaaggggcaacatagcaattagagaagaaaagagccatcctccaagcataatcagaatggcatgtcttaatcgcagcttttggtccaggtgaatagcataggtgatggtgtgccatctttctagagtgatgacggtgagggtgtagacagaaagttcacttgcgaatacagtgaaaaagccagcagtgctgcacccactccctgtctgccagtctatggcatggttatagtactggcccttggtttgggaatcaactgaggctatgagcagcagatagagccccatgcaaaagtctgcaaaggagagattgcacatgagaaaacgaggcactgtaagtttgtaacgacttgtcaggagaacaaaaagaacagtcatgtttcccatgatggctagaatattaatcagccaaatcaggaccctaaggaagtcatagcccataatatcttcacagggattaaaagcatctggttcaggagcacatcggggtgtcttgggtaagcagaaaccatattcatagtcccagccactcagttcactctcagcaagcatggaagaataactgtaagaagaattattggcttgaggtaagggattttctctgagtattaaaaaattcaagaattatgtttctttaaaggcaaagaaacaaaaggaaacaaagccataatagcctcagccttacatttatttgttaaattatttgagaactctgatttgatgtaggagtaccttaagaagggaatgaaaagccatttagactatatatacacacacatatatacacacatatatacacacatatatatacatatatacacatatatacatatatacacatatatacatatgtacacacatatacatatatacacacatatatacatatatacacacatatatatactatacatacatacatatatatataacattgatacaaaaacttaatgaagctctttacaaaggatgactttctttggaaaacaagtttagaaagacaatctatgcttggtaaatctaaaataatcctttcttggcattttcttaactatttatctctcatttagttgccaaccaaactgctaccaagctgttcgtatgtagtagaacacaaatggaattggaaggctcatgttgttgaaagtcattagctactggtggacttgtttgcacttaagtccctagctaatcaaatagtccaacagagaaatagaaaccaaggatagattattagaaatttaggagcagaggaagaatatagttgtggacaataggaagagatggtgaaaacattgctctttaggggtatgagtcaaagacagagggaggcttaagaggtactttgtccctagtgaaagaacagtccttcctttgccactcctttccaaccccactgatacttcctgagtttagggtcttttcctctctctctcttttttttttgagacggagtcttgctctgtcaccaggctggagtgcagtggcacaatcttggctcactgcaacctctgcctcccaggttcaaacgattcccctgcctcagcctcctgagtagctgggactacaggcgcatgccaccgcacccagctaattttttgcatttttagtagaaacggggtttcaccgtgttggccaggttggtctccatctcctgacctcgtgatctgcccgcctcggcctccaaagtgctggcattacaggcatgagccaccacgcccggcccaggtttttgtcctctcttatggagcaattagttttcttcctgatatcctttctccaattttagctctctccctagtccattctgtatgttccttctagaatggcctttcccaaatacaaagttactaatttcacttatcgaattcaaacctgccccaggctcttactggctatgagataaaatccaaactcattgtgatgacttccaaggccctccttggtctgggttctgcctatctctccaacctcatctctaagaagcagtagtgctgcagaattcagagaatgggctctggagcaagattgccaggatccattcctagcatggctcgtacaggctgtgtaatcccaggagagttaattaatatccgtgtgcctcaagttctttatttgccaagtagggataataatcataccttctatgttagagttgtgctaagagttgaatgcattcatacatgtagaatgtttagaataattcttgaagcaatcaatattagggattcttaaaattagctcttgcagatcccttgggcaaccttccctttggtcacataaaatgactcgtagttctctgaataagttctactgtttcactcctctgtctttgtacgtacttctgcctagaattttcttcttttcctcatctctctggtgaattcctcctcatctgtaaagataagctcttctatgaaggctttcttgattatagtacccaagtattatttatcctcctgccagagctgcacttaatacaattgcaattatcaaaacctattgcaattaagtgatgatgcatgtctatcttctttaattgtctaatcacttcttgaaaacagaggactaggttttacttatttctgaaatcccagtgcctagcacagttttggctcagagtgttcattcaatacatgtttgtagagtgaataattctaaaccaggatgattctagctctgaaaggaactgagaggatacagggacaatgagcacacagcatgatgcatgtaggctcaacaaacatttttgtttttacccatcttctgctaatacaatcttaggaactggagaaatgggcataatttttgtgtcaaggccattacatatatgtatttataatacatttttgtataatacatgaggagccttatggttcctacatattattaaaagcatatttttctctgctttcgaaagctaacttcccatgttttgtattttaagtgcatacctagttcagtgagtggaggagataataaattggaagaatacaatactgaagggaaagaacacagatttttaaaaagaaaatatgttagagtattgtggagcccagtttggaactagagaagggctgctgctatgtacagaagaccgcataggaacctctcgtgttttattattaaatattgttataaccagcacatttgtttgtcctcttctcacagacatcaatataattatcattttttaatctttaaagggaggagatggttataaagaactattaaagaaaatagatcataaatttcttagcattagaaaggttttaaggccgggcgcggtggctcatgcctgtaatcccagcactttaggaggctgaggctggcagatcacctgaggtcaggagtttgagaccagcctggccaatatggcaaaaccctgtctctactaaaaatacaaaaattagccaggcgtggtggtatgcccctgtaatcccagctacttgggaggttgaggcaggagaatcgcttgaactcgggaggtggaggttgcagtgagctgagatcgtgccactgcactccaacctaagtgacagactgagattctgtctcaaaaaaaaaaaaaaaaaaagggttttaaaggccatctgattgaatcctttcattttattggtaacgaaaccaagattaaaggaggtaagtgacttgtccaaggtctcttggggatagtgacagtggcagcatgaggtcttcataatcacagttcagagacctttcccctaacttcactctctctcattgtttttcaaagtgtggtccttggatcagctccatcagaatcaccatggtgtttgttaaaatgcagacccctggctttaccccaaaccctgaataaaaaatctatagagacaccgcccaagaatttgcattttaagtaagttctctggatgattcatacaaaataatagcctttgttaaattagatgaaaacagtccagctattcctgatttcctttactcctttccccttatcaaaactacttcagctgttagaagcactattgtaaaacttctaaaaattctgccatgatttctggttaaatttatatcaacaagaggtcaaacatgttttctcacttcctctcgctgtctggtcctttgtcctttctttttttgcccttctgggcatatgtctagcaatttttctccctggtgatttatctttggactaaatgcccacctgctgttactggtatttgtgtcctgggatggctcctgagggcagcatcatgcttattgacaaagcccagcacagagctgtctttagtattagaggctatgtggggagtatgaatggactcacatgggcttagtaatattgaatcagaggaaggagagctgtagcaccgctgctccagtcacaagaaagaaaggagaaaagatgggaattttaggaggacaatagggccaaccatagaggtaaggacacattatcttggggagaatacgtaagccttagtggctggctctagaatttctaaactctagggactgaggaatggctatctggtgggaagtaggaggtaggagatttatcataaaatgctttcacaagaagaatgctctttttacttagattttatgttaatttcagttagttttggagatgctagagattagggacttgtcttaaagcagtgatagcatagcaaacttaaggttgtatatgctcatttgagaaggtttatggtgaggactggtgaggattatattgaggatggtttaaagtcttccttcccctcaaaccactccttggtgctattattaactatatccataaatgttttcttgatgataagaataaagtcatgtggttgcaaaagagttacacagaaggttgctgatagaatactgagcaagaagagagggaagggtgaagaaaaggccactggaggatatgggtgccagacctactgcgagaaaaggaaaagaagagacagtaatacttatttacccttggtgttgtcgcattgcttagcaacttccttcattctcatggttctgaaagccaaatggtatttctgctgttccttacagatgaggagaaaggtctcaaaagggataaattttgccagcgatactctgttacaggaaggttacttccaaagattcatatacttggaatggaaccccaaagtccagggtcattccaccgtaccaacctgaagcatctgtctaacttggagattgataggaaaagaaaagaagagaaaatttcagaaagagattggcaaagtatcttagagggacatctagttttgtagtctggaggactcatgggggcataataaaacttctaaatcttagtaaatgtgccatagggacactgggattatcttttgaggcatgctcttttacagttgaagataagtgaaatgccaaggcagccagcatttatagcagaaaagtgttaaaagttagtcagtaaaacagagatgtagcttccatccagtgtatgtggtagcgatagcattaagactcattttaagctcaggagcatagttgtcgaggtagcctaagtctcctttaagggaagtggctacttttaagctacgtttgcaattagttaatctttgtggaatgttgaccatgtgactagggaaaattcttacaaatgaaggtatcagttgtatcagcctttggtgacatcaacatacctgcaaaattttaatttttgaggaggctttaatacaattgtagaataaatattaaggaacattttaaaatagtttttttaaacagttgaaagacatacctgatcaacttgatgccaattgcaaagaaaaaattcccattttaaaactattaaaagttgctttgcaacagctccgtaaccaagacttgtatcaaaagaaaataattgatgctgataataaggtgcacacagaacaagatacgacttctgagtttccttgcatgcaaatacttacagtgttttgttattcactttccttactgtgctttcacattgtttggaaaagttttcagaaatggaatgtgaaaaattctgtctgaaagagaagaggttaaaaaaagcatttgagcttttggacttcaggctaaacctgactgtgcgtctatttatgctttgttcatgcaaattctttacctattacaccagcatctcgttctgcaccattgtcctaactgaaatgcttcctgaggagagagtaaaggcttctgaattgtcattagagtgcttccagcttagataaaatgcttctgaatactaagcattttgtgtgggcactagagatgaaaaaacttaaatttgtcatattgaatcaaggattttccaatgattactaaaagctacttttatgatatattaaggtttgctccttaccactctcctttccacattggccttaacaaatagtcattctgtgttcatggttttgaattgtaactgggcatcttttttgtaaggatttgaagatgctggacctgacattatgatgtgaatttcaggttattttttcttatgtgcagaaacatacgtgggtgctccctactcctccatctttccctctaagaagtttagcctgtggaaagaagagaaataccaataaaataaaatgaggcctgttctcacctgggggagcacttacctagagatgaaatttaagggagatacaaatgaataaagaaatagggtataagcattcccttttcttccacagccttgccagcatctgttgtttttctcattgtggttttgatttgcatttctctgatgattagtgatgatgagcattttttctttagaagacatacaagcagccaataagcatatgaaaaaatgctgttctattcatgccctttgcccattttttaatgggattatttatttttttgcttgttgatgcatttaatttcattatagattctggatattagacctttgtcaaatgcatagtttgtgaatattgtttcccatcctgtaggttgtctgtttactctgttgatagtttcttttgccgtgtggaagctctgtagtctaattaggtcccactcatcaatttatgtttttgttgcaattgcttttgaggacttagctaaaaattctttgccaaggctgatgtcaagaagggtatttcctaggttttcatttaggacttttacagtctgagaaaagggaattctcatacactgttggtgggagtgtaaattagttcatccactgtggaaatcagtttggagatttctaaaagaacttaaaacagagctactattcaactcagcaatctcattactcggtatatacccaatgaaatagatcattacaccaaaaagacatgtgcacttatatggtcattgctatgctattcacaaaaacaaagacatagaatcaacctgggtgcctggattggataaagaaaatgtggtacatatatacaatgtaattctatgcagccataaaaaatcatgtcttttgcagtaacatggatggagctggaagccataatcttaagtaaatttattcaagattaaaaaaccaaatactgcatcttctcacttaaaagagggagctaaacactgggaacatatgaacataactgggaacatatgaacaggcactgcagaatactagaggggtcagggaaggagggaggcatgggttgaaaactatctatcgagtattatgctcacttcctggatgcaatatactcatgtaacaaactggtacatgtaccccctgtatctaaaataaaagttgaatcaaaaaaatagtggttgtccacagaggaggtctacagaaaaaaaaaaacagtggtttcttcataattacaaatgcccctgattgtctcttatttcttctctcctcatattcagtgccctgatggcattctcatgacagtccatctttgttttcatagagaatgaaatttgcatcttctctgatgagacaatgcattgtttctacacagttcatgcatattctatgaaagaagtatcatgctgttgacacattattacaaggtttatcaactgcattcattaagaatttggacattatggaaaaggacaggctcagaagggactacttccaaaaggttgcttggtgaagtcagatcaagtttccctgagggcagtagggtgcaaggccgcaaccagaaaagatatgtgacatttgcctattttccttttcataagtttcaaatagacttatattgtaatagcaatttgtaaaacatcagaaaattgaattgtaacacacagaaagcaggtaaaacatgaatgtatagctcaatgatttctcacagaatgatcacctacgtacccattagtcaggtcaataaatgaaaataagccacacctcctccctgcccccgccaagaaaaaagaaaaatgggaaaagagagcaggctgtgagggcctcaacttttactgatgaggaaggataaatgaggcaattcaaattggacatttctatgtattattcttctacaatacttatgagacaattccttgcaggaatactttgtctctttcacctactggaataaaaatccctgaactaaaattttcacatgccagtgatttcagaaggggtgtgatttctttgccaaaaaatgtgggtatccagaatcagctctatcataaaccagtatctctgtcattttcctaattgttctctcaccagctttgctcacccccaaaccatcctctaccttgctgcaaagtggtattttataaaagcaaatttgagtcatcttgcttaaaagtcttcatggctccccatcctctaaacaaccgggcctggcactcagaccatcatggcccacatctccttggcttcctcttctgactcatcttcttccatgtgtccatgtttcaatttttctgagtgagtttcatctactgtctcttgcctttttgtcttcacatgagctattctatcttctttgctttttctcactctgtctagacaactcctgcctgttcttcaagactcagcataaatcacttccctcaggaagccttccataatccctgctgccattaacaaactcttgttcagtgctcccagaacactctgctctgttctcagatctgtcataacatttgccgtgttggacttaaatattggctctcttgtgtgttgctcccatacagctgtctgtgacttatctttgtaacctcaggctttcacacagtatttgaaacatagtaagtgctcagttaatgttttggaagatcagttaatggcacatgactctgtgaatacagcaagtgttttgtcttctcagctacccaaaaagcctcaggtggagctgaacctcctatatgcaaggtacaaataatgcatactggttgattaattataaataattcattttggttgattccaaacaaagacagcagcatctggtgtcactctctcagtgccttatctaagtaattgaatggatcctatctccttaggctgcaataataaccctttagggcagtgttgttccaactgtgagttgtgtgacccattggtgggtcatgaaagcaatagagtgcatcaagactggcattaaaaataaaaaaagcataaaataaaatagagtaaaataagaaaatatcagcatattacatattaaaaagttaagtatcactcagctttatttctgttacatatgtgacatgtactgggttgcaataccaaagtatttgttactgtgcatctcagtcaaaaaagtctggaaaacagtgctctgaggaaagaacgaaattctgccaccgtgtcccccaccctggactgaacggaatcagatacccactactggatgcaaaccatgcaggagctccttcccttcctgttcccatgctaagcttatctttagctgtaattctgttctgaaatagaagatgctcgtctactaggagagaaatagttttgaaaactttctgtaatattttgtgtccatttttaaatcaaagatttaaacattaggtaaattttgccctcctgaggcttcttccttcacttaaaaaaatgatgctctctgataaggattagaacaaatcctttgagatgccagttttgtactccattctgcaaatgctaaaatggcctctaattcagtttacccagaattggctacaaaggtcttctagctgcagggtgaatcaactatttggtagcagtttccacaaggaaacagaacagtttgttttcttcttgtctatttgaaagtgaccccatgtctacggagctggccaagaaggtagggagtgaaggggagtggagctgtctactcattgactattttgaaatctgaatttctgccacagcttgggtaggctttaccttttggtttctacttactcttttgttggcaagtttctaaaagcacagcagtggctggggtaagtcaacgtggcctccaggagattgacaaatgtttctcttgatggcaatttttttagagaataggatgacgtggcaattagcctctgaatggactctaggccatagctcggcagggcctgcaatttggtggaagaaatatccctgaacaataaaggggagaaatgctttttatttatttattttatacattttttttttttgagacggagtcttgctccgtcgcccaggctggagtgcagtggcacgacctcggctcactgcaagctccgcctcctgggttcacgccattctcctgcctcagcctcccgagtcgctgggactacaggcgcccgctaccacgcccggctaagagaccggggtttcaccgtgttagccaggatggtgtcgatcttctgacctcgtgatccgcccacctcggcccctcaaagtgctgggattacaggcatgagccactgcgcccggccatattttatacattttattcagagaatgaaacctcccctcaacaatattatcattataggctctgaggaatcttttctccatcttgctttccccttaattctccatttcaattactctcactaagatctgaattcagaaaagcgagtctgtattttttctcatgtgcgcctcattattcttttcaaggttaagtataactccttgcacctaccatacatttattagcatttctctctctctcccctcttccaactccttttccctaccctctctcttcctccccaccctctctcttcctccacttctctctacttagcagaagtgaaataaccacttgctttatgcgacagccagcacatgcagttacatcagcttttgtgctctaccccaggggaaattattcagggcttcagatgcctcagtctttgattgattaagccctgcaggagaggttttcatgaagcacagcctggttacttattaagagcttctgtgtggcattagccatcatctacctaggaagcagaatgcatgttctctaatgcatgttctctaatgcattctctaatgcagaatgcatgttctctaatgattcatctgttcaaagcaagcgaacactcagccttgcaagctgaactgtgtgaaaagctcaggctttgtcaacaaggtcctgaactctttggttttactagacttgaggcaatgcccaagaaaattccaaacacattaagtgttaggagaaaagagtcaatgggaattaaacaattctgcttatcttctaagtggctgctgctggtgcctcacaaaacttttccaagcagcacagctcccctcagcaatcattcccaagacttggtgttcagcacatgggaggggaccaataggtgatagatggaagatgaacttgacaacatggaatgatgatggtgtaggccctcagtggaaaaattaaggcagcaaaatttgtctcaggggcttcagaatttcctgcttttgtgtccctgttgatttaggtaaccagggttctcattctgctttatagggtttttatctcagacatgttagggattgagctctttgaagatctggtggcttttttgtttgtcttttgagtgggtacatttaaaattaggttcttagaaacagtaaggcctcgttacaaggcagtgaacctctgatagtgggttttcagtcttagtaacagactagtgggagaaatgctttttgagtaagggtggagtggatgcttttagatacgattcaagtcctaggggtataatgagaacaaccccttgggaaggaagagacctaggtctggtgctagtgttttggacatgagagtgtaggggtctgtagtgcccacagtcacttctaaggagctaaccaagcagctcttcaagcaaatactgtcatgcaggagtcttgggaacacagtgggttggttgtgttttgcacctgagccagaggcagctctctttgtttgcctagtgaccaagtagatggccagcttgctgtaacagctctgcctacaggatgtgctaaactggagagtattcagccaacttacaagattcggagtctggtatgctttgcatatgagacatgcagaaaaagacccctaggataaggttgccagaagttgagagcagagaaagcagtgggcaggagccacaaggtagtggaagtcataagtaaacagaagttatggggttgagtggatattagagggagttaggattgacaacgacagaagttaggaagcagaaagatctaggaattttagtggtgggagttaggaagtagagtcagaagtcgatagtggcaggacttacgaagtagacagagtgagaactggacagtggcaggagctaggaaataggtgaagtcaggagttgacagtgggagctaggaactagcacagtcagggctcaacagtggcaggaatgggaagtagagagtcaaaagtggatagcaggaaggagttaggaaatagagagtgaggggctgaggggcaggagctaggaagtagacagactttgggttttataatggtggaaacagaaattagacagagccatgagttgatcttggcgggatctacagtacgaagaataacaaggacagctcatttccttcccttgctcaaaaccccaaagcctccccatctcattaaaaaaagacaaagtctatataagtgaccacaggccccgccatgatccagctctctgccacgtctctgtccttatattctgtgattcccttctttgctccctctgccatattggcctccttgctgttcttcaaatacacaaggcaagattctgtctcaggcctttgcttttgctgttccccctcctggaacacttttcctgcagataatcacgtaacttgctctcttagttcctttaggtgttcgttcaaacgacactttttcaggatagtcttccctcaccatcccctttaaaatagtaattccccctctccagaactcctttccccccaaccaaatgagttttctcctctacaaccaatagcatttggacaactacatattttatttacttattcaatccttgtctgtcttccccatcctatgaaggcagaagtgtttgtctcttcttattctctgccatttccctgatgcctaatccagtgactaccacatagtatgggttcataagagttagtgaataaacggatgaataaacaaacaaatgaactgggttaccctgctcaccatttttctagaacttttctcattgtaaaatgacatgcctgtttattgctttgcgtttgttgttgtctcccttatgtgactgtcatctcactaagggcaaggaccagggctattttacttactactgtctgttcaccacggtgcctggtacacaggataggttcaatcaatgtttgttgaataaataacatctgctagagtagggtgtcgtggactgccacctctatgatgggataactggtcgccgtgtgtgagagcagcacagtatctggaactctgttgcatttctccctgaagcctgactgcagcttcagctctctgcaggatgttggatgtttcatgttggatgtttcaggctttgtcagattcaatgttctattcctcctaactttctcatgtatcttttttttttttttaaatactttaagttctagggtacatgtgcaaaacgtgcaggtttgttacataggtatacatatgccacgttggtttgctgcacccatcaacttgtcatttacattaggtatttctgctaatgctatccctcccccagctgcccacccgccgacaggccctggtgtgtgatgttccccctccgtgtcgatgtgttctcattgatcaactcccacttatgagtgagaacatgcggtgtttagttttctgtccttgtgatagtttgttgagaatgatgctttccagcttcatccatgtccctgcaaaggacatgaacttatccttttttatggctgcatagtatttcatggtgtatatgtgccacattttctttatccagtctattattgatggacatttgggttggttccaagtctttgctattgtgaatagtgccgcaataaacatacgtgtgcatgtgtctttatagcagcatgatcctttaatagtacaatcctttgggtatatacccagtaatgggatcgctcggtcaaatggtatttctagttctagatccttgaggaatcaccacactgtcctccacaatgattgaactaatttacagtcccaccaacagtgtaaaagtgttcctattcctccacatcctctccagcatctgttgtgtcctgactttttaatgattgccattctaactggcatgagatggtatctcattgtggttttgatttgcatttctctcatgaccagtgatgatgaggattttttcacaggtctgttggctgaacaaatgtcttcttttgagaagtgtctgttcatatccttcgcccattttttgatgggtttgtttgtgtttttcttgtaaatttgtttaagttctttgtagattctggatattagccctttgtcaagatggatagattacaaaaattttctcccattctctaggttgcctgtttactctgctgatagtttcttttgctgtgcagaagctctttagtttaattagatctcatttgtcaattttggcttttgttgccattgcttttggtgttttagtcatgtagtctttgcccatgcctatgtcctgaacggtaatgcctaggttttcttctaggtttttatgtttttaggtcttacatttaagtctttaatccatcttgagttaatttttgtataagggtttaaggaagggatccagtttcagctttctgcatatggctagcgagttttcctgacaccatttattaaatggggaatgccatttgtttgtgtcctcttttattttgttgagcagtggtttgtagttctccttgaagaggtccttcatatcctttgtaagctggattcccaggtattttattctctttgtagtaattgtgaatgggagttcactcatgatttggctctccgttaatttcttattggtgaataggaatgcttgcgatttttgcacattgatcttgtatcccaagacttcgctgaagttgcttatcagcttaaggagattttgggcggagacgatagggttttctaaatatacaatgatgtcatctgcaaacagagacaatttgacttcctcttttcctaaatgaataccctttatttccttctctcgcctgattgccctggccagaacttccaatactatgttgaataggagtggtgagagagggcatccttgtcttgtgccagttttcaaagggaatgcttccagtttttgcccatttggtatgatattggctgtgggtttgtcatagatagctcttattattttgagatacattccataaatacctagtttattgagtgtttttagcatgaagcactgttgaattttgtcgaaggccttttctgcatctattgagataatcatgtgtttttttgtcattggttctgtttatgtgatggattacatttattgatttgcatatgttgaaccagcgttgcatcccagggatgaagccgacttgattgtggtggataagctttttcatgtgctgctggatttggtttgccagtattttatggaggattttcgcatcgatgttcatcagggatattggcttaaaattccctctttttgtggtgtactctgccaggtttagtatcaggatgatgctggcctcatagaatgagttagggaggattccctctctttctattgattggaatagtttcagaaggaatggtaccagctcctctttgtacctctggtagaattcagctgtgaatctgcctggtcctggactctttttggttggtaggctattaactattgcctcaatttcaggacctgttattggtctattcagagatttgacttcttcctggtttagtcttgggagggtgtatgtgtccaggaatttatccatttcttctagattttctagtttatttgcatagaggtgtttatagtattctctgatggtagtttgtatttctgtgggatcagtggtaatatcccctttatcattttttattgcgtctatttgattcttctctcttttcttctttattagtcttgctagcagtgtatctattttgttaatctattcaaaaaaccagctcctggattcattgattttttgaagggttttttgtctctctatctccttcagttctgctctgatcctagttatttcttgccttctgctagcttttgaatgtgtttgctcttgcttctctagttcttttaattgtgatgttagggtgtcaattttagatctttcctgcctttccttgtgggcatttagtgctataaatttccctctacatactgctttaaatgtgtcccagagattctggtacattatgtctttgttctcattggtttcaaagaacatttttatttttgccttcatttcgttatgtacccagtagtcattcaggagcaggttgttcagtttctatgtagttgtgcggttttgagtgagtttcttaatcctgagttctaatttgatggcactgtggtctgagagacagtttgttgtgatttctgttcttttacatttggtgaggagtgttttatttccaattatgtggtcagttttagaataaatgcgatatggtgctgagaagaatgtatattctgctgatttggggtggagagttctgtagatgtctattaggtcttcttggtccatagctgagttcaagtcctggatatccttgttaattttgtgtctcattgatctgcctagtattgacagttggatgttaaagtctcccattattattgtgtgggagtctaagtctcttcgtagttctctaagaactggctttatgaatctggatgctcctgtgttgggtgcatatatatttaggagagttagctcttcttattgaattgatccctttaccattatgtaatggccttctttgtctcttttgatctttgttggtttaaagtctattttatcagagactaggattgcaatccctgctttttttttttgctttccctttgcttggtagatcatcctccagccctttagtttgagcctatgtgtgtctttgcatgtgagatgggtctcctgaatacagcacactgatgggtcttgactcgttatccaattttccagtctgtgtcttttatttggggcatttagcccgtttacatttaagattaatattgttatgtgtgaatttgattctgtcattatgatgctagctggttattttgcctgttagttgatgcagtttcttcatagcattgatggcctttacaatttggtatgtttttgcagtggctggcactggttgttcctttccatgtttagtgcttcctttaggaggtcttgtatggcaggcctggtggtgacaaaatctctcagcatttgcttgtctgtaaaggattttatttctccttcacttaagaagcttaatttggctggatatgaaattctgtgttgaaaattcttttctttaagaatgttgaatattggcccccactctcttctggcttgtagggtttctgctgacagatcagctgttagtctggtgggcttccctctgtgggtaacccaacccttctctctggctgcccttaacattttttccttcatttcaaccttggtgaatctgacagttatgtgtcttgggatggctcctctggaggagtatctttgtggtgttctctgtatttcctgaatttgaatgttggcctgccttgctaggttggggaagttctggataatattcaggagtgttttctaacttggttccattctccccatcactttcaggtacaccaatcaaacgtagatatggtcttttaacatagtcccatatttcttgagaccttgttcgtttgttttcacttttttttctctaatcttgtcttcttgctttatttcattaatttgatcttcaatgactgatatcatttcttccacttgatctaattggctattgaagcttgtgtatgcttcacgaagttctcatgctgtgtttttcagctccgtcacgtcatttatgttcttttctacactgatttttctagttagccattcgcctaaccttttttcatggttttttagcttccttgtgatgggttagaacatgctcctttggcttggagaagtttgttattacccaccttctgaagcctacttctgtcagctcatcaaactcattctccgaccagttttgttcccttgctggtgaggagtggtgatcctttggaggagaagcgatgttctggtttttggaattttcagcctttctgctctggtttctccccatctttgtggttttatctacctttggtcattggtgttggtgagctacagatggggttttggtatggatgccctttttgttgatgttgatgctattcctttctgtttgtgagttttccttctaacagtcaggcccgtcagctgcaggtctgttggagtttgctggagatccactccggactctgtttgcctggatatcaccagcagaggctgcaggacagcaagtattgctgactgatccttcctcttgaagctttgttccagaggggcacctgccagatgctggccagagctctcctgtgtgaggtggttgtcagcccctactgggatgcgtctcccagtcaagctacatgggggtcagggaccccttgaggaggcagtctgtctgttatcagagcttgaacactgtgctgggagaaccactgctctcttcagagctgtcaggcagggacgtttaagtctgcagaagttgtgcccacagctgccccttcccctaggtgctctgtcccagagagatgagggttttctctgtaattccctgactgtggctgctgcctttgttcagatatgtcctgcccacagaggtggaatttagagaggcagtcagccttgctgagctgtattgggctccgcccagttcgaacttcctggcagctttgtttacacagtgtgcataaaaccacctactcaagcctcagcaatggcggatgtcccttccagcatctcaggtctatcttagactgctctactagcagcaagaacttcaagccaatggatcttagcttgctgggctctgtgagcatgggacccagcgagccaggcacgggagggaatctcctggtctgctggttgtgaagaccatgggaaaagcacagtatttggtcaggagtgtatcgttcctccaggtacagtctctcacagcttcccttgcctaggaaagggaaatccctggaccccttgtgctccctgggtgaggtgacgccctgccctgcttcagctggccctctgtgggctgtacccactgtccagccagtcccaatgagatgaaccaggtacctcagttggaaatgcagaaatcacccgtcttctgcatcgatctcgctgagagctgcagactggatctgttcctattcggccgtcttggaaacaatttcccatgtatcctttaaaacccctttaactgagagagcctggccctaatccttgcaccctcagagagtctgacagcagctcagccccgtccaaccaagtgccaggggcatgccagatctttggccttagattcccatgagtggattccaggtgggtagccagcctctttgccagcacatgaggccacccctcatatttggtgttaggggttgaattgtatcctccagctaaaattcatatcttgacgttcccagtacctcagaccttatttagagatagggtctttacagaggtaatgaagttaaaatgagtttattagggtgggctctaatccaatatgactgctattcttattaaaaggggcaatttggagatacccacccacacacacacacacacacacacatgcacacacatacacaatgtaccatgtgaagactggaattatgctgccacaaccagaaagaactagcacaagctaggagaggcctggaatagatgctttcttcacagccctcagagggagccaacccctgctgacactttgattttggacatctagcttccagaaccataagacaaaatttctgttgtctaagcctctcggtttggggtactttattatggcagctgtgatacactttgtctttccaacagcagccttttcaggtgtagaggctgatgtctcacatatcagcttggggatgatgtggagggacaccctaagcagtcctgttggggtacactgggcagggaggggaggcagcaccattctactcacaaggttttcggccctgtggccccacggaaggctccattgtgcatcttctccagatgtacgttttcctttagctccctgtggggaaggatattgcccttagtggagtttgtacctcatgtgtaagcattcgtagctccatatacacatgtttagaccaagctatgtgcatgatgtatagggttaaaagggggaaaaagggtaagtggagggaaagtgggaaaaagacaagctagttcttaatgaaattatgaaattactggcatgtgtgttggccacaccttttttcttccattccccccttcacttggtagaactctgtcctacagcttaaagtactcaccccctcctgtcctggagttatgaaagtttaccaccagacagctggataaggatgagattgctgctccaagaggccaagactgaacggctgaagtgcagcctactctttgttagcctctcagtcattgtgaccgtggaggtctcagagtgtgctaatagtaatttattgaagtttgcaaatacttgaaaaagtagggtccattcaaagttatcccttttgtagtgtaatttgcattctttttctttcagatatgcatttctctgtgggtgagaaagaggaggacttacagcctctgtagaaaattgccccatggggctgtgcagtgtaaatgatcatcgccaggtgtatgtgtgtgtcatggaaaaagtgttgagggcctctactctcaaggctgtggaagaagccaaaagctgttatggaagtagctccctgagggctctgctgccttgagctcaaagtcattcaggctaaactccttaggagcagcacaatctggtcctcctaggcagcctcctttctgggccctgacactggtatctctaagcacaggcccttctttgagtagtcgagggagctagaagaggaatccctgggctcaagtctgccagccttcttttgagcacttcctctctataagagaatggttgtgattcagagcatctggaaaaccgtggatggtgggaacagtgtgcatctaccgttgatgtgatgatttcaagcgtgggaacatgattctcttaccacattacagtgtacacagcaaaacaaacatactaacacccattccccgccttcattgctgtttaagaactgcaaaaacccctgcatctcactctgggtggctgttttccacatttctactaagcattttctttggaaaccctcagccctttcatcagaatccacctgtcaatctcacatcgtcccatcccctgggtatatttctactttcaaagagatgagattgtcagaatcaactgctgtttaaaatataaatcaaaagaaatttttcttcctaaacctccatggctcttcttcctgattccgtttgttttaattatgttcagttatagttataaatcattgaaactgggctctgtgagcaaattattcttgtgtcagcccagtcagattaattgttcaaatttcgtgacagagcatttcacacgttttattaaaactcagatctttctgtatactgataactctgtattatgcaacttggtcaaaaaataaatcaatttcccacattttcctgggggtcacttttgagaattctcccaatgatgtgaccttgcggtgtgagaagcacaggcaggatgaccttttgaagcacaggggaagaacccacaagctccgccaaagttttcccagcttgggtgctctgggaacagtatggactgactcctagacccctcaggtgcctcagggccaccttctgcggctgcccctgtctttcctgtgctgccttagtaagtcaggtgtttgcgaactttgcaggacttcagtatcgttgtgttctgaacaactttggacaggtctatttatgaggaagggttgaatgtatcgtttgaaaattttgcttgacagttttgaaaactgctcctcccctgctacttaaactctttaatgggtgaccttgcccttagaagagaattcagactcctttcccatggctgctcagtcctgctccatctccttcatctccagtctcccccttgctaaagaccctccagccacactggcctcccctcaattcctgggacttaccaacttagttccttttccagctcaggacctttgcatatctgctccctctttctgtaacgtgcttccctcactgttgacacagtggaatccttgtcatccttcaggctcagcctaaatatcacgtcctcagtgaggccatcctggataccttgcctaaatcgttcacccctcatactctctcagatctcagtaacaggttatttccttcatagtatatattacccttgtaataattttatctgttatttgcttttttttgtctgtcttttctgatagaacagaaactacataagggcagggactgtgacctctctaccattgcagactcagtacctaacacggtgcttagtatatcagtggtgcttaataaatgtttgttgaatgaaattaagtttgttcttggcaaactgactcatgttcttgatttcctctttcttgcaacagtgagatacagggtatacaggacgttgactaattgaacttttcatagttcacgtccattttggcatctctgtaacagctgatatgctgctgaccatctgaaatcttccctcctaaatttctgtttttcctgacctcacacagacatactgtgttggtttttctcccgtctgttttattttgctcttgcttctcttgctcatcttgtttccctttaatttaatattcagttcttttatttttccccctgttcaggtgacctcagccacacaggacttcagctatcccctctattcagatgatcctggcatttgtgtctctagccctgccctaccccttccagccttccgtccttcctgctaacagatgaaccttctttaagcactcatctcatacttccatctcagaactttcaatggcttctcattttctggagaagagagtctaaactctttactatggcatctaaggcccttcctgttttgtccctaactcgtatctagaaagtactatctgctggtctatgaacacatcttataattcctcctctggaccattcttctggctgtcctctgcttggaaggcatttttcctctctttttgcctaagttatgcccagctcaaagcccacctttctcagaggctttctatactttcttttcctgctgcctttgaaatcccagaggactttacctctctctggggaggcttcatgctttgccttctgttttagttagtagtcaatgtgcagtttatacactatttggagatgcttcttcctatgctgtaagctcctgtagggcgacactaggacttaatcatcttcattccccctcaaaatacagcatgtttcttcaaacacagctgatgcttggtaaacatttgtagagtgaataatggaatgaggcatctgagagaactgtgccaggagatgatataaatgcctctgatttaagtttgtcagaaatcgatttaattggccagagtgaacacttcattaacttaagggtttttgttaatgaacctttcattaagtcatcaagtcaaaaagaacatgagagcaaattcaccccatgataggagaacaacttaaaaaattctacaatttcttgaacacttagtatgtgcaactatgctgtgctaagcacacaaaagtataatcttgttgaattgtttacttataattaattatattatatattatataataaataagcacctactctatgccaggcacagcgttaagtactgaggatatgacattttcaaaacaagcctattattggatccattttatgaatgaagacactgtggcttagatcggttaagtaacttgcttaaggtcataccagctgttaaatagtgggactggagtttgagtcccactcactctgaagtctattcttttagccaccaaacgatatagcacatatcaatataatagaggctttggttacatatctataattaaaaataaatagcatattgtacagaattttgctacccaacattagactgtgctacccaacttcagactgacagcatcagcatctcctgaagcttgttaaaattgcaaattctcaggccctacctagatccactgaatccaagtttctgggggtagggcccaggaatctgtgttttaacaatctgcagattcttcgtaggtgtgtaaaaatttgagaagcattagtatagatcatggtttatacaacttattgattttaaaagccttttttgtttattttccataattttggctttaatcgaacttttcatgtgctcttagtttttattatgcacaaattgcagggtgactgtgacctcaccctgtacttgctatggttcaaatgtccccagccccacaaactttgtgaatatgccactcttttagaagaggagccatagaaggaaagagaggttgagaacagtgagggaaacagtagcgatgctcttcttgagttaaaggctgttaacatcaagaactgggtagggtgtggtgaaaacacaaagctccctaccttgtggaaaatgagcttcctcccacactagcagtacagagatgggactctctgagtgggtctgttgtggctgacaagactggtaaatggtggtgttatctgatttctctgcagtggggccaggagaagaatttctttctgaaattctgcttcctctaacacaccatcaacctgagtgagggggctagagagggaggcattgagttgcaggaggcataaagtagggtgttgaatattgcagtaaactgtcaacttcaatgtatccaggctgcatctgtctttgaaatcagggtgctctggggtttctagccagccagttgcctagtaacatgcatgaaacactgagggctagccacttgaaagtttatttttgccctgagttagttgctgaagattgaatgtgatcttgtagccagagtaatatttcatttttattcctgagctggggaaataagcaaatacttacagtgaagtcagtgtcgtcccattgaatgcatgactttgtacttcttcaaatccatttccatatagtttgctgaaggagggaggagagggtttaggaatgggaagaaactgaaagaaacagtttggaaacacatttttcctcctgtaacatatattactaaggttattacaggcattcataatatctagttctccatcatcaccaccaccatcaatttattaagtgtctattaagtgctagatacttcatcagccactctatgtttattttatgatttaatcctcatcatcatttccattataccgacaagaagcctaaccctcagtgtggttatgtagcttgcttaatgtcaaaggaaaacagtggcatagctgggatccaaggccagagatgtttaacacttaagcctttcctctggttttgcaggccggtgtgggcatatgggttttctgggtgttgaaagctgagggcagaggaagcctccagcactgagcccacttttttttttttttttcttggatgagtatgtggttttgctgatgtcagatttggctccacaaccaagaagatttcaatgtctgtaaacagtcctttaagaccattagtgcatagtgaatcaatttacttgggcataaccagcatttaaaaaatctacatagaaaaaataaaaagtattagagcattttgcaagtgattagggtattaatgtttatgaaactttatcccaccattttttatggtatatacctataaatacacacacacacaaacacacacacatacatgtatacttctacccagaataagacataagaggatccttagaacacagatatggggaaatgtttgagccacaaaggagtctagagggaatcaagcagcacattgtcattttgcaaagaaggaaataggctcagtgagggaaagtgacttgtctaaagcctacaactggcataaatgggactaggatatgctttgtctggggctacatccagcacatcaattttgctgattctttttacttttcctccactgatatcctcatgggctacccatcctcttcctgcaggattgtatttcgtgtcgtgttctcagtggggcctttactggctgccctatttaaaacaccaatttcctgtttccccctactttccctatactccttccctgatttgctttgcctccgttgctttatcatcatctgacccatgattacattttatgtttttattgtttacctcctccgtgagaacatatcctcctgtatctagaacagtgcgtggcacctgggagtattacagtaaatatatattaaataaattggatgaccaaatgggaatttcttaccataaatcatagccaaacaagtttgaaagctactgccttagatggaaatatttgtataaattctttgtgaatgatgatgtaaaacccacgtgagaaagggctgtggtgtgatgtaaagttaaactccttatatctgccaacaccctaacttccctttgcaggattgctggaagctggccagggacaggctgtggggtgtgacttgagaaatggttcagaaacatgcttcacttgttcctgctccaggtagctgttgtctgcaaggcctctctagtctttgttaaacaaaatgagcatggagcttcactttgtggggtgtgagtatgtgtgtaacatcaacagcatgtatgtactctgtgtgtatgtatgtgtggtctccttccaccaacccacaacacagctgagacaaaccaacatataaataaaggtgtgactcatgttgaagtataatatttaagctctgaaattcagaaaatataactagagattacaaaataattcttaagtctcctcgttagagtcagttcaaagagggcaggggagaatatttaattcatttcttaaactcctggggcctcacagaatgcctggtgcctagctcagtcaatagcctgagtaaagcagcagctttgcccttccccgggaaggggaggcttccatggtttcccaggctctcatatgctttcttctgagattcttcagagtttacagcttcacatactagctctcccatattggattactggatgccactttcaatagttttcatccctttctatattgcagaatctgaagcatgtttctgaaccatttctcaagttacaccccacagcttgtccctggccagcttccagcaaccctgcaaagagaagctagggtcttggcagatacaaggagcttaactttacatcacaccacaggcctttctcaaataacttatatttccatctaagtcagtagccttcaaaattgtttggttatgatttatggtaagaaattcatcttacatattctcatttggtcatcccattcatttaatgtatatttactgtaatactcccaggtgccaggcactgttctagatacaggaggatatgtttctctggaggaggcaaacaataaaaacataaaatataatcatgggtcagatgatgataaagcaatggaggcaaagccaatcatcagtttcacatactagctctaccatgttggattactggatgccactctcagtagttttcttccccttctatattgtggaatctgagaacataggtacagggttgatgcctgttgtcttgcataattatacacaaccttgttgtttccttagaagctcaatttcaccagaattttttaaaattttgcacctaggatgttagtctttggcagtctcctgtcattttaggggttgaattcctttatagcagtctcttttagataaaggaatcacactctttttctgaacttccttaagtttgatttcttagactcttgcccggtatttgtcaaaactttctcctccatccactgaattagaatcacctggagttgcttgtcaaaaatgcagactcagacctattaaatcagaaactaatagtggtatccaaaaatatgcacttttataacaagctctcctagtgagccttcagtatgccagtttgagaacctttgccctagggtatgtcataggatgatactgttctcatcattcccatggggcaaatcagatggtcattggcttggaattgtgtccagagtctagtccctggattgctttctctaccttctaagtgatgatcgcactacacatggagtagatgaagaaaagatagcccttgctttgttttcaccaaagctgctaacagttgtctagatgcccattattcatcacagctgcatgctgccctgatccttgtttgatacatgttaggattttatgcttttctgttagactcacagtgtcacaggtgtacccttgtggttaagtctgcaggcactgaacccaattgcttgaatcccagctctgctgcttacaatctgaattactttgggcaagttacttaccatctctctacattagtttcctaatctgaaagtatgataatagtatcaacctcataaagctattgtaaggactgaaaatgtaaatatatgttaaacatttataagtaggttctggaatacaataaatgcttaatgtgttgatcttattattattattattatatttttcagtagcctctagccttctgacaagaacagaggtaaacgatctccctttccatgctctggacaggatttctgtgaaatacaagcattttgtttaattgcactatcatccttctccaatgaagtagggggtctttctcttcctgggcagagcaagtcaggtcagtggcctgggctgcactaaatgtactcacgtgctgaaggctctcaaacacctttggtctgtactagcgtcatggacttttttgcctttagacattttccatgtctttttttttttttttttttttttctgaatagcctcagtcctgcttgtctcaactttctaaacaacgtggcccactgtttcagttgctcttgtctcttttcttaccggtcacacacaatagaatgtgctgccttgttgtgattaaaagagaagcttccttactttggagaaattacaaatgtgagtgggagacctcatgctgtcagtcttgcacaatgcttttaatgcccttaaaaaaacatctggagagtcacttcagataacttttttccaaaacatcatggtgtcagaattaaatgaggaaggcttcctttgctttactttgaggattttgtcacaggcacaaaaatgaagatttttcgcctcccccaacttctctattacaatagctgtacctaactttaaagcattgtctaggttctctactcaaatgtcagtaattgtgaatcacacagaatggcacctttttgttcaaaataagatttgggctttagatattaatcacagatgatactctaattctgaatgctgctttataatgaaccccaaatattcctggggctctaaaagcacttctgggattctaatattaacagtattagacattcttctatagtttccttttggatcacctggtttctggatgattttgaagaagaaagcttaatttatgtttacagatactcagggtctcaaaaaagtggacccattgctaaaaggcaaagcataccgttttagaagatatcttttagaaaatatggtggtatatttgtaagcaattttttttttcaaatgactatacaaacagaattctaaagaaaagaaaaggaagtcctaaattcaccactttcttccctatgtggaactttgctgaagtccttttatagctgaataattccttacgtatgaagacacttctctagtggatgtgccggcagtggttagatgggtaactgtgacctggttactactatgtgctgctgtaactctagttatgaatcagggtccccccatttctgggggttcatagtctctatagcaatggatccctctccctgtattgctgtgcctcctgcctctcagcagcactgagttttcatgtttccttctacctcagccatgttcatgtcaacttatatgtctttactatatgtaataataaaaagggtgacaggcatcagaaagaatgataacaataaaggattctaggccgggcatggtggctcacgcctgtaatcccagcactttgggaggctgaggcgggcggatcacgaggtcaggagatcaagaccatcctggctaacacagtgaaactccatctctattaaaaatacaaaaaattagccgggcatggtggtgggcgcctgtggtcccagctacttgggaggctgaggcaggagaatcgcttgaacccagtgagctatgtcaaagtgggatgacctgactaaggctgcttggctggttagacacagagccaggactgaagcccagactccctatttcaacacagtagagagacccagcagtctctctactgtggcttgtcatgggtgcagcctggaatcatcatgcctttccagacatcacttctctgtagggtcttagaaaattaattgctatgacctttccatttctttgtggagttaagatgtgaatcaagattgtctctttttttgagactggtgtgaccaatcacctagaatattttgaaggtggcacagctaaattctgcttatttgggaaggaggggcatttcaaggtggcctcttgaggagatttaatgaacaaccaaagtggctataaagggacataaaagcataatgcatagttttagcattagccccactgagtttctccagcatcaagtgaagtgttttgttttcattaaatgagctcacagttggtaaagatttgggtagggggagggcaagacaggttctacaaaaagcaaaatctcaaataccactaataatgaaaagagaaggcttgctttcattattttctaattagagagttgaactttatagctgagaaaataaggctttcctctttaagcgtaatgccctttttccagcaggctgctccacacgatcctttgcttacagaggggcccattcagcagagaacaagtgccaggcaaataaatgactaatcactccccttccagatgaagggccaagaatgagaagggggatggaactacaatgtcccacaggctctctgggagagacggagcctcaatctttattaacttcagagtggggaaattacaccctactggcatgcactctttttcttaaaatcatgagcaacataagttaatgtccctgtcattagaaaaccatgaagctctctgtgcacatactgaagtatgatgtgtgagaaggaatctttggttactctttgagtctcgtggggtggcccagtcttgtgagctcatagttacctatggattatcccaacattggttttcttcttcaccctcctccatgtcttctgccttttcgttcctacttcactccactcccatcattgtacatttacctcggaggaatacctattggtctctgattatttttagatttagatcaaagttgaagggagtcatggatatttgtgatctttgaataaagcctactctattgaatagattattttattactttttccagagttacctccaagcctgtctccttgtcctggcacttaagggtctctgcaattcagtgtcctctccatctcagccagttatctaaactcactttccattccttaaacagcatgtttactcccaagtagtagcctcatcctgttctcctcctgccatgcttttgctcctgccatctcttcacttggattccttactctgcctttctctgtatgttgtggtaccgcataacggttaagaacatgactctggagccatactgtctgggaccaaatcttgacctgagatagagatacttaacctcttgatgccttggtctcctcatctaaaagtagggttgatagttcctatctcataaggttgctatgggacttaaaaagtacttaaaaacagtgcaggtatttaataagggctacatacatattagctgctattttcacatttacccatataaacgttactgattccatgaggtctaattcaaatctgttagctctaccataaagcctctctgacttccccagcccaaaaggacttctctaagatcttatttctaggtaccacacactctcatagtgaatatctactagcttgtattattattttattattttatgttttccccctcattgagactatgaacttctcgaggacatgaatctaatcctgtgtcttttgtgttcttgatatagacatgtggggagaccccaaatcctaaggcatgtgatatcacctcattcggaatttgtttgttgaataccttgtttttggtgggggacatgatgaatgagtagttccagatccattatgcaatggtgagttgaaaacactttataagcagccggtagagctgtggtgtgtgagggaagtggcaggagtggagagactgttgagaaatatttctaggatcaacagaatctctttcctggtgtttgagagttgcaagtaaagagtatgggttatttttgaaattatttttggttgctgctctgtattcttttgattgcattaatctgagatgaagctacatggtcacagctttgtaacatgacaattatacatgtaaaattacatctacacaaagtaaaagtactatacaaaggcagtgcaccaaggataccaatttttagaatccagtgatataaaagagagtcctctgagatgatctcttcttttgcttcacatctatctcttcatttcagagtcattccaatccatgttttctcttttttctttaagggtgagctcctttattgcctcatcacaattttgccatgggctgtaaccaaagcagaaagagtgagagggatatggattttaggagcagaattaaatcagggtcactgggctttaggtataaagaaatgaggccggggggtggtgactcatgcctgttttcccagcactttgggaggccgaggagggcaggtcatgaggtcaagagatggagacaatcctgtccaacatggtgaaatcctgtctctactaaaaatacaaaaattagctgggtgtggtggcacacgcctgtagtcccagctactcaggaggctgaggcaggagaatcacttgaacccaggaggcagaggttgcagtgagccaagattgcgccactgcactccagcctggtgacagagcgagactcagttgcaataaaataaaatatgctgcccaggatgctgcttctgaatggtacggcagtggagggctcccatgtgaagatgtatggcagggattccagagggaaggaagtctggcaagtgtcctgtgaagaacatgggttgagttatcttagtggagtgctcctcaaactttaatgtacatgtgaatcacttgggatcttgtaaaaagcatattctgagttagtaggtctgcggtgagctatttctaactagaggatatggtttagatctgtgtttccacaaaattgcattacaaattataatccccagtgttggaggtggggcctggtgggaggtgactggatcatgggggtggtttctcatggatggtttagcaccatccccctagtgctgttcttgtgatagagttctcatgagatctgattgtttaaaagtgcgtgacatctccctgctctctctcttcctactgctcctggccatgtgaggtgctggctcacccttcaccttccatcagtattgtaagtttcctgagacctccccagaagctgagcagatgccagaatcatgcttcctgcaaagcctgcagaattgtgagccaattaaaacctcttttctttataaattacccagtctcaggtagttctttatagcaatgtgagaatggacttatacaccagctctcagaagatgctgaagatcatggctcatagtttgaatagtgaggccttaggaaacaccatgaaagggatagcctggtaacctgacgagtaactgtcaaataaaaacacattatttttaagcattaaggaatagagagaatgagtatagatagtgttgcttcagaagcaaagtgagagggacccaagaggaaggcgaaaatgagagagacagagcaaggtccattgatcaactacttttcctacttggagaatatccttccaaactcttctctgttgaaatcttgaaatttctatgctctttttaagccaggaaagccactcctctctagactgtgtcttcccagccttagagcattctccattaatgcagtgaacaatttcataagtttgagactcagtcactaaaaatcctcagggcctgtttggttaaactgaattggttggttggttgtcatgtgaacatatgacccagctgtgatcttacacaactcccttcacccttagcattttaggttaagaagaatgtcaccagtgagtgaggaatgtggtaaaacatgagaaaaagctcaccccaacctagtagtgagactagcaggaggctgtatggcagaacacaaatctgggagtttactcacagtgttacagattcattattcatcccttgaaaagcatttcctggtatggtggttatgtgtaagttatcacaaatttcccttgaggaaagaaatgagaaatatttactttctaaattttagctgcaaataggaaactgttatgcatagcaatcagcctggtacttacagaatgaaatttgattcagaggagaagaccttcgtaacatctggaaactttctgatgcctgtgttacagatgctcctgtgattagggacaggatagtggtgtgggcagagagtgggtaaaagtgattgtcattaagacataaagataaaaagagagtacaaaggcattttgcaaatacaactttcacattaaatttaaaaatattgagtttggtgttatcaggactacttttagctgagaaagattgttgcaatttagaagtccctcatgctgtgggagaagatgctttaatgactgctatttagagacctggggactggggccaaatttaaaggtctttttcatttatatttgtagcctgtcttttcttattaaatcaatcacattttcccgtattgcattccactttcttttggtaattagtttattacaagctcttgatagttcgagaaagcatccttaaattttggagcaggttttgattcaaatacttcaagaaaattaatcttttatgataaatccatattgctcattattaaaaatcttcccttatttagctatcttgcaattcaggaagttcttctttgcatctcattgaaatcactaaacattgttttggtgtttgggactattcaaggctcttcttttcttcccaccttttatttagcctctgaagaggagagaggcttaagtgataggtgaaattgaagagtattttattacaagaatggggctccctcagagtctaggcatctggatttccccactggagttttagattcaccagtcatgggatctggacaactaatatgaactgtctgtcaccctcgtgacaatgaaacaaagccaggtttctcttctggctctctctggttctccttcttatccaaaagcccaggtcacactggatctctgctctgtctacagctggggatagcagtgtgggattagactgcaacgtgtacttgggttgggtgaatatcacagttttggatgaaaatactatttaataaagacaatgattcttagataataagaggctgcagtggtcaaatttggttctgggagtttcttatgttttttcaaagtagttgatgctaccgtatgcttatgtgccctatagacaccctggaggtttggaaaaacagaacacctgagtttggaattgttcagtgttagagttaacaaaggagctatgccagttccagtagcagctcttatagaaggccccagagcaagactgatgacgtgaagtaccagagagatgtcccttctctctgttttcctttttttgggcagtgatgggaggtgggctttacattctctgaggagtttatgaaatttaaagaaaaaagagggatgtctgttttagggagacgcaaatttttctttgtgaatagggatgacttgatatgtgaaaagatccatagtgataaattcatagttttcaggaattttggtattgctgacaaggcaatgattgtggcaggctacagtggtactcaatttctaatgctaactgacagacttagttagaattaatgggaagtggaaaataatgatttagtttatatggcacagtgtctaccttaaggcaatacttaaaaagttttcatttaatgaacaaatgaaaaaaatgagataaaggagatcagaaactcttaacccgtgatgagagtcagaccagaattgccactctcactttcacctactctctattcacttcagagattctgatttaccctttttaaagtgttatgacctccatctcccatacccattgtcaaccttgaaaatcactacagaggggtgacgttcttcccaggtgtttaggactgataaaatgttgggaaccacttacatgtatgtaaaagcacccagctcggtggctgacaagaaatgacaattaaatttaaatcagaaggctgaagaggaacatgcaaatagtgccatgtatatggttaaacaaaatctttccaaccttttccttgttttgattttcatcagatgcccatcttcccctccccaattgcttaaaaaggaaaatttctcacaagtattttaatcggggaagatttataaatgctccgggctcaatgtatctcagatttttggtgttctggatcagtctgtaaagagagagggaaaaaaaaagctgctgtttaatagatgtgtattgtttgaaatgtgtgagatcatggtcaccagaagttgctggctgaaaatggcatcagcaaaagcaggcgaccttcatatgcttgggaggacccctagcgactctggggatggaaatggcttggtgagagccagttccctatttccaggaagcactgctctcaagcttctaaagaggtgggtataaggatcagagcagggagtctgtctctgcaccctcccacccctctcccccaccacagacagcaccgacatccagggctcctggccaagcagattctgccccactgtggaccctgtacactgagggtgatgagagactcctctcaggagagatgagcaaattacctactctcccttgtaagcaaactcgtcctcttcatattggccggcaatcacatgagcagttataccgaggggcaccagtctgtggaatggcacagggcaaaagccagaggcttgaatttgggggattttatactcatgctgaagataatttgctgtgtcatgatgtccagcctcctaacttccctgagctagtgtctcttctgtaaaatttgtataataatattacatagtcttcctgcctcacaggttagtaggttttaagtaatagaacaggtagagataatatgaggcagggtttggcaaagtataaaagtacagccatacaccactgtgatgttattgccctccccgcccaactccctcattcccctaattactgtgactctacaaaaagtagtcaccattgctaagtcctgtctactttgtattaaataaaaggccagtaaatgcctttgggtttcttaatccaggtgacagccacctgaggaaataataattaccttgttctatagagagaatgtagtatattggttaggagcatgggctctggagtcaacttggtttttcattctgattttactaatcgtatgaccttagatatatcactttaagttctctgtgtcttggtttccttatagtgttgtttttgaggaataaatatatgtgtctggttcacagtaaggcctcaaccagtgttaacaatagttataatagttgctgaaattaggaagttgaatgatttgtcttcggtcacacagctgagaagtagcagaacttggatgtgacccagtttttctgaccctcagtttagtgcttgttccaccacactacagttacccaccacttgtgcctgtttccatcttctcagcccttttgattcttcagatgtgagtgatattttgttgtaattatttctacaacaactgagtcaaacaatcataggccatatagagccttatgtgggtgggatggaagggacttttatctctaaaggtcttttgggctgggtgtggtggcgtgcatctgtagtcccatctacttggcaaggaggtgggaggatcacttgagcccaggaatttgaggtcggtctgggcaacacagtgagaccctgtataaaaaaaaaaagattaaaagaaatttaataaaagaattttggggcctgaccttagcccagtcattcattcatttaacaaacatttattgggcacctacatgtggcaagcatcgttctatgtgctgggaatacagctgtgaacaaagcaaaaaaagccttcatggagctagcatgctagtcttaggaccttctttgggaatccataaactttccctgagagtgctttatgtttctttctgttgatgaatgttgctttgcatcacgggaagctttatttatcattagctgccctggtggttctcaatataagctgtgttttagcattacctgggaagtctgttaaaactgcagctttccaggtctgggataggactgtcgtctgtaattgtaatgagcccaatgtgtgattctgcttctcagctaagtccagactatgtcttttgcacttactcattattttggatttctctgtaattggtgagtagtctcacttccctggctacactgtcatctcatggtggacatttatattttatctcttctgtattccaacagcatttggccctgtattggacacatggtagttgctcacgtacttaccaattaattattctcttcaggtaattattcattgggtcatttatagggggaccctgtggtatagtggaaaatctggagctttgaagaaagacagtctgggattgaaccccagtcctgccatggtctaaagcaagcttgtccaacccacagtctgcatgccacatgtggcccaggatggctttgaatgcgacccaatagaagtttgtaaactttcttaaaacattatgagtttttttttttttttaaactcatcagctattgttagtgtaagtgtattttatgtgtgacccaagacaattctttttccagtgtggcctagggaagccaaaagattggatacccctggtctgaagtgtcacatcggtcaagtttctgtgcctttccaagcctccattccttcccctggacgaaagggataattacccccactctgcatggtagctgtgaggattaaatgacacaacatagaagaaatgccaagcacagagctcaaaaaatgtttgatgctaatacttttccccttccctaacttttgaaactccaaagtaggtaaagtttgagtgctcttctggaaactcaggtttgcgcctgagtaaaagcagcagtagggggcctggtgtagaagtcacatgcattgatttctaatttcagctctggcactaacttgcggtgtgatgtcaggcaaataggttaacctcttcaggccacagattcatcacttgaaaactgaattgaaccagtcttttcctatcctttttgtgattttttggggaaatgatactttggcaagggttgtttctaagagttaattccaaaacatcacaataacaacaacaaaacccaacaaacccaacacacacatgcctatcacacagcttttacactgtaggtattcaagaaacattcactgaatgagtgaatgtgccaaaacagcccccaatgaaccaatttatgatctctaagctcttttccaaattttcccactatcccaagtactccataccctccataggcaagagctacttggcaggagttcataatgtcaattttaatttctatctttgtgttgtgatgtttcagagtttatacagctcccagggagaagcagttgtcaccatagcaacctacaggccactgcagtgagaaaaattagtgcctgcccagacctagtaattgctgtagtcttttccttttggattcctagcagtggatgcttgaatacaaataccaagtgggctccagccagtgagggtaatagtgtacagcagtaaactgtctgttagctgatgcttacatttcagacaaattgaggaggttgtcaaaggcattagcttctatcctttccagggaatcaatctgagagatttcactagggaagagaggagggggaaaaagagaaagaaacatgaaagaaatgaccgtgtctgcatgattatgagctatgtgtgtgacccaacaactggggacaccactgtgtccccctgaaaagaacaaagatgtgcaagttgtccccaaatcatacagtgctaacatctccctttaggagcactgatgggcacctacaacccaagtgcagttgaaatgcaagttttagtagcccctgtttatgtgacaagtttttctcttatttatctctgactcagagccacagattgttagaattgcataggccctttgagaaaatctagtcagattcccttgttttacagctctggaaattaaggccctgagaggagaggcaaatagtatttgtattaaggttcaagactaggatatggatctctgggtcccaattctgtcactctagtgaggctttaatatggattgaattgtttcataactcttaacccttagtttcccaaaatctcgtgctgaggccgttgcaaggtggtcaactcctgcacatggtatccatcctgaattacaattacctacttccttgactgtttttctcacttgtgagcaaactgaggacaaagagtatattctattcacttctgaatccttggtggcttcatgttgcttggcacagcgttaagagtacaaaatgaatgaataagtgaatgcagtagtgaataattgaattttttgaaaacaatacaaaaataaagaaaccagttttgtcatatatgattcgcaagcatgtaagtcatgccaatgttaccctaaaatcccaacatacgctaccatttcctgccagttgaaaaaaaagtctcaaattcacaaactgtacatttgcttatttctaaggttaaggctcactgaaggcttcagactgatgagagcattagcccacagaaaggcagagcctaaggtagctaatgtcttttcttaacaacacaggaatggattattcttggctgattcatcttattcctacctattggtttgcttatttaactgtagctccttttctcagtaggaggtcttaatgcattaaaggttatcaaaactcaacattccaacttgagagcagaagagtgtgggttaagctcaagtaaaccgacaagtccgtaacctgcagggaatttcctataatatgcagtaattcttgaggaattattttaaatattctaattgcttactaataccctaaagggcaatagaggttcccaaaggagctaagatcaatgctgtagcatcttctttagagatgcaaatctgcttccaaagtccagtggattgttaagattggagatgcactgtgagaactcaatggccatgaggtcctttgactcaggctaatattaagaaagatgctggaatactgggcccttgagaacattctctctccaagtatgggaactttggtcctagaagctgaaacccagaaacaaatgatcgaagttatgtctgacaaacatgagatcatactgcattatccaggtgctttacacttttgataaatgcctttcatcaatatagttataaatactgtgtttttgtcatatacttatattttagatataaagattatcttctgatgcacaataaatttccaacacattttttttcctatgtgggtgttatctaaaaatgtgacacaagggaatagctgctctagcagaaggagaatttttatgattggaatctatctttttttctccttaaaaggtatatcatcacttataaaatgcattcagtcatttgaagcaaggttaattatctgtattttaatgactcttaaaaatcataccttttcttcaaaggtctctagttattatttgtattacaaagataaaaatatgtgagtatcctaaacacaatttctttcctagaaaaattatcccctttcaaatgtgttttctcttagaaaaaattcattattccaattacgaatgtcttttgatatgcagtaacttacttacatttttatgacctcattaagtcctctgaaagcttgagatgggatcactttgacagggaggtaggcaagtgatctagaaaagaaaaaaggaaatccaagagtttaagatttatgatagggtgccttttaagttcatgaataaaatgggtatgtgtatgtgtgtgagagacagagacttcagagttcccaagaactggattcaggctgaggattctaacttaaatcaatgaagagatgtgccatgacttattcttggtctttatcaaagagtgtataattttgcggttaagactgtgaacgttgagattaggcatacctggacgcaaatcttcgctgtcccactacttggctatgtgattctaagcatgttatttaagccctccagctcagtttctttgtctgtaaaattgcaataataattcctacttcacagggtcattgtgataattaatcaggataatccatgtaaagaacagggcttggcaccaagtatatagttaaatagttgtagagtgatcctatagacttgattgggaagatggacaaaaactatgttgagtagagtggagacattaatgatgaaaatacaactggaaatcatgcaggcaggaaaacagaagattcattaagaacatgctcccatcttgatctctactgtctttcccaggtagcctatttcaatattattccaaagagacaactttgatcctatggttaactcacatgggcatctcatgtcatttgcggggaatgtctatgagatcatttccttcaggcattcacttatacccacaggaaaaatctaaatattcttgaaattgaaataaaatctatgctgtacttaagatttgagaaaagagtgacactcagaaatgcaaaaccagtataggatgatgtgtgaatgctaaaggaactggaggttaagataactcaggagaaagcaactgcaaggcagggacgaacatgcagccaacatttattgagtatctacaatggtttaatgttttggcccaaggactggcagagaggaagggagtgggcaaggatatttcaggtgggaagtgagtatgtgagtatcaggaatatgagaacaaaggtgaaagatgctgtcttgtttttaacatgtctatgcagcagagactgctttaagcttctaggaaagaacacctccatgatgggcagatgaaagtaagatttcttacagtcccagaagggacttgctacagttgtaagctactatgtgagttatacacacccatttgtgaccttcttttactcactcaacaatggtgtgaggtgggaatttctcttacatagcagaagaaattgggtcacaaagagactaagtaacctgaacaaggttacaacgaggcagaatgactccagacatcctttccctgtgcaatactggccaaagcatgtcactcttaatcccatgtcttggtgagcaaggtggagggacagacattgcaaccttgcttctcctgagaggaagcatgtcacattcgctctatttcttctgcaaagcggtttaccagccgttcctccctaggtgctaatagggaggaaatttcatttcagaaaaatattttcactcaataatctcttagaaatgatataacctagagaaagtaatccaactttggtctctgattctattcccgaaggcattcccaagaaggacatcgtttaacacctaaactcatttaacaaaggatccgagaagaacagggacagtgtgggaagaaatcttcttgtgatggcatatttgcttcctatatttcttctggaatcatgttcgcttggcttcctgattaaaaacacagttttattgctctctgcactgccaaaccaataaatttacagaagagaaagctgtattccactgtaccccttgcagcatcaataaaactgacagccaaattctgattccagaatctttattgctggggataatgcagtgcagaacatattttggagagtgtttacataaaagcttcagcagaacacttcagagctgtttattcatgcaaatggagcccagaagctgaagtctctcagcaggcagcctcctcctccaaatgggagcatggtgtgactcccagaggagcagtttggttcagatttgatcagggaggttgcctgagcttttgattgatgtagggaggagggatgaggagcaaaggtcggacagaagtgcaagaagctgtagatcatgcaatggcagtctccagtggctacagaagcagccctggtgcaagctgaaattttgcagcgttgatgttgatgctgcagagcaggaaaggcagcagtggggagagtgaaactagagcctcccctataaaagagacaccaagtgaacagcaggtgactttgtggatatggctgggtcaagaaagagtcctgggggccagggaatggggagagaggtggggttaggcaggtgcactgtgcttttcacaacagatgtgttcccatgaggcaacacagagaatgtggtcctgtgaatcgaaaaccattttccctacagacttatatgttttttttttcagaaatgtcacatcttcatttctgattcgtctttgatgggtagcagttcctaagcattcaagtatctgtctccagaatttattaataaagtttatgatttgttgataactgtttgaatgtactccctttgaaggtgtcccactctctattggatgcatctatgattctttccatgatgccagaaacttttagcaatgtgaacaatgatcttaataaccctgcaattccactcctgtatacattgagaaaaattctcaaattgatacttaaaggaatcttgtacaaacgttttcttcacagcattgtggcatcaggggcttggaggcaacctgggtgtccattactaggtgagggagtatgtaaaatttggaccgtacacacctaactgaataggagagcctgtagaagtgagagtctaaaggcacacagagtagcatgggtggatcttcaaatcatggaactgagagaaacaagaaattacggagatataatatactgtttgcagaattaaaatatatgtaaacgaaacactagacattaacctcctcctgcacatgaacatacactaggattgttatctaaggtgagttgagaggaacagaagtgggagaaggagataaaataaataactaaaaacagagagggactttgaatggactagtgataatgttacttgaatgaagaaatatgaccaacttaaccctctgtactagagagacaaatggaaaataaaaaaggtttattttgatgtattggcagcctgcttgcttacctttcttcctcctccttcctcctctctcccttcttccctccttcctttcctttccttcatatttttttggagttaggcatacttgtattccaatagttttgtgaactattgtggaaaggtctagtcggtatcatttgatatagagcagaagccaaggagaactgagggcaaaaatgcctaaggcaaggacagttcagcagctctgctgtccagggtcaaaaaaggaatgaaagctatgcataaagcaaagaaaataaaggaaggacagagccctttctgtctcagcaaaagagggtgatacaccacaactatgcacctcagatgggtggtaaagaattagggttactgggaaaatatgaggttgaacttgcagggtggagattctctcttgaaaggtgagacggctgtggaaaaatatggctgtagaactatgcagctacttaaatttattatattttcacagtcttttttgcagttttgaacttttgtttttaaataaattgatgaggcaacgcaggtggcaccttgcccaagtgcctttgccacagatgttgaaacaaatgcttcaattggattacaaagtctgcgttagcttcatcagcttggaacttccatctactcattaatctcatctgcaggtccccaacccttctagttgtgtgttaaagttgaaatcgaaacagtctgtcctccttagggctggaattaagtcattcatcctagtactgggatcttgtgattggtcatgactctggcgaggcttgtgcatcgtctaaactggacccaataatattaatatttgggggcaggagtgcacctgcagtgccttcccacatgctatgctggtgtttgtttttgtctcgatttcttattctgtagcttgcttggtctccccagaatccatctaggagtagggcttctcttagttcctgccttctctttttctcaatcaccagatcctgatccctgtatctctaccccttagggaacactgctgccctagaacagttcctggttgctgtctggttagggtcaagctagtatctcttactgcttagttctgactttcaaactgggccccttggcacagacggtgaccctgtgttaggactacccagtggagttgggttactttctgtagtggatactgtggtgggctacccaagtcactctttagtactgacgcaccaatttcgccaactgctaggaaagagtgggtggctgaagctctcagctgagttgctctcctagaattatgcttatagactgatgtggtttgggtctgtgtccacccaaatctcgtgtcaaattgtaattcccagtgttggaggtggggcttggttggaggtgattggatcaagggggcagatttcccctttgctgctgctcttatgagagtgagtgagttatcatgagatctggttgtttaaaagtgtgtagcacctctcctctctctcttcctcctgctctggctacatgaaaatgtgcttgcttcccttttgccttctgccatgattgtaagtttcctgaggcctccctagccatgcttcctgtacagcctgcagaactgtgagccaactaaacctcttttctttgtaaattacccagtcttgggtatttctttatagcagtgtgagaatggaccaatacacagaccaagattgctacctcacccaggattatgtcttctcttttgggcagccctcatccagtgactggacaatgtatagaataaaggcccagcccccttgcctccgggtgggactactcagaaggaccatcctatctttagaccttcttcctatcaattcttacctgggccctgacttgatccccttcccagccaaatccaattgccaagcactcagtgcagctgtgtcagagtccagtgacaggaaaatttacagcatccagataaatctaattaccttaaagaagataacgccaccttatcatgtcctccctggtggtttctaatgtctcctgggtacccaggattggggcttgggcccctcttcttttttcttttgagtttaatgacacagatggccttggaaggagccaatttgtccagtttaatttttgttaactaatcctcaaagtaatgttacctggagagcttcagtcaggtgggctctagtgtccccctttaagaaaatagaagatttgttttgtatgttatatatattaaaaattttaaaaaaatctggaaatccttgcttataaaaacctatcaattgggagacatatgcactatcaaatatttctttgttctatagatggatttactgcagggttgctttaaatagcaaactccctgggtgaatggaaaatagagttcaattgacacactctctctttttaaggacaggtattgcataaagcaaattataactgtaggtttctcacctccccttggtttttcagagcttgaatacaagatgtttcccagggcagggaagccttctgatgccctcaggctgaggaggtgcagagggagagaagagccagggaagaaatgcagcaccaatctggagtctccaaagactgtataggctctttggtcacttgccagagcttttacttttccttctgcccaacacatggcagaagtgaagtgtttttattcactaccttctaattgttgttaaaaatgccaactatattattgatttaagaaagctacaaacatccattcattttccacagataatgagtttattgctagagctatatcctgaattctaaaacactacaaaatcagatgaagggaaaaaagagagaaatcagagagttaaagcttttttgcctaatgaacttgttgaaatgggaagaggtttatttaattatttaaattcaaaagaatttggtgtttttgtatttattaagatcttgttctacacttaacagtgtcttaagaagttctgtgttcttttcaaagctgctcacaatgataataaacttgctttcatcttagaataaaataaaaatagctttcctcttttgaaatgattttaaatctttgagctgtcaaaggcatcggactatttggtggcttcattacagggaatgtcttcacttattggcctattgtcttcagcatttacctagagggagctgaggcttcagtgttaactgaaatatgaagtcagtatagatgaacatccaatatgttacgctttacaccagaaaactttggaacagtctttaaaaatacatccaggtggttttgattattgttgattgctccctgcagttactgtactaggctcaaggagtcagagtgaaagggttgcttacaagtcatttggtccaacccctcactttacagagaaagaatcttaggaaaagagaaatgacttttttgaaaccacatggcaattcagaggcagatctggactaaagcattggtttcttccttcctggcttggtgctgttgtcctccaacaatcaagtcacatcagtactgttcatttggatgtttgtcgatacactctactacatgatcctctgctttttgtgtgtgaaaacttagcctcctgaaaagagccatcagcttcttgaggacatagctcagtttcaaaatgcagctcaaatccctgcttctccatgaagctttggagcctaccagaatgttttttctcttcctctatcctcctctacacttaattactacactattttttttcccttcagtattatttgagaatttaccagatgccatgcgtgaacatttcctctgttctcccatcgaacacccagtctctggtagattctgctttccacattgtctcttgcttccagcccctttactccttacacactgctactcttggccattcttttctccacctggactattctagagtcccctaattggtttcctgtcactccatcgttgctttcccctgaccaatctagattactcttcctgacaactcctgctatgtcattctcatgtcaagcagcttctttgccaccccctcagccaacctatctacaaatgtctcagcctggcattcaaggctcaatctttattcaccagttgtatcacccactcttgccctcatgtaaccaatacactagacttgcaccgtctcatatggcagccattagccatatgtggccactgggcagttgaaatataggccagtctgaattgagatgagctgtaagtataaaatgcataccaggttttgaagacttggtaagaaaaaagaatgtaaaatatctcagtaatttttgtattgataacatattgaaatgagaatattttatacatactagactaaattaaatgttttattcaagttaatttcacattttgaaaactttttaaatgtgggcactagaaaattgaaaattactcgtgtgactcacattatgtttctactgaacagcacctccctaggcaaatcaaactatttgtacttcctgaacttgactcacactttcctgatgtcattcatggttcctactgtttggcacatctcccttctctgctggtcaaattctaccctggattaaaggtccatctcagaatgcaaatcaaaaccacaatgagataccatctcataccagttagaatggcgatcattaaaaagtcaggaaacaacagatgctggagaggatgtggagaaataggaacacttttacactgttggtgggactgtgaactagttcaaccattgtggaagtcagtgtggcgattcctcagggatctagaactagaaataccatttgagccagccatcccattactgggtatatacccaaaggattataaaacatgctgctataaagacacatgcacacgtgtatttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggacatggataaagctggaaagcatcattctcagcaaactatcacaaggacaaaaaaccaaacactgcatgttctcgctcataggtgggaattgaacaatgagaacacatggacacaggaaggggaacatcacacactggggcctgttgtggggtggggggagtggggagggatagcattaggagatatacctaatgttaaatgacgagttaatgggcacagcacaccaacatggcacatgtatacatatgtaacaaacctgcatgttgtgtacatgtaccctaaaacttaaagtataattaaaaaaaaaggtccgacaatttgagaaagatggccgaataggaacagctccagtctacagctcccagcgtgagcaacgcagaagatgggtgatttctgcatttccatctgaggtaccaggttcatctcactagggagtgccagacagtgggcgcaggtcagtgggtgcgtgcaccatgcgcgagctgaagcagggcgaggcatcacctcactcgggaagcgcgaggggtcagggagttccctttcctagtcaaagaaaggggtgacagatggcacctggaaaatcgggtcactcccacccgaatactgctcttttccaatgggcttaaaaaacggtgcacgaggagattatatcccgcacctggctcggagggtcttacgcccatggagtctcacttgttgctagcacagcagtctgagatcaaactgcaaggtggcagcgaggctgggggaggggcgcctgccattgcccaggcttgcttaggtaaacaaagcagccaggaagctcgaactgggtggagcccaccacagctcaagaaggcctgcctgcctctgtaggctccacctctgggggcagggcacagacaaacaaaaagacagcagtaacctctgcagacttaaatgtccctgtctgacagctttgaagagagcagtggttctcacagcacgcagctggagatctgagaacaggcagactgcctcctcaagtgggtccctgacccctgacccctgagcagcctaactgggaggcaccccccagtaggggcagactgacacctcacatggccgggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactcaaaaaagcagagtgcctctcctcctccaaaggaacgcagtttctcaccagcaacggaacaaagctgacagagaatgactttgacgagctgagagaagaaggcttcagacaatcaaattactccgagctacgggaggacattcaaaccaaaggcaaagaagttgaaaactttgaaaaaaatttagaagaatgtataactagaataaccgatacagagaagtgcttaaaagagctgatggagctgaaaaccaaggctcgagaactacatgaagaatgcagaagcctcaggagctgatgcgatcaactggaagaaagggtatcagcgatggaagatgaaatgaatgaaatgaagtgagaagggaagtttagagaaaaaagaataaaaagaaacgagcaaagcctccaagaaatatgggactatgtgaaaagaccaaatctacgtctgattggtgtacctgaaagtgacggggagaatggaaccaagttggaaaacactctgcaggttattatccaggagaacttccccagtcgagcaaggcaggccaacattcagattcaggaaatacagagaatgccacaaagatactcctcgagaagagcaactccaagacacataattgtcagattcaccaaagttgaaatgaaagaaaaaatgttaaggacagccagagagaaaggtcaggttaccctcaaagggaagcccatcagactaacagcagatctctcggcagaaactctacaagccagaagagagtgggggccaatattccacattcttaaagaaaagaattttcaacccagaatttcatatccagccaaactaagcttcttaagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactgaggagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatgtcacgtgcagagacacacataggttcaaaataaatggatggaggaagatctaccaagccaatggaaaacaaaaaaaggcaggggttgccatcctagtctctgataaaacagactttaaaccaacaaagatcaaaagagacaaaaaaggccattacataatggtaaagggatcaattcaacaagaagagctaactatcctaaatatatatggacccaatacaggagcacccagattcataaagcaagtcctgagtgacctacaaagagacttagactcccacacattaataatgggagactttaacaccccactgtcaacattagacagatcaatgagacagaaagtcagcaaggatgcccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccgcagtgcaatcaaactagaactcaggattaagaatctcactcaaaaccgctcaactacatggaaactgaacaacctgctcctgaatgactactgggtacataacaaaatgaaggcagaaataaagatgttctttgaaaccaacgagaacaaagacacaacataccagaatctctgggacgcattcaaagcagtgtgtagagggaaatttttagcactaaatgcccacaagagacagcaggaaagatccaaaattgacaccctaacatcacaattaaaagaactagaaaagcaagagcaaacacattcaaaagctagcagaaggcaagaaataactaaaatcagagcagaactgaaggacatagagacacaaaaaacccttcaaaaaattaatgaatccaggagctggttttttgaaaggatcaacaaaattgataaactgctagcaagactaataaagaaaaaaagagagaagaatccaatagatgcaataaaaaatgataaaggggatatcaccaccgatcccacagaaatacaaactaccatcagagaatactacaaacacctctatgcaaataaactagaaaatctagaagaaatggataaattccttgacacatacacttttccaagactaaaccaggaagaagctgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaagagagaattttagaccaatatccttgatgaacattgatacaaaaatcctcaataaaatgctggcaaaccgaatccagcagcacatcaaaaagcttatccaccatgatcaagtgggcttcatccctgggatgcaaggctggttcaacacatgcaaatcaataaatgtaatccagcatataaacagaaccaaagacaaaaaccacatgattatctcaatagatgcagaaaaggactttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaatactggcacaagacagggatgccctctctcaccactcctattcaacatagtggtggaagttctggccagggcaattaggcaggagaaggaaataaagggtattcaattaggaaaagaggaagtcaaattgtccctgtttgcagacgacgtgattgtatatctagaaaaccccattgtctcaggccaaaatctccttaagctgataagcaacttcagcaaagtctcaggatacaaaatcaacgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaactgagccctcagaaataacaccgcatatctacaactatctgatctttgacaaacctgacaaaaacaagaaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacccaggcattaccattcaggacataggcatgggcaaggacttcatgtctaaaacaccaaaagcaatggcaacaaaagccaaaattgacaaatgggatccaattaaactaaagagcttctgcacagcaaaagaaactaccatcagagggaacaggcaacctacaaaatgggagaaaattttcacaacctactcatctgacaaagggctaatatccacaatctacaatgaactcaaacaaatttacaagaaaaaaacaaacaaccccatcaaaaagtgggcgaaggacatgaacagacacttctcaaaagaagacatttatgcagccaaaaaacacatgaaaaagtgctcaccatcactggccatcagagaaatgcaaatcaaaaccacaatgagataccatctcacaccagttagaatggcgatcattaaaaagtcaggaaacgacagatgctggagaggatgtggagaaataggaacacttttacactgttggtgggactgtaaactagttcaaccattgtggaagtcagtgtggcgattcctcagggatctagaattagaaataccatttgacctagccatcccattactgggtatatacccaaaggactataaatcatgccgctataaagacacatgcacacatatgtttattgtggcattattcacaatagcaaagacttggaaccaagccaaatgtccaacaatgatagactggattaagaaaatgtggcatatatacaacatggaataccatacagccataaaaaataatgagttcacgtcctttgtagggacatggatgaaattggaaatcatcattctcagtaaactatcgcaagaacaaaaaaccaaacaccgcatattctcactcataggtgggaattgaacagtgagaacacatggacacaggaaggggaacatcacactctggggactgttgtggggtggggggaggggggagggatagcgttgggagatatacctaatgctagatgacgagttagtgggtgcagcgcaccagcatggcacatgtatacatatgtaactaacctgcatgttgtgcacatgtaccctaaaacttaaagtataataataataaataaataaaaaattaaaaattaaaagaaaaaaaaaaggtccgtctcaggtactacatactctatggaaagggttttcatcaccagtggcacttgctttctctcttgaagtcccatagtgtggtagttaagagcgcacactctggagccagcctgggttcaaatcaaaatttcatttcacatctataaagtgtgtataatctaaaaaatctatgtttacataatactaatatagcatgcagtacaatatgaagactcaataagtatttttattaataattcacagctgcttactgtgaaagatttaggccacctaggctacattttatgacatctctatttccttggcagggggtaggggtggataggttccatacttaggaattgattcttctgtttgtcatgggtcagtcacttttaagtctatagcatgcctatggcttattcctaaatcttgactttcctctgattaggacaactgagagggagaataaatactctcaattggtatctttcttttgggctcagatatctcttttaggactcttctgatagcctttttaagaagtgataaagaacaaccttcaattaaatatttcaactctagagagccactctgcagattttgcatttgagcattgattgttttaatgatcagtcagttgaaactttcccattggaaaatgcaatttgagtgactctcctctaagacagccattccgcagcacccaagatggtgtgaggagtttatgtcttatcatgtgaaccaagatgttaagaagattcctggataatggatttttcatgtcatttgtgcaacaagtaaattaaaaatataaagcctcagaggaaaatggtaagtatatctaagcccttactcaaaacccatttaacattttctaaagaaacaaagcaaaataacccaatctctatctccttaaactagaatttgtctagcaataatataacatgacaagaataactctggtaaataaaactacatgttgggttctccctggggaatgtctgcctcacctgtaatgatttcttgaaaatatttttcagaagctgagaatattatgttgccaaggcagtgacattgcagatatgcttcaggaagctctttcattaaaagcgcctctttcccaacacttaaaaactttttttaaagtaactgtgtaaaagttggttgcaactgatatactacatacttttatttattattattttttcttttacttttttttttctttttatgaggcagtctcgctctgttgcagaggctggagggcagtggtgcgatctcggttcactgcaacctctgtctcctggttcaagggattctcctgcctcagcctcccaagtagctgggactacaggcaagcaccaccatgcctggctaattttttggtattttttagtagagacaaggtttcaccatgttggccaggctggtctcaaactcctgacctcaagtgatccacctacctcagcctccagaagtgctgggattacaggcgtgagccactgtgcctgagaatgggtttgaagtgcctgaaattactggcctgtgtgccttcactttttactaacttatcccctctggtagcaaccattatgaggttgcctgtatcaaaaatgcgcccttctctggaagtacctcagaactcgccacattatggtggaagaatcttgctgactgagcagatcgattctatgctgggtgtgcttgggtcagtcagattctctttttgggaattggaaatttataaaagagggacagagaggagtcgtttttggaaccgactccttgtaaatctaggggaaagctccctgagcagcttttgctaagatgccagatattctccttacatcttcacagcatacttctaccttcttatccttctattaagttaatctcttatgattaaaatggtcagaattgatttctggtgcttgcaaatgaaaaaagacttacccagagccccacccaaggtttccaggttgaagtaatccactattctatggacagtccataacacagggcatatgttgttgctcagtgagaggaccgaaggctttgaatagcgattcctcagtggtctctctaagctggccagaactgagcttaggggataaccatgctagtccagctgcctctatagagaatgagccttaaaacactcagaggaagttcaaatgacacttcctctgaggcctctttgttactctggctagaagagatgattccctgctctgaactcctatcttgtttataacctttatctagcatttatcacattctccatttccctgtagtcatttgagaagaggatacctcttctacatctggaagactataagctcctggagggcagagatggtatctttggatcctgcatgctatcttgtacatttcagtacgtatttcctgagtggccaacaagtctcacctgaaggctttctgtgtgtccagtctgaggcttagggatggggaaaggggggaggaaaagatccagaatgggcttggatgctttagctgggcagacaggaccaaaaacagccaataatcaggtattaggaggtatgtgtcaggggcagctaagtttgggctgaaaaggccagaaattagactcaaggcaataatgagctctgctgttttgggattctaacttattcactttccaggttgagaaggcctagtgggtcattttctctaattaacacctcccaggaacaaaactgttccatcaggcttgccccttggatgatagatatttactgttcaacctcacatatgggctgtgggttttttagtcttctctgcatcatcagattattacaataataccttgtagctatgtgaaaactttatttccatacttttggctttttttggtctcatttatcttcactatatctggtcccactcagggacaggaatcatcatgtcccttttacagacagcaaagagatttcatcattgagccaatacctacagtgcaaattagaaaaaggggacctggtgctagaacccagttctgcccagtctgtcctgttgatcagtttgaataatttggggactgcattggaccctaccctgtcacaccacagcatcctcacctctgtgggctcagaaatgctgtctgctgctactcatgaggtgcaattaggaacccaggagtagcgtaacctcattacatcagagtcaaggacaagtgtaacagcagcaaggaattaaatcttcattctgaaagttgagttttgtttataaattgtacttttctgaatttggctgaggtggcattaaggaactgaggttcagggccacatagagagcagctgtgagtggtttgccaggaggtggtgtcatcttccagtgaggcagaagctgggagtacatgaggaccctgtggagaagcagctagaagctgcccaccaagtcagaaagcccacctgcctggtgggagggattattttaattcctttcataagaaaaaaagctgggtgggaatttgctaaaatctgcattaaatatgatttttctgcagccaaggggagctgctggaacaaagcacatatgctcccatggagccagccctctcagctgtggaagtgagcagcagggcttctcttcaccactgtgactcaactggctttaaaacctcaagtataagatcagaattacacatggccaagacaacatttggtgtagccactctgggagattatattttggaaagagacctttgttgcctcatttcaagacatgaaaagaagccaactgaggggcttaggaagaagatagaggtgggcaaaagagcagaactggagccctgaattaatctgatttactgcttttgaaattaaaaaaaaaaaaaaaaaagaagaaaaacccaaggaattactactctccaaggagggagctgggtccaatgccaaagagatctgtgtgtgaaccttttggctctacacttgcgttgagattttgggaactctgttgcttgttttttagtgtcttgctaggggctatcattcactttccccagcagagtgatttttaaacaaataaaatctagtccttcctgagcttctcccgaggagtctgtgtatcagcaaggtcaggtttaagagttgccttgaggcatggctgggagagctgagtcagaactaaggttccagattaacctcaaccttgggcctttgtttctttaggggtggttgtggtggtggtgagggtaggctagggaggtgggacataaactttcttaattctgagattttttggctggcccagatttaggaaagctgagggtagggccaagctgtcttgcttgcaagagtgtggtagtcttctttctgtctgtggattctttcctgggggctgttaccttgtgtgctacaccaggaggccatctgtctcaattcaggctgccttggtggtttttgtttgctttcagtttgtttttattaaggaatcttgggctggggattgattcttccctactgagtctaaaaaaataaaatgaaaacaatctagatggaatatactgatataggtaagcttcaggtcttgcttccctgaagttgatatgtctgctatttcccattcaaatgatagactggaagcctacaaattctgttataggacctggatgctgacataacacaaataactcccttcagaacctatagcattttctcacttccccattttctaaaacagagatttaaaaaatgacatttagctgtaatacatgctagctgatgtagacatgcttcttttctgcatgagttaattgttcctattcagctatctcagtttaatcatgaaactcagtaacactttaattatactacatgtgaaattctgggaaccctgagttgaatgacatttcttcaggtggttcttactctagcacaatgattcaaaaccaaggggtggggaggaatttccccctgccccctccgggggtcatttgccaaatgtctagagatacttttggttgtcacaatttgggaaggcagcgctcctggccagggatgctggaaaacattctacaaggttcaaaacagctcccataacaaagaattatctggccccaattgtcaattgtcaatattgctaagatttagaaacctgctctggcagaagaggcacatgttgaacaaatggctgcattatggtgagatatgtacaaaaatatatgtaagcccaggatattgaagtgagtatgtggatggggaagatggaggtggagtgggggtggggcagtgggcatcagggaaggcttcatggggaagtgactcctaatcatggtttttacttaatgcctttgcaaccaatcatcaaataatggctttaattgaaagcttattagtcaataactacatattgggatttttttttctttttgcacaacgtctgagtaatcaaagctctctaataactttatgtcttctcttaagaaatatttcccccccagcctgggaagaatttattcaaccttcttccttgcttctcagcaacgaatctctagttgattttaacctgtggttcttccaccaggacccctctttccttcttcacagttcagcttcttaacacttggcccatgaagccttcccttggagacttcagttcatagtgattaattcattctgtgaattccttagagccttgttgtctttctctctacacctataccagtctcttgggggtgtgtttccacttacattgtgggcttctcaaagacactacggcactgaacactgttttggaccctgatttacactgcaagtgagaggaagaggaagacactcaagaaaggtgtcaggaaagagtaatgctggatcgatatgaacattgcattaggttggtgcaaaagtaatcatggtttttgccattgaaagtaatggcaattacttttgtaccaagccaatatcttgccaaggcctctggattatgtcttcaacaaaatctaaaagtttaatttctgttcagtaggtacaacatgcaaaaaataaattgccataattattattagcattttcttactaacagatttttcaaaagctgtttccatatcaagcagatcaacctttctgttgtcatagagacaaagatctttatatagccatgggcaaggtgagatttttttctcctctttccagttgcctagaactaataagaaaggaaaggaaattttttaaatcagttttttctttcattttttccccaattaaagtgagtgaaatgtgggaggttatattttgtatcacattttagattttaaatacctatgtttttcataaaatatgaaaggggaggaaaaatttgaacgatgccattttcaaaatttgtaagcagcaggcttgtcagtgataagcagctataatccatgtaccttgttttttttcttcttcttaaaccaaatagtgaactttggatggaggtcttagaaggtaaggttactaggaccccaaatgactaaagcataaattaacatctattgagggactaatgctgaatcctaaggtgctctgcagtacttgcctcctccaaccctgagaacttggagtgctccccttctctctgcagaggcaaagtctatgataatgtagtgcaagaccacatcctctcctcctggaagacttacctcataatttaagctttctttttttttttttttatgaactgataacttgccatcatagcagttttctgtctcataattactgtttatcatttcatgcattcatcatcaagaaaagaggatttcagtatgaacctgtccacttttcctgtcctttgtcttaatattgagttattcctttacccataggtcttcttacctcaggactcaaaacttcttattctttctaaggttaatctttcccccatgttgttagactgatgctctcctcctacccccattgagatctgacaattaacattcctccctcattccctgtatcttcagtctgtcctccatggattccttcctgcagtcctctttgaggaaaaaaaaaacttccctcaattctgcttattttccgtctgcctctgggtttaggattttgattttatgcctttttgcaataaataggtgttatgccggattttggcgggggggggggggggtggggaagggaagtgtatggcacaaggacttttaaaatatactttttcctctctaagatgatacctccctggagagctgtgccttggttctcaaactttagtatgcatcagaatcacctgaggagcttgttaatctgtagcctgctggaccccacccctggagtttctgattcagtaggttggggctgaggcctgagaatatgcagtctaacatttcccaggtgatgttcatactgctgagctaagaccatactttgagaaatattgccttgaagtaacaaccctccctttgcttaacatgcacctctcttgtcatatggatgttggtgtcactatgttgtgccaaaagttaccctgttttggcctgcataggctcaacctccacagagtgacaagggcatctcttgaaagatgagggcatctctcaaccatctggtgctcaggaaatgaaaccttgtgagggtcaccacgcttggctaaggaggctaaatgactggcagaggatgttcctggtggtggatgctcagggtctctacccccaaacctagtcagccctatcagatatttttgaggggttctaggattcttgaaaccctgctgaaaggcagcaggagaaagtgggatttttaaaaaaaatttacttcagccttttccagggaagggggtcccctcctgagaacagcacgtggcagcaggagcccttgagagatcttactgaaaagctgaattgaaaaggaactgggacttggcccacccattcatgcccccagtgggagttctttgctcagtactaattttggagaaactgagtgtgtgtgtgtgtgtgtgtgtgttttattaagaaagcagtagtttttcttacaaagatgagcaaatttaaaaagataattaatagataaaatcctgaattgctattcaatagctgtgagaccttgagcaagttattccttctccttggatctcagtttcttctaatctgtatgataagtagcaggcaagtgagaaagtctgttagtagtacagtcattcttaagagcaacatggcatgcttgtcagggacggaccagggctggaacttggaaggcctgttgcatggatttgtggattgattgaaacaaattctatcagcatggtccattccttcagggaatggacctgacaagataattaatggaaactaattaatataaacccctcaaccctttaactgtatctctcaaccacaattattcccagaaggcctttaacttttccacatgaagaagcctggcctggcagggagggtgagtctcctctatgaaacagcccgtgacagactgttgggggctcaaaggaaatggcagagggggtggtctccttccttccccagcacagaattccatcatctctaattgttaggacatgatcaagacctctaccagccttttagatactcttgtcttttgtctttttttccctttcttttctttccttttctcttttcacagctgtattgagatgtaaatcctacactatagaatttaaagtggacaatgcaattgtttttaatatgttcacacgcaactgtctctacaatctaattttacaaaaatttcaccacccccccgccccaagcccatacccactgattagtagtcacctactgtccctcccatccgcttccccagccctggtaactactaatctactttcagtttatctggacatttcatgtaaatagtattataaaatatgtggtacttttttttctaaataggagaaaggagacctgatgacaccctgatagtctagtactaaaggctccccttctcctctttaccccattactccagaaacaacgccctcccccaggttgctgatgtatacaatccctcaatcaggcctgtgagtgtggaggtggtgcgcgggtgccagcggcagggcacagggcctttggtccattagaccatgagactgaagttcaagcacatctgggcacggtggagcagcggcttgtgtgctcactaagatgcccgtgtgactgccagcagtcagttgacagattaggtcacccttggccatagggcctgagcactccattcctagaggaccacagggtgccagagctcacattcaccttccctgacgtggctggcccaaggctcaaaggcctgtaagacttctctggcagagacccctgccagaggagttgaggagcgtcacacccatattcccttcaagcagcggcagagagcaggccttcccctgaggttcctgaatagttctactcccccggccacagccccaaccaggggtaaagaatggggctggggctctcagaggcatggggtggtaaaaacaaccaccaagttttgggttctcatcaccctaaaacgtgggggaaatttgatagggcaaagcgtttttctccaagcttccagggaaagggggccaaaggagtagggagggaaggtggcatagagcgatggagggtcctgcatcaagggcgccgcgacgggagcgctgtgtactcacagtcgagtgagaccggccgtggggccggggcagcgcagggcgccgtcgggcacgcagttgcagggctcagggcagagcgcctcgcgcagcgctcgtggcagcggcggctgcagcagcagcagcagcttcagcagctgcagcgccgagaaccgctgcttcatggccggcgaactgggcttctgcggcttgccagtgtcttggacggcctctgagtgcggcccgcacccctctccccgccccttggctgcccttccacacacccttccctgccggcccgcccctgccctccccctcttaccgcgcaccccgctgagtctgctctgccttgacctgcgacagtgcccagtgacccaataacctccttcctgctactttcccctgtcttgtcccctaccatctgcaaatggccctagctataggaggtaaagagatttaatggcaaatgttttggattagaggtggggagttctgaattgagtgagttgtgacgcttcccggaaccccttttatttcatttgtgaaagggtccgatggatactcgctatacccacatcagaaggcgtaagagtgcctggctcagacatttttcctctcttttatcctcaacccctaatcctttccccttctctttcaccaaatccctccactctacaagtaatctttgcccatcctcccaactaccccagtaatttctcttggtggtaaatgctttcttatttatggtatagctatttggcttggtcctgtatctcttctatagattgggaggtccttgagagcaaaatccaattcagatttatttttgtattccttctggcttctacatggtaagtcctcagtaaagatttgttgaatgaatgaatgaaactgcctaatactggtagcagctgccccatagaaggcccaggataggctagaccttgtaacaggtgctctgcctcacatcatgtttaagctccacattgaactagcagggtgtttgcgatgagaaaaatgtcccaagaggtatgtggcttccctgaagtcacacggttttaaagtagtgaaacctggaactcatgtctatcacctaccacctctcaccaatgcaaaaagctgctatgatctacataccaaagaacttaggagacaaaattttacggtaatcatggggatccataatatcccctctttgatttgatcatttcttccttccaaggattctgtttggattctggaaatcctagcagttttgctggaagaggtggactttgaaagctgggaaggcatttaaggctttgaagagaggaaatataagaatagatttctttcactctgaagccagttctcaaggatgggctccttcattcaccattctacagtctgttgctcaaggagggtagattattattattttaaaaacttgtttggctttggccacattgtgctagatggcacaaaaacaatgctcatgtctataatattgtcttctctggatcctctcttcaactgcttatagatgactcctcaccctttaatacctctgcatgggctgtccccactattttctcttctttttccattattccattagataaactcccagttgtccttcaagactcagcccaatgtcatttccactttgattcttctctgagtcatcctagttgagtagttgtggccataacacctggttctacagcaggtaatctaacacactgtaattgtgggtttaattttgctttcccctctctattcatctcaatatcaacagagcatgtcatagcttctagctcctagtaggtgttccatatgtgtctgttgaataatagagtgaataagtgaggcccagatttgtagtagatgctcagtaaactatctgagaagagcttgataccctcacttgctttattctcaaccacgctggatctatctggatatgtaaaaagtaattatacatgacgactttgggtgtcatgttctctgttctcttttagttttgtcagattttggtagggaagttggggtaggcactgggatttttaaaagttttcaccatgtatcttgaatggaaggagagaaagaatgaataactcaaggtgcctgaatggcttttctttcaagtctcatgttttatgtgacttttttctttttttaaccctgtagtgtacctgttatatataaaaaaagtttgctcccacccacccctgaatctttgaaaacaatggatattccagaagaatcatttaattctgtactccagtaggaggactaggcaatcagaacactaggattttccttctgtttctgctgtcaatcatgagatttgcccttcagtctcttcatctgtaagaagaagggttgaagttcactatccctaaggctcttctggctctaaagatgcaaggactttctaagcagctcctacagaattgctagtgggaggaattggattgtatatattgacttcttataacttgtcttggattggaaataaaatcctgtttatgaggagttgaggttgttcgtttggaagaaagctaacaactgtaatgagttttcataaaattttactatctagattaatttcagttggatcttaattatcacatcagttcttgcaatgtaactattataataaaatcatattgattcatttgttataatcacaaaagtttgttacaatggaatttacctatcttattcattaatactcattatgagtgagtatttttaaatccaaaggactttgtttcattaactatgcttatagctactttgtcagagaacttcaaaccaacatgacccacaaagattgctgattacattttaatgacaaaataaagttcacagaattcacaaatattttatcctactttagagatagaaaaacatactgacaccgtaactcagaaattgcaattaaaactctccaaagttttagaatggagcttctcatattttagggtgcagaaataccatttgcaaagctttaaatacgaagattcctagaactttccctatgagattctgattccatagatatagagtggggtccaataatctgcattttaacaagctttctcgtgtaattttgatgcatgtagtcctagagcacaatttgaggaatacaaaaatggtaatcctagaattaaatttgcctgaagaaaacaaagctcaagaatctttattaaggactttgagtgaagcctaataattttgatgcatcttaaaagaaaccttgatatgtataagcatagaaatagtatattctgtatacctgtgtttaaatgtctaaaattatttaattggttatattgctgaaatttatttatttatttatggaatgagccatgttgcaaaatcatggaatctattttctttatgccaccctaggtcaaaactcaatagcatctgaagttacattaacacattggagttgaaagacattagcaaagtaatttttaaaaaaatttttactttaagttctgggatacatgtgcagaacgtgcaggtttgttacatggacatacctgggccatggtggtttgctgcacctatcaacccgccatctaggttttaaaccccgcatgcattaggtatttgtcctaatgctctccctccccttgccccccatcccccaacaggccccagtgtgtgatgttcccctccctgtgtccatgtgttttcattgttcaactcccacttatgagtgagaacatgtggtgtttggttttctgttcctgtgttagcttgctgagaatgatggcttccagcttcatccatgtccctgcaaaggacataaactcttttttatggctgcatagtattccatggtgtatatgagccacattttctttatccagtctatcattgatgggcatttgggttggttccaagtctttgctcttgtaaatagtgctgcaataaacatacatgtgcatgtgtctttatagtagaacgattcataatcctttgggtattcccagtaatgggattagcaaagtaatttttaaaaccttaagtagaataggcaaggttttttgattattgaacacataccctgttagtataataactggtatttcttctcacttaaaagcagtggttttacctttcccttggaagaaaaggtgaatgtaggcagaggaagaaaaaattgcttaagaagagaaaaatacagttacatctctgagctgttcacctttttacctggggtaaaaaaactaaacaaaacaaaataaggagaataaaaaagacagtccatgaaagttacactccaaaatttcatgcaaattctttattgcttgtttagaattttcatctccatttcactgtctacataatgtaaaatcagagctgcgatcatctgtgccacctcccacacagccctggggttcttgtgggcctcagcaggagtttgaagctgcaggatgataggaagctgggctggtaattggaatgtgatgattggtctggggcatgagaatcctactctaaggctgatggagagagagagttggagaaggggccttgcctttttggtcatgttgctggaaggatgtgaatgaattaggggctgctgtccttcttgtctcatggaaaaagcctgtttgtgctggcaacaactagaggaaagtagagatgagaaatagatgggggcaagcagtcttgttaatgtcctttgacttcatggaactggtcatgcctgaggccagctctacccttggacttcctaagtaatgagctaacacactcccctcctgcttagtctagttggagttgagtctctctcacttgcaaccaaaattcttcatctctactatcagccttgctgtgaactttatttaacctgccaacttccctcatcccttcccagttaggagagaaatagggcttttctattcttatctctgtcacaggactcattatagtcatagtgaatttttctcctttgcattgacagcctttatcatcgtacttctaggaataaacaagtcaaatgagtgaatgaacaaatgaatgagtgcacaaagaagtagtgtagtagaatcacgttattcctctttgtagagaaactgcattttgttacataatttacctaacatcatttttcttttagggaaggcctcttactgaaaacttggtttagcaattaaacttcaagctaaaatattagacagaggcaacacaaggaaagtgagaaagttttctgaaatgatgatataaatcaacaaagaaacaagatttgattgtttaaaatcagtgtcgaattaattaaagtgtgtgctacagcagctttccccaacctttttggcaccagggactggttttgtggaagacagtttttccacggatggtgtgggtggctggtttcatgttgaaattctttcatctcagatcatcaggcattatgttctcataaggagcatgcaacttagatcccttgcatgtgcagttcatgatgggttcatgctcctatgagaatctaatgccgccgctgatctgacaggaggtagagctcaggcagtaatgcttgtttggccattgctcacctcctgctgtgcagcctgattcctaacaggccaggccctgggggttagggaatccttgtaccacaggatactgtttttctgccaggctaattagcagtatttaggggaaagggaccaaaactcaagaaatttgaggaaaattgggttaaaaaagttaaacaaggttctttactaaagagttttccagaacattttttattttcatttttactttagagttggggtctcactctgtcacccaggctagagtgcagtggcatgatcatacctcattgaagcctcagcctccttagtagctgggaccacacctgactaactttcttagtttttttatttttttgtagagatgagggttttgcttgttgcccttgtgggtcttgaactcctgatctcaagcgaccctcttgccttgacctctgaaagtgttggtattgcaggtgtgagccactgtgactggcctctgagaacttttaacatgcattctggatctccaagagggccacagtatatgcaggagactggtgtttcttttctctttcttttttttttttatactttaagttctggggtacatgtgcagaacgtgcaggtttgttacgcaggtatacacgtgccatggtggtttgctgcacccatcaacccatcatctacattaggtatttctcctaatactatctctccccatgccctccacccccacaaaaggtctgggtgtgtgatgttcccctccctatgtccatgtgttctcattgttcaactcccactaatgagtgagaacatgcagtgtttggttttctgttcttgtgatagtttgctgagaatgatggtttccagcttcgttgatgtccctgcaaaggacatgaactcatccttttttatggctgcctagtattccatggtgtatatgtgtcacattttctttatccagtctatcattgatgggcatttgggttggttctgagtctttgctattgtgaacagtgccacaataaacatatgtgtgcatgtgtctttatagtagcatgatttataatcctttgggtatatacccagtaatggtattgctgggtcaaatgatatttctagttctagaactttgaggaatctccacagtcctccacaatgggtgaactaatttacactcccaccaacaaagtaaaagtgttcctatttctccacaacttctccagcatctgttgtttcttgactttttaatgattgccattctaactggcataagatagtatctcattgtggttttgatttgcatttctctgatgaccagcattttttcatgtttgttggctgcatacatgtcttcttttgagaagtgtctgttcatatcttttgcccactttttgatggggttgtttttttcttgtaaatttgtttacgttctttgtagattctggatattagccctttttcagatggttagattgcaaaaattttctcccattctgtaggttgcctgttcactgtgatgatagtttcttttgctgtgcaaaagctctttagtttaattagattccatttgtcaattttggcttttgttgccgttgcttttagtgttttagtcatgaagtctttgcccatgcctatgtcctggatggtattgcctaggttttcttctagggtttttatgtttttaggtcttacctttaagcctttaatccatcttgagttaatttttgtataaggaagggatccagttttgtaaggaagggatccagtttcagctttccagatagggctagccagttttcccagcaccgtttattaaatagggaatcctttccccattgcttgttttcctcaggtttgtcaaagatcagatggttgtagatgtgtggtgttatttctgaggcctctgttctgttccattggtctatatctctgttttggtaccagtaccatgctgttttggttactgtagccttgtaatatagtttgaagtcaggtagcatgatgcctccagctttgctctttttacttaggattgtcttggctatgcaggctcttttttggttccatataaaatataaagtagtttttccaattctgtgaagaaagtcaatggtagtttgatagaaataacattgaatgtacaaattattttgggcagtatggccattttcacgatattgattcttcctatccataagcatggaatgtttttccatttgtttgtgtcctcttttatttccttgagcagtggtttgtagttctccttgaagaggtccttcacatcccttgtaagttggattcctaggtatttaattctctttgaagaaattgtgagtgggagttcactcatgatttggctctttggttgttattggtgtataggaatgcttgtgatttttgcacagtgattttgtatcctgagactttgctgaagttgcttattagcttaaagggattttgggctgagatgatggggttttctaaatatgcaatgatgtcatctgcaaacagagacaatttgacttcctcttttcctaattgaatactctttatttctttctcttgcctgattgccctggcctgaatttccaatactgtgttgaataggagtggtgagagagggcatccttttcttgtgccggttttcaaagggaatgcttccagtttttgcccattcagtatgatattggctgtgggtttgtcataaatagctcttattattttgagatacattccataaatacctacttattgagagtttttagcatgaaaggcaattttgttgaaggccttttctgcatctattgagataatcatgtggtttttgtcattggttctgtttatgtgatggattacatttattgatttgtatatgttgaaccaggcttacatcccagggatgaaggtgacttgatcatgatgcacaagctttttgatgtgccgctggatttggcttaccagtattttattgaggatttttgcattgatgttcttcagggatattggcctaaaattttatttttttgttgtgtctctgccagattttggtgtcaggatgatgctagccccataaaatgagttagggaggattccctctttttcttttgtttggaatagtttcagaaggaatagtaccatctcgtcttaaaatttggctgtgaatccgtctggtcctgaggtttttttggttgataggctattaattactgcctcaatttcagaacttgttattggtctcttcagggatttggcttcttcctggtctagtcttgggagggtgtatgtgtccaggaatttatccattttttctagattttctagtttatttgcatagaggtgtttatagtattctctgatggtagtttgtatttctgtgggatcggtggtgacatcccttttatcattttttattacatctatttgattcttctctcttttcttctttattagtcttgctagtggtgtatctattttgttgatcttttcaaaaaacaagctgctggattcattgattttttgaagtgtttttgtgtctctatctccttcagttctgctgtgatcttaattttttttcttgtcttctgctagcttttgaatttgtttgctcttgcttctctagttctttccattgtgatggtagggtgtcgattttagatcctttctgctttctcttgtgggcatttagtgctataaatttccctctacacactgctttaaatgtgtcccagagattctggtacattgtatctttgttctcattggtttcaaagaacatctttatttctgccttcattttgttatttgcccagtagtcattcaggagcaggctgttcagtttccatgcagttgtgtggttttgagtgagtttcttaatcctgagttctaatttgattacactgtggtctgagagacagtttgttgtgatttctgttcttttacatttgctgaggagtgttttacttccaattatgtggtcaattttagaataaatgtgatgtggtgctgagaagaatgtatattctgttgatttggggtggagagttctgtagatgtctattaggtctgcttggtccatagctgagttcaagtcctggatatccttggtcattttctgtctcgttgttgtgtctaatattgacagtgaggtgttaaagtctcccactgttactgtgtgggagtctaagtctctttgtaggtctctaagaacttgctttatgaatctgggtgctcctgtattgggtgcatatatgtttaggatagttagctgttcttgttgcattgatccctttaccattatgtgatgcccttctttgtctcttttgatctttgttagtttaaagtctgttttatcagagactaggattgcaacccctgcttttttttttgctttccacttgcttggtaaatcttcctccatccctttattttgagcctatgtgtctctttgcacgtgagatgagtctcatgaatacagcacaccaatgggtcttgattctttatccagtttgccagtctgtgtcttttaattggggcatttagcccatttacatttaaggttaatattgttacgtgtgaatttgattctggtattatgatgctagctggttattatgcccagctagctagttgatgcagtttcttcatagcatcgatggtctttaaaatttggtatgtttttgcagtggctggtactggtttttcctttccatgtttagtgcttccttcaggagctcttgtaaggcaggcctggtggtgacaaaatctctcagcatttgcttgtctgtaaaggattttatttctccacttatgaagcatagtttggctggacatgaaatgctgggttgaaaaatcatttctggctgggcacagtggctcatgcctataatcccagcactttgggaggccaagacaggcagatcacaaggtcaggagatcgagaccatcccaggcaacatggtgaaaccatgtctctactaaaaatacacacagacacacacaaaattagccgggcattgtggcacacacctgtagtcccaggtactagggaggctgaggcaggagaattgcttggacctgggaggcagaggttgcagtgagcaaagatcacaccactgcactccagtctgggctacagagcgagactctgtctcgaacaaaacaaaacaaaaacttattttctttaagaatgttgaatattggcccccactgtcttctggcttgtatggtttctgctgagagatccactgtcagtctgatgggcttctctttgtgggtaacctgacctttctctctggctgcccttaacatttcttccttcgtttcaaccttggtgaatctgacaattatgtgtcttggggttgctgttttcgaggaacatctttgtggtgttctctgtatttcctgaatttgaatgttggcctgccttgctaggttagggaagttcttccggataatatcctgaagagcgatttccaacttggttccattctccccgtccgtttcatgtacaccaatcaaaactagatttggtcttttcacatagtcccatatttcttggagactttgttcatttcttttcagtctttttctctaatattgtcttctcgctttatttccttgagttgatcttcaatctgtgatatcctttcttccgcttgatcaactcagctgttgatacttgtgtgtgtttcacaaagttcttgtgctgtttttcaactctatcagttcatttattttcttctctaagctggttattctagttagcaatttgtctaaccttttttccaggttcttagcttccttgctttgggttagaacatgctcctttagcttggaggagtttgttattacccaccttctgaagcctacttctgtcaattcatcaaactcattctccgtccagttttgttcccttgctggtgaggagttgtggtcctttggagtagaagaggcattctggtttttggaactttcagcttttttgtgctggtttctccccatcttcatggatttatctatctttggtctttgttggtgatattgatcctgttcctttctgtttgttagctttccttctaacagtcaggcccctctgctgcaggtctgctggagtttgctggaggtccactccagaccctgtttgcctgagtatgaccagtggaggctgctgcccaacaaagattgctgcctgttcctacctctggaagcttcgtcccagaggggcacccgccagatgccagccagagctctcctataggaggtatctgtcggcccctactgggaggtgtctcccagtctggatacactgggagtcaggggatcagggacccacttgaggaggcagtctgtcctttatcagaactcgaatgctgtgctgggagaactctgctctctttagatctgtcaggcagggacatttaagactgctgaggctgcacgcacagccacccctcccccagttgctctgtcccagggagctgcagtgggctccgcccggtttgaacttccctgtggctttgtttacactgtgatggtaaaaccacctactcaagcctcagcaatggtggttgcccctccccccaccaagtttgagcatcccaggtcaacctcagactgctatgctagcagcgagaatttcaagccagtggatcttagcttgttgggctccgtaggggtgggacccaccgagccggacactggagagaatctcctggtctgccagttgcgaagaccatgggaaaagcacagaatctgggccagaatgcaccgttcctccctgtacagactttcacgacttcccttggctaggaaagggaaatctcctcaccccttgtgcttcccaggtgaggcaacgccccaccctgcttctgcctgccctctgtgggctgtacccactgtccaaccagtcccagtgagatgaaccatgtacctcagttggaaatgcaggaatcacctgccttctgcattgatcttgttgcgaatggcagaccagagtttttcctattcagccatcttgccagctaccaacctggtgtttctttaagaaacttcaagaatactgacttgggaatacactttgagaaaatgaacttattcacaaattttcaggcacatggattttatggcaaagaaccccttcactgatctggaagccagagctcaccttagtatccatttagcagactaatgtgtgggcctggtgaggacaggaaagatcatccggactcctattcttctcccctccatacctcaatccagatattcaaggtctagaaattccagggttatcaatatattccttgagggcattgccctttccaggctcctttttgaaatgaaaatacaacacagggtgggagcactttgaatcaattgtatcttcatctgaattatttgtttttagaataagtttggaagacctcagggtggtgtgaggatactggatatgtagagcataggaggtgggccctctaaagggaggggaggaatccccataggaagcttccccccatcaaggctgtgccaggaagtagaccctacatacggctttctctcagatgcattcagaacccagagattagggggagtgaaggaaacccatgtttaactcttggcttgctttgagtggatgcaatggccctcttttctcatcctcttcctcagcctgtatagggtcttctttcaggcatgctgagacactgcttgcttggatgccagctctattagagatgcactatccgaaggcctgctgctgataatatctgtcacattgaattatgccttctgggcatgatgtggcatgcagacagagaggccagtcattaccctagggctaataaggcccttatcaaaaggggaatctccttcaaagaatagtttagaaatagcaggcggtactgaattttgcatgtggggctgacagtctgtaagaatactgctcttgttttcaggaaatgagaattctttcggcaaaaggagaagctgatttgcagaagtgctgagcatgcctgagagagatgggagtgatcaagaccaagagtgccatttggatgtgcagagttgaggtgacatctgcctggagagattcaggaggcagctgaaatacactcacgtaaagcaagagaaacactaaaatgggagagacaaatttgggaatcctacatttgtcgttgtcaaagtttaagaatcacttttgagaagttccttaagagatggattgggagggcgcattgggagattctgcttctgtatacttgatgtcaggacaggaaatgtgaatttaaaaagtgtccgaggagacttttatgcagggaggaggggccccaaaggccttctggaaaacacttcttcagattgatagagaaacccatggtgaagaaaaacgggctaaggacagcaccatgggaatgcctgtgcccacaatggggaaaaggaggaatcggaggagccagggaagaagatggagtaggggccatcagagagatatgaggagagtggaacatgcagtgaaatcgaccatccacctaagaaaccatacaaaggacaggcgaaaacaaagtagtttattcctccttgaaattaagacatgaaaattaaaaccctgtgtatgactttactcctaaattagccaagagaaaagtcacttaaaggaagcaccaaatggcagagaaataattataaaacatacactcatgcatttaaaatgatttaagccttttggaaagcaatatggtaattcccatctagagccaggcatatgtgtatatcccacaatccagtgattctagcactgagaactttccaaagaaaataactgaacacagtaaataagccataagaatgaaaacgatcattatagcagtatctatatgataaatttgagataccctgaatactcagcaacattacagtgatataaagacattatgattcacttaatgaagtatgcaataatttaaaatgacaatttggctaatttagagatatagaaaaagttgtatattgaaaaacttagaatacaaagtaaaacttatattgtaaatacaaaaatgtaagtatgttttttgagaaaaaaaggaaagtaattttgtgtcccaattttgtacctttaagtcagttaagtatgtgtaccatttacctggtagcctataaagcaagccatggataccaactggtattcttggcagttataaggtgctcagatagccaaaatagctgtgtaaatatcctaaatcccatcctttccttattgagttggtttccaactcttctttccaactcttctctctttgtctggtttaggatgctgcctatgactctgtactttatactagcatctgttctttcacacttcttttacatgcttctcagattgcttggaccagctctcccagtttcagataatctcagctattgaagcccactctaacagccctgtaataaaagtacttgtgtttaagtttttacttacgaaaaattacattaaagcaatgttcatggtaaaactagccaaatggcttttaaaagctaatattgtcaggtgtggtggctcacacctgtaatcccagcactttgagaggctgaggcaggaggattgcttgagcccaggagtttgagactagcctgggcaacacagggacaccacatctctataaaacattaaaaaattagcttggcctggtggcataagcctgtgttcccaactacttgggaggctgaggtgggagggtcatctgagctggggagatcaagtctgtagtgaaccatgatcatgccactgcactccagcctgggtgacagagtgagaccctgtcttaaaaaaaaaaaaagctaatagtgaaaaatataatacttgcctgcacagtttctgtagatcagaagtttggtgaagcttagctggtggaggatgggcaaggatctggtggtttaacctctctgtatacagactttcaattaatagatctgtttttagctccacactatacccctaccttactgcaataacttgagtctccaagacctgagactttctgctaatccagttcaatgcttatcagatcctacagattctttctgtagggctttcagggtatcctgctacgttgactactgctcatccatctgcgtgccttccaaatatttgttaagatctttcacctacagttgtgcattagttcaggtccttcaagaggcagataccaagacgatattaaatgtacaaggattttgttagggaactgcctctgtgcgagaaaatggtggtgtggggggagccagaaaagacttggaaagtgtcagactgaaatgagaatgaaggagagaagaaaggaatgctgagtggtaatgtcctagaccacagtgcagtctgaggaaagttcaacaaggctgacaagagtatttgagtcaaagctggctgttggaccctgggaatggacctgcctgaatttccctagcatactcattgagtaatgattagctgggagctgccctggggaagcatggcttgggtcaagatcagctgtggatgtagcaggatttcagagcccagcagtggggatccttggtcaattccactcccatggataggggcatgagtagtctcatggcaaccaaagattgtttttttctccctttatcttttgggtgtgttccttttatttgggggaggctatattctttaaagaaaaatattttagtggtgtttaggaaaggaagggaaataaatggttacatttcaacgttcgttttcaaaataaattaaaataataaatatttaaattaattaattcatttactagataaattaaatgtttaataactacttaaataattatttatttaaaataattttcctccaacatttctgtaatatgtttatactttttgaaaaagtttaaaagaagagaaggtaatcagaagtgtcaggcagaaagtcgggggaagatggaggctgagaaagcttgtgtgactagctaattaggaggttggttattggtgaacttattgctgattccactgttatggggtgaaagccagcttgaaagagactgagtagatataaaagagtaagtaggtatagagcagtctgccaagaagtctggtagtaaagggagaacaaggaagacagcattaacttaggggtgtgcttagtactttgaaacatatttcaaaggaaagggtctttttttttaggctaagaagttcctaacagttttattagtggacataaaaaagagccagaatggaggaaaagattgaatatgcaaacaagaaaggacatgattgtaagaacgcggcctaagaggaggcagaagaggaaacggggtcacgaatgcatgcggagagctagttcaaaaagcaggagggccatctctccttcaaacgtaggagaaatgagatgcagacctaaagatgcctcagtggtgtatcaggatatctcttagctgcatgaagcaggaaattgactattgtggcttaaataagtagaggtctaggaggtaggcagtctagcattgatataatggcaataagatactgccaaggattcaagatgcttccatcttttcattctatcatgttccatgaaggaatgaatgaatgagcaaaataatggaagggaactatcatacttccattgagacttttttcctttcagtgaaaaacaatgtgaatgatcaaactgtagcaagttggttaaataatctagcatgttaacaatttgaagatcacattgcttttttaaaatatgtgtatgaagtagggatgtgaaaaaatatagattatgtgatattgagtgaaatagaaccttaaaataatatgggcatgtttattgcaattataaaaaatttgtatcttacaatattaaggcaaggaggaccattgtatcttgattctcatttagcttttgtgttaaggagggttggatttttttcttttttcatttattctgtttatagttcactataaagttgttaaaatatataattacaaaatttaaaagcccatatggaactttctttgagctcatctagaagaaagacactcctaaatgcaagcatggccatcaaaatatcattgcattgtacacacacacacacacacacacacacacacacacatacacggatagtcactacattctgataactaactaacttccaactgtaatattggtgtggttcatgaaggcccctttgccaaatatctctctacctccttcacaggcctgagattctttttctggggagcaatgttttctttgtttgaggagaggcatcatgatcttctcactacatgtaaatgattatgtctttctaaatggagagtgttaatatctctgaaggacaaagggtgcaggaaggagtggctgggtacacttgaaatgtagccccttcttactcatgccaaagttgaatctagattctcaattcaaatgatcttccatccctcacttctgaatgatctcccttccttttattggtgcaaggaattacggggctgggcatggtcttctgtttaccctcctaccctccatcagtgactttaaatcattccaatgaagtaagtatctcctatttttaagcactagaagaggatgttcttcaatatccctcaatcatacattcttttttctgacaaaactcaccctagaaatacttctttaagccaaacttcctaaattccttacttgcagtgttacagcttgtttcttgttggattgccgtccgagattaagaattcttaatcacatcccttcagaacttttatctggaagatctaacatggtgagggattatctgaccctcctttactggtgaggctcagaagtctaacagtgtgctcagacacctagtaactcagaggctgatggatactccttgtaggttttagtttccacatctgaaaaatgaggagagcaatatctaccccctcctcctcacatggactttgtaaaaaccctgtaagataatgtgactaaaagtactctgggaaatataaacaaattcaagttattatttaaatacttctctcttttcctttgagttttgctttgctgcagtttcatcctccttttctacagcactggctttgctgtagaagaggaatggcatggcatgctgtcagaagccacacagccctccagcaccctccctctgcatctagcttgcagctctgttccatcctcagcattaatttttaggtttgaatggatatcctggcttacatgaactcaggttactctcttccttaacctcctggtaacctgctaaatccctgcagacacattgttctcaattgggggcatttctctctccttttctactgacaaggggatatttggcagtatctggagtcatctttggtcatcactgctggtgggtagtgctactggcatgtggtgggtagagtcagggatgctgccaaacatcctaagatgcataggacagctcgcttcccacaacaaagaattatctggtctaaaatgtcagtagtgctgtggttgagaagttctgctatagataaaattcaatgaaatacatattcttctcccttccccttccttccttccttccttccttccttccttccttccttccttccttccttccttccttccctccttccttccttccttctttccctcttccttctttcttcttcctttcctttcttttcctttccattcctttttactttctttcaacagctatatcagatataaaggtataattggtatacaatgacctgtacatacttaaagtgtacagtttgatgatttttgacatctctacatgtaaaaccatcaccataatcaagaaaatgaatctatccatcactcccaaaagattcctcctgcccttttgtaattctgccctccttgggccacccatctcagcttcccagccccaatcaaccactgatttgctttctctcacttgagattagtttgcatagtctagaattttatataatttgaatcatacattatgcactttttttctggcttctttcactcagcataattattttaagatttatctatgtcattgctgaactacttattcttgaggaaagataagctgatggttaagaacaaagggttatgactcctgggtttttgggtcattaatagacactcttttgatgattttacttcttggatggatgcctcacttagctgttccttcccctgcccccacaatcaattttccttatcacagtctttaatacctggccagtgaactacctcagtggtcttctaataggagacttctgtctctaatttctactccccttaacttataaaacttcattcccttttttttctctcaaacagaatattaaagagctaatctgtgggataccagtttgggaaatggtgccctgacatagctattttgtttttaaaactctgcatttcagacttaatccatgtgcagtatacacacacacacagagaaatgaatcttgagacatcatctctaatcagcacagcttacctggtttttgcctactttggtgctaagaatctttcctggaattatatctagttaaggtatccatatttaataataggaagaattctttaaccaggcactttgaagaccataaaaaatagttaacgataattaaacccacacattattatgagaagtatgtagattttactacattgttagcctagacatacttctatacagcaatgacatatggttttgaagtggaattcttgaataaatctcaagttgctcctttcaagataactgagaaaatcttgattcctaagaaaacagtcctctttatcatctgttccacagttttctttcccatttatcttcgttatataggatatggctcattcttttctcttcccacacagtcttctgtggggttggtcatttctttattttaatgcttatatcacttttcttcagtcagttattggtatttgtatctgcaaatgctccaagttcattttaagcatcaaatataattaatattgctgaggatgttttgctcttctcctggcaacttgttacctggaatgctctcttctgtttgtgataggcattggttgtcttgcctacccagtatcctcttcatttggtaatagtactgtgttcttttttggtgtgggaggacgctatgtcccctctttaatgtgtttagttaacgtagcaagatttctgagagggggcgaatggtgaacctagggaggcctaaccttaggtccctgtgttctcaatggtatatatatcttttttatcagcagggagataccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaattgttttggca

SEQ ID NO: 1778 - DNA, 99024 bp, Homo sapiens
gagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtaaatattcaacaccccaagtttattttcatgggaaatagcttaaatattcttaccttcctccttgggttgaaaccaggtagagacagatggcaatttgtcagctgaggctgtgctttggggtaggagatggaacatttagctaaacagctggtttatttgtttccttttgcacctatttctaccagataagtttaactgttgaacattttttaaatatcatacgaaataccatgctaggctaggaatttgttgtggatggcggcactaagagaaaattcgttgatatccatggttgagattaacgcatcaacttcaaatgttaaaaatatttctaatatagctgagattccctaattaatctctaaagatctgtcatccatgaatatacctgaacttctttgcattctcagctgataccacttcttccttaggtttgctccctgctctttgaaataagactgctttcatttttacccaaattgatttttgttgactgaattcacccatttggtcatctcaacttgtattgtttttgtttttgacatggcatctcactctgtcatccaggctggagtgcagtggcacgatcacggctcactgcagcctccacttcccaggctcaagtgatcttcctgcttcagcctcctcagtacctgggattacagatgcataccatcgtgcctggctaattttttgttttttagtagagacggggtctccctatgttgcccaggctgctcttgaattcctgggctcaagggatcctcccacattggcctcccaaaatgctagcattacaggtgtgagccacctcatctggcctaaactggttgttttagaattaggtggacacacgtgagtgttaaaaattcagttaatttttaaaaattttgcaaataaaaattatctaaaagtcagaacttgaaaagacagttatagtaccacatttattttggagtagtaagtaaatagtagtggacataatataataaagtcaaaaaccaaattttaaaattagagctctttcctattttagttgagggttgttggttttttttttttttcccccctagcagagcactggtcactggtctctggagttaaattggaggtggggttgggggacctgagttgatgcattcatgcatccatcgatccatccatccattgatccaaatcttttttttcttttttttttttttttgagatggagtctcgctttctcacccaggtggagtgcggtggcacaatctcggcttactgcaacctccgcctctcgggttcaagtgattctcctgcctcagcctccggagtagctggaactacaggcgcccaccaccatgcctggctaatttttgtatttcagtagagacagggtttcaccatattggccagggtggtctcaaactcctgactttgtgatcctcccacctcggcctcccatagtgctgggattacaggcttgagccactgtgcccggcccatccatccaaatctttactgagtacttactgtataccaagtgccacatcaagtgctggggataaagataaataaaaatctgatccctgtttccagatggctcacagctgctgtagtccttcagagaaatttaagctcatctaggcccctccaggctgtggacttcagaggaagcatttttctttggggtggccttatggcagtgtttctcaaacctggctatattattattattattattttgagatggagtcttactctgttgctcaggctggagtgcagtgcgatagctcactgcaacctctgcctcccaggttcaagtgattttcctgcctcagcctcccgagtagctgggacgacaggcgtgagccaccacgcctggctagtttttttatttttagtagagacggggttttcccatgttggccagactggtcttgaactcctgacctcaagtgatccacccgccttggcctcccaaagtgttgggattacaggtgtgagccaccatgcctggccaaacctgactatattagaataacttgaaagcttttaaatcatctcaatgtttaggtttcacttcatgctaattaaatcggaatctctggcgggggtgggcggtggggagggagccagattccaagtattttaagatctctccagatacaaggtgtagccagagggaagaacactgctctccaggtgttgtaaagttgtagaaccagaagaacaagccccagactacaattgacttgaggggcagcactgcccgtaccctggaggccatgggaccaccttgtccatgactctctgtttgttggtttaacacctgttgactgatgagagcttgagctatgggcaggatccttcaggtgagagacacaggcctagtgagctgaggagctccaggaccctgtgcagaagggaagttcctacattgtctttcttcctgacaccccatacccttcttcattaatgccaaatttcaccccacagcgttctcaagactcagattaattatgttcagttcccccatactagcaaggatagctcaggcttagggcagagtgaggtggtgatggtgcagcctggtcacagtaaatggtctcaaacagcacattctgatcaactctgctgtgatgggagggaaggtcagtatcttctatgatataatccactgagatgatgtttcctgctttctttttttttctttttttgggatggagtgttgctctgtcacccaggctggagtgcagtggtgcaatcttggctcactgcaaccgctgcctcctgggttcaagcaattctagtggctcaacctcccaagtagctaggattacaggcccgcaccaccacacccggctaacttcttatattttgtgtagagatggggtttcaccatgttggccaggctggtctcgaactcccaacctcaggtgatccacccgcctcggcctcccaaagtgctgggattagaggtttgagccaccgtgcctggcccctgctttcttttataacttggctagagaggcaaattgaaccatttgcatcatcatgccagagaaaccagttttaaggtcttcatacaaggttccaaatggtctattctaaaagttacttgtgctagttttaggttagagggtttaaacaaaatcagagtattagcttttgttttgctcaacaaaaagggaaagagaggcaggcagaaagtcaggcaggctggaatgcctattggaaactcctggatctgcaggtttcccctgaaatctgggtgataaactaactcctgttgttttccgttgatcctagagatggtctcgaggactagaacaaaaggtccaaagcagtttttgcatagacttgaagtggtaattatgcttttgagagagaagcacaataggctcaggctgtgggcttgcccacgtggtgtgagagggacaagagcacaggctccctttgtagtccattcctattgctctacttagagcaggtgctccgggaggccctgaaggaaataagcacttggctaaagcctggccagggtaaccacacttatttttcaaactgagaacccataccaatcatcttttctaattttgggagtgcagacacgtatgaagctttttgtgaaaatgatcctgtttataatactgcatttttttcagagtcattggtgtagttaactgattcaatcaacaagaatttattgagaaggagtctcactcatttactccacaaacatctactaaagttcttctaggtataggttctgtgctgagtgtttaagagatacagacacaaacatgattcctactctaccagaaacttaacagtctagaaggtgagacagactctgaagcagctacccaaatgcactgtggaaaagtgcatagttccaggcttggacaaacatatgcacttagggatcccagaggaaagggtaataaactgcctggggactagggagggcttcgctgaagagctgatggctgggagagtcaatagagtttccatcaaagaaagaaacagcagaaccacaggtgtgtgggtgggggatcttacctaagttttggggctgagggagtggtcggggaagagaccagtgtattaagaccttgtgggccatgctgtggggtgtgaagtttatctgtcaacagggcctcggggttgttttcggcatgactgctacagaatcatatcttgtttcagaaaggctggcatgcagtgcagaggaaagatttaggagtagattatagacacagggaagttgggaggaggtaagggttgctgagcaaaggcagtggcagagagagagaggcaagagatgggtgagcgaattcaggggaggtgcccctaagtgatgacagattctctatgggcatgagggaaagggagggaatgggacaaggtcaggtgctctggctgtggtggataggtgggcaatggtgccattagccgagatagcctgggatcttctcatcactcatccttttaaagtctgtttcccagtcctggccacatgttagcatcattaaagcttcaaacacatacccatatttgggccccatcccctactaatcgggctctatgaagatgaggctcaggtgttgatgtttataaaggctcatgcagccggggttgagaactactgacgtgatcccctaggcagagatcattcctccctgctctgcatatgcctttgtcttccagacctctgttattgctctcccatgagtatttatttatttatttatttatttatgagacggagtctcgctctgccacccaggctggagtgcaatggcaccatcttggctcactgcaacctccacctcctgtgttcaagagatttttctgcctcagcctcccaagtagctgggactacaggtgcgcaccaccacgcctggctaattttcgtgtttttagtagagatggggtttcgccatattggccaggctggtctcaaactcctgacctcgtgacctgcccagtttggcctcccaaagtgctgggattataggcatgagccactgcgtccggcctcccatgagtatttattagcagtggagctcaccaagaacaatgacaagaatggacatttccagggaaactggctggacctgatcttggccttcaggaattcttttgtaaaaccgtcatatcaccaggcccacagaggacaacattttacaggcatttcagtcaattacacagtgataattcactgaacaaatcctttgggatcacagctgctttattgagatcaggtctgtgcacaaagaggaggcccagggaaaacacagtggggctgtgtcaggtggcgtccagagggcatggtgcagctgtgggcctggcttggggcaggacatttctgggattacagggccctgccccaagcttctccgttgagggggtagggagggcaatgcagagagtgagagggtgccagggcaggctataagctaatttgcctcttgagaagtagggtaataataaggttggagcagagaggaaatctttgtcctaaggcagtgcttctcaaacttttgtgggcccaggaatcaccttgttaaaatgtggattttgactgagcaagtgggatctggaatactgtgtttctaacaagtgctgatgtgacgccaatgcatctggcccaaggaatacgcttagaatagcaggatcccagaatgcatctctatttttctatatgacttttagatcagttgtgtatttagagaacataaagtttttaaaaagctctttaaaattttatccttttcaagattgtctcggaaaactttgcattatttgaaaagatacttcgaaaatggaaactgaatgaatagcactggagtgcagtggcgaggtctcagctcactgcaacctctacctcccaggctcaagccatcctcccacctcagcctcccaagtagctgggaccacagcacgtgccatcacacctggttaattttttgtatttttggtagagatgaggttttgccgtgttgctcaggctggtctcgaacttctcagctcaggcaacccacccgccttggccttccgagtgctgggattataggtataagctacctaccgcacctggcaagaacatataaactagtctactatgttctaattataaaacttttttttaaattttttttccttcctgggaatttgagggatcaggattgaccttttttactggggaaatcacctgtgatttctggaaaggtggggagggctgctggtcccttaatgtcccttctaaccagcttgtcaatgcttagtattcctttgacagtgggcaggtctttcattttgcaacaaaggtttgcctgaggcactagctcacagacttcattcatactaaggtgtgaatgacagcagaggagcttaggctttgttggggtgatagagagagaaagagaaaggaagaaagagaaagacagctgaagacaaatgaggatgctggttagccagaggaggtgtatatggtggcacagaattattaaggggaatgagagtggtggaggagcaattaaatatatctacctctaacttcccaatttttcgacttttctctttttttcttctgccctgtcatcagcacgttggttgctctctcctcctccactctgtcatcctcttgctattctttcccttcggccctctaacagttcagtttcaggtgtaaaatattttggttcaggagggactggatatcaactagacctaagattttgtgatttacattccccgtcctaagaaaaggaattatgttgagtgaacaatgaccaaagctggacagttccccctggtggtcagcactgcgacaacacgattttcctctatcttttattcattaattggtgaatttgaaaataatctgttaagccccaaacatgacagacattgtgctaaggacagacatgacacctgtccctgtggggcagaaagtctgaagagggagtgtgttactaaacattgtagagcatttagcattttcaaaagccttaaaaaataagccagaaaacttgaaaggaaaaaggcttttaccatttttaaagaaaagcaggtagaaaggttttgtttctgacattttttgtaccactaagtcttcaatttgggtttagttcttcaattttcatcgtaaaatttccccaaataattttttcttataaagtgtgagtatcaaatcagatcatgtgtagtataatttttaactccgaatgtgtaacattcacagtccctttattagcaaaattatagtaattaaataatactggctttataattgaatagcactttgcaaaataatatgtctggctcatctatattgctatagaatactactgccccagtgctgtatgcatatgaactggttaatcctcacaacagcccttataaggttcaggttatcctcattatccacatttttagatgaagaaactgaggctcagagagataagcaatttgtaaccctagccttaaccactttgccataacaagacagaagaatgcctgcagtaagtgtaaatgaacttactgtatcctcactgcagacagaggactaaaaagagtaatggggtttgcaatctttctgggtgtgtgtgtatgagaatgaagttatcacttgcctccagtgatcaggttgttaagagcacctcagaggccactgttgtcctacccttcctgtaagtggtagagatggctaatgagcatctgttggttaactgattgatgatttctcaaggctttttacagccttagaattctattagtcactctacaagaaacaggttgtatggaacgaaaggtaatttatcttttaagaattaagtgaaatcctttaaactcttgtttttgtgcctaaagctatattctgatggaaatgctctttctctagctatgtcagtggtacagtaatttaatctggttcttgaaattactctttatctcatacatttatttaagtaaagatagccacattagatatggagatgctatgaacaatgcaacagaatcatggaatgtttgtaaagctgctgcagtgattacaatgaaaatattgatcatttccttataacacacacacacacacacacacactatatgacccccatctaaaatctttgaaatatatccagtatctctgggtctggcactgaacctggcctggcatagcacagatgctcaataagtgacaaattgagtgaaaaccaatattagattaaaatattaaaggccaatatgcccatttctactctgtatagctgttccagtcaaagtattttggaaggatgagtgagaattacagtagggaaaaataatttgttccactgaaaaaagaattcttggcctggaacattttctgaaagttaagtttaacttttaaaaatcagaattttaaaataatgcgacttaatttgggctgaagtttatttttgagttatctgtaaatagatggtaaggaaatgaataaattaataattataagatgttactcagtctaagagaaagaggcttgtacaggtcttgagcacattgtagccaaataattatgtttaatataaatattactcatatcttttaattaaggaaaacaattaagtttaagcatattactatattgtttaatataaattaaacattaatattaaaaatattgcttaaaataaatatttagcaaattatattagtataatatagtaattatattgttatatactaatataatttgctaaatatagtaatatttctaattaatattagtaatatttctaattgaaaacatttttaggagttcatctgtgcctgcatatagtaatatattttttatttttatatttttgccattcttattcaaaatagtaatgaagttgtacttgtttttaaagctagtacttaaaaatggcagacagctttccccctagttggtgcaaaattgtagattttcatggtatgttgtttaaatggaatttgcactgctgcagtgctaatgaaattccttattaaggagagagatgagtgccttttatgttcaagagaaatgttcaatggccattaaaatactttgactatttgattttttttccctcgaggtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggtacatcccaaaacttctagaactgtgacctgatttggctttaaatatttgttttgctgtcttttgtgatcgtgtatgtgttgtgtgtgtgtgtatatgtgtggtgagatttgccctagagaggatctcagctatggaaacttgatggccaccattgagcttagttcttcctatccattctggagaatgttgggaacacttaataatttagctctcaatgaaaaacaggacattaaaaatgaatctacattttagaagcatatttataataaaaattatgatgttaggacaccatttctcaaaatatgtgctgcagaacatgtgtcccatataattatccaacaaaagaataagttggggaatgccgtatactaaattaatgttaaataaaggctcccaagaagtcctgcaataaggaaacttgttaaacttagttaacccagtttttcccaactcattggctattgtgtcttgtctttgtgggtatgtgtatgtaaaacacttatccctatcttgtggaatagtgttctgtggagcatgctttaggaaatgctgagttactctattatggtagttttcagtttttttttttttaagacggcatctcactctgtcacccaggctggagtgcagtggcattatcttggctcactgcaacctccgcctcctgggtccaagcgattctcctgcctcagcctctcaagtaactgggattacagccacccaccaccacacccagctattattattattattattattattattattattattctatttttagtagagatggggttttgccatgttggccaggctggtctcaaactcccgaccttaggtaatctgaccctctcggcctccccaagtgctgggattacaggcgtaagccaccatgcctagcctattggtagcttaaagttttattttaaatttttaaatagagatgggatctcactatgttggtcaggctggtctcaaattcctggtctcaagtgatcctcctgcctcggcctcccaaagtgctgggattacaagcgtgagccaccgtatccagcctggtattatggtagttttaaatgtttgccatcagctcttctgcattcttaggcagatgaactaaaggaggacatacacttacatctgtttctaaacttgttttcccttcttatcctcaagtttagtagatatatggatgtctcctgccacatatttcccacagtatcttgaaatggtgatgcatcttgctgattttgtttaaaaggttttctttattttgagacagagtcttgctctgttgcccaggttggagtgcagtggcatggtctcggctcactgcaacctccgcttcctaggttcaagtaattctcctgcctcagcctcccgagtagctgggattacaggtgcctgccaccacgcctggctaattttttgtgtttatagtagagatggggtttcaccatgttggccaggctggtctcgaactcctgaccttgtgatctgtctgcctcggcctcccaaagtgctgggattagaggtgtgagccaccacacctggcctaaaagtatttttaactagaaaatatttcaaaaatcacaaaaattaaatagtgcattacagacaggtggttcagtttagaatgtatgtttcccttctgtctttcacatgagcaacattttataatttctaatagcatttattttatttttaaaaatttaaattttgcctgttacacagccctcaggaggtcctgagaacatgtgcctctcaaatagcattttaaaatctatgtgttgcttgacttgcagcaaagattaatgccattctgattttctactaatttatttctattaaaaatagtgatattatacatgacatcgctaatatcaactgggtttcctatactatagtaatgtgagtcaggatttttctttattttggactatctgtttagaagtctatgtttgggtccagttatctttttctactgataaaagtaatgataggtagtgctgtcctgtgcagccccttcagacctgaaggatgtatttccccagcaggtgggaattgccgccgctgaagatagctgcctttcctgaggtcatgcctccttcctggaatctatgcaggggtgtataggcccctttgcatcaacttgggctaacgctgtaggtcagcccagcttcagctctccagggcatggacagaagccttcattctgactacattgcatcccagcttctctctctgcccatttagcttcatttcctgcctcactcccccatgaatgttgaactcaacggcactctccagtaaactttctgcacacagatctccatctcagagtttatttcttggggaacctgacctataacactaggtatatatatattatgtgtgactgaaatgtgggtcaagtggcatggagactgtgtttatacttattttcctattcacagggcatgccaggttcatgcaattttagtggacaattaaaaattactttacaaagtatctcttgctttagtagcatttactagttgatgtgcacctggtggcagtttcaaaatgttttcttccatttagtaattatctgttgccagatactgctccacatgcagggacacagcagtgtgaacagagagacaaagtccctgtcctcatggagcatagtttctagtgggggtaaacgaaaaatagttagtagataaataaataaataaatatgatttcaactaataacaaattccaagaaggtaataaaatagggtaacgggatagagagtgactggagggctttatcaggggtagtcctggaggacctccaggaggatgtgacatttgagctgagacaaaaatgatgaagagcagatggtttactattaggttgctgcaaaagtaatcacggtttttgccattagttttgcagcaacctaatagtttgtaagatggcttgtttcaattagataattttgggtgcattataaatcttaagggggccaatggctagatacatgatacagccatatattcaggtagagggataattgatcatatgtctagtcagatctgtaaattttttttcagtatacatattctgtatacattttataaaaactacgtttgacttagaagacagttttggtgctcttgaagacttgaccctggcggggaggatttgaggggctctgttgttcaaaaggagagcagagcgcctcacttggaagctactgtaggagggtagagggctgtgtctgtgtccaaagggtgaggtttgtgcagtctgtgccacatgtataaaataggactgaagaggtgtgagtgctgtgttgcatttgttaatgctgcctgtgttttgcttttgcataacaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaactattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggctgaagcgggtggatcatgaggtcagaagatcaagaccatactggctaacacggtgaaaccccgtctctactaaaaatacaaaaaaaaaaaaaaaaaaaaaaaaaaaattagttgggcgtggtggcgggcgcctatagtcccagctactggggaggctgaggcaggagaatggtgtgaacccgggaggcggagcttgcagtgagcagagattgcgccactgcactccagtctgggcaacagagtgagactccatctcaaaaaaaaaaaaaaaaaaaaaaaaagaaatatatgaaatgaatacatgcataagattaccactattcaaagcctttcacaatttttccttgaaaacaggaaaaactttgtccacagaattccatggaattttcaacctttggcaacttgtagagtagtcctgtagaattaatgtgcacctaaaagccacatttttaaagtttagaaaaccagttttacaaaattgcacagaatatatatcaggtaagatatacgtgtgggtggtagggagttgggggagagtggaggagagttgtgcgggagtggagggaggctgtaggagatatgaagggaatcagtgcttataaaggacgaacctaacaacctctccaccctcctttttataagaaatctgccttgtgttgaaattaaatttttattgagctactaaagttaatatttcaaaaaggcatcagtacttcatagaagacagagcatgaagcaccattttagccactgctagcactcacaaggcttggccctagttcttcaggaacagcaaaaggattgactggcaaaaactgaccatatttgtaacaacagtcctcaaaatcccatcaatcaattcttccctgttttgtctcaactctggctagactgtcccaccgcttttgtgtagacacagggtagattttgatgttgtctctcctagaccctccccatcctctgcaactactgtattccaaggaacttatacccttagccagggccctaaaacacagggttatgtgtattctgttgaatcatatgtaatcgccaatatttacctttcttgatgggaatttcacgggctcaatctaattatccacatatttccctaggtcatatgatacaagcactttttgttatcctgcttagaaatggcaatgaaatatgaatttgactaatttttaaagcaagacagagttgctagtcaagaagcaaatagttgaattacaaaaatccatagatacaagctacagataatattgtgcctttaaaatcatctgtaaggaatgtaatcattttcctctgtaaggaaaaggaaaactgattagattaattgccccaagttttaaaatatttcagttcatttccgtgagacttcctggggaagaaaggcacagcatcattagactctgggttttgctgcttacccttcatgtatctgcactcgcacagccttccaaacttcagagggaagagtggcttctttaaataatatgactgtgcgtgttgacattttcctgagaagtcccttttgtagaatccagaattgtgaactccatgaaatgtaatttgcagtacattctttaaacagaagagggtgctctcgggcaagctgatgctacccagctctagaaatataagcatttaaatttggtggtgcttgtattatgattagtgcaagatcttgggggcatttaataaagcatttcaaagcattgtgagtccagtggagtataattaaaattaatgcaatagacaaacacattaaagtattcttaatgcctagtctaaaaatgctgtcaaatacagttttacacatccgaaagatttaaatactatgcttgtctctgaacatttctaactgttacagagaaagaaaaacagtgtcttccttctccacaggtttcaaacaaaatttttctaatgagagttaataaaatcttctttctttaaaagatttataagatattataattaattcatcctgctttggcatgtgtcaaggtcaatgtggtctctaaaaatctccagtccaggattgtactttcagcttcttaggtaagaacaagcaaagatatatgctttcaggagaatatttcatgctgccttgactcagggacaagccttggttctgtttcagtcctcagaaaggagtaatgaatattgttcttttcaagatgggctctgtatttctctcagaaatctccctgggtggatgttgttgttttttgtaaagccagttaggacactctctttccaaaagtcttatatcatgagtagtctatgagtgtagctgtacgcacgcagcattcccaaagccttctgaagtacagaaggcttcctaaagacattggctgccagtttggcactctgagtcacctcaaaatgctatgtgaccttcgttccaaataatcatcttgctgatcattctaattttcttaagtgcttactatatgtctgcatttttctaggtactagggacaagtaattacaaaaacagttaattcctgctgttatagagagcatataatagtgggggaagtcaggcaataaatatcaagttgtgattattgctatgcagaaaaataaagcagggtaaaacaataaagagtggtagaagcgtgccattttagataggttggtaagggacgttctctttgatgagatgacattctagcagcgagacctgaaagaaatgaggtagagtgccactcagatccccagggaagagtgtgtccagcagagggctctgctagtgcataggtgcgggactcggggtgctaacccgtcagaggaacatcacagaggacagatggctgctggatggccatatcggagtgagcaagggggtgggatggaggtggaaagagatcagagagattgtggggaggtgggggaggcagaccacctagggttttgtgggccatggattttactctgagtgagatgggagcccctggaaggctttgtgtagaggaggggtagaactttgttacatgttaagatgatcgtgtggacataaaaaggaggtagaggcagaagcaaagaaagtagttaagagtctattgcagtatctcaggtgtcttagtcctttcttgctgctatacctgagactgagggatagcagaaatttctcacaacacaaatttctcacaatcttggaggctgggaggtccaagatcaaggtgccaatagattcagtgtctggtgagtgcctgtctgtttcttatagtaggcacgttcttgccgtgtcctcacatggcaggaggggcaaaagggctccctgaaccctcttttataagggcactaatcctgttcataaggacagagccttcatacctaattacctcccaaaggccccacctttcactaccatcatcttgggggttaggtttcaatatatgaattttgcgtgggacacaaacattcagatgatagcatcaggtgagaggtgacggtgattgagagtggtgacaggagatgaaaaatggttgaattcagaacatatttgaaatatggagccaatagtatatgccgatggattagatgtggcgcgtgagggaaagaagggaaccaaaacaactgccagatttttggcctgagcaacgaaagagtggagttgattttatggacgaggggaagggtgttgtaggagcaggttttggggagaaagatcaggaattcatgtttggatgtgttaactttgagatgcctattagacgtctaatggagacagcaagtagcaattgaatgtacaaggcaggaaagagggctgggataaagatgcgcctcttagagatatcagcgctttcagccatgggactaactgggatcacctgggagtaaatatacactaggagtgggctgagaattgagcccttgggctccctggagtttagaggtcaggaaaatgagggcaatgtcataaaggacactgaggaagagtagctggagtagaagaaaaaagagaatggcattcattccaggggtcaagtgaaaaaggatgtaatgagtttcctcaaatgctgctgctagagtaagatgaggactgagagttgactactgaatctagcaacatggaaatggtgaccttgacagaaacagtgtcactgaagtgagagcaatggaagcaaactcaagcaggtttggactcagggagtaaatggctttgtaggggaagcaaaatttccttctaccctcttcagttctgttgttggtccaagaattaaactgacataagacagattaacaggagaaaagcataccaattttattaatatttttacacggacgtggcagtcttcaaaagggaaatgaagaccctaggaagacagtaggccgtgaagcttatatacattttcacgcaaagaacaataaattatggggatgtgacaagacaaaggggcttgggcttggggcattaaattgtaggacagtgcctaggaaatacatgggggaaattaacgaaagacagggtcgttttggtagtttgttgtggaagtccatttcggcatcaactcctagtctctggtgataagaatgttctcttcctagtacagggaaggcacctttttcatggaaaattttatgatctgtttttaggtagaaatgaggaggtcagagagcctatgttagtttgttttgcatcgctgtaaaggaatacctgagactcagtaatttataaagaaaagaggtttaattggctcacagtttggcaagctgctcaagcatggaaccagcatttgcttggcttctggcgaggcctcaggaagtttttactcatggcagaaggtgaagcgggagcaggcatgtcacatggtgagaaagaagcaggagcgagaggaggagcttccaggctcagctctgcatgaatgaacagagtgagaactcactcattatcgcagggacagcatgaagacattcatgagggatctgcccccatgacccaaacacctcccactaggctcatctctaacactggaggtcacaatgcaacataaaatttggaggggaaacacatccataccatatcagagcccttctgcatgagctgtttctcaagtgccttcagattaaaataatcaatatgccaaaacagcatattttgggatggcacgaatcccttcagccccctttttttttgggaatagagtcttgctcttgttgcccaggctggagtgcagtggtgccatctcagttcactgcaacctccacctcccaggttcaagtgattcttgtgcctcagcttctcaagtagctgggattacaggtgtgtgccaccactcccggctaatttttgtatttttagtagagacaggggttcaccatattggccaggctggtctcaaaactcttgacctcaggcgatccacccacctctgcctcccaaagtgctgggattacaggcatgagccagtacacctgttccccttcagctcttttgaggagttttgctgtcaatatgaacactggaacagtggctggggaggatgagatctcaatacttccctgacatcccttaagactcaagtcttgatactttgtctgctctctggctctttctttgtcattactattatttttatcttcttgatgttgactcttgctaaaattttttgtcttccttattgttaatgcttatagaaaatgattccttgttatcttttagcccatgtcatccgaatcatttgctgtttctagcctaggtgctttgactatgccagcttgtatttcttcagaattttcattaactatatgtgtggtattgtaggcattacatattttaaaataaatttagccattgcttcaatcacatcctgctttgttttaaaatttttcttggttgaatttcactgggtcaatgtcatttcatattaggatggtaatcccacttcaaattttcttatcaaattcagaataattataaaccagttgctggtttcataatcttaagaatgccaacaaagttcctgcaggataaaaaaagcacacctatttattcatagtttttatatctacctaatagtttgaacttcgattctttattatagatgatacactaatattctatgtaaataattgtccagtaattaataagtgaattttaataaaattaaagtatctgtgaaaggtacaatttaggcaactgtgaaatcatactattagtgggatattttattgttttgattcattatttattttaaagctgttttgtatggttcaaataaggaggtgatcaaaatattatttcacgactcacatggcttattgtcacacacagggaattttttccatgatgtttaaagagggaaagaatcacaagaacaaatctcatagggaatacacttgatagatgaagtacattaaccatgtaatgaatgagttccaaaattactaaagcctagttgctcaattaggatgaatgcaggctctatggaaagtgaaagctagttgaagtgtcaggtatgagtgtaagagaggattttgggagagatagcttgatcagcacaacagagatccatgcagacacaggaggtccctccatgcaagagtgtgggtgttgctgctgagtcttcggagatgaccccaaaggctaacaggatgtagtcctgccatacctggagctcacgatctttggagaagcaactcaacagagtgcagtcatgccatggcctaatctctcaaagtgtctgccaaactattagatttgtaggtaagtcatgcattacttaccaatgggaaaatgtacaaaatgagaaatgtgttgttaggagacttcgttgttgtgcaagcatcatagaatttactgacacaaacctagatagtatagcccactacacacctaagctatatagtatggtctattgctcctaggctacaaacatgtttttggtaacagcatgctactatactgaatactgtaggcagtagtaatacaatggttttgtgtatcgaaacatatctaaacaaagaaaagatacagtaaaactatggtattataatctcatgggactaccattttataagccgtccctcattgacagaaacattgttatgaagcacaccactgtattttggagtccagtagttgaagtcagtagttcacatatggggtttgataaggtgtgatgtaacattctcggaggaagtgggagtacatcgcaagttcttatcatagtaaaacatatgtcactcatagcaaactatacatgtgttaggaataatttcaaagctgtgcaacaaaaacagttcacaattaaaatagaagaataaacttcaatttaaaaatattattactcaaaaatagtaaatatttaatgtataaagtaatgaaacaaaacttactaaacaaaaatattacatcttgcaattcacactccattttagtcttttaaatttaaagatacaaataaaaactccaaatggtcacatagaatgacagaattgaagtaacctaagtttggctgggcacagtggctcacgcctgtaatcccaacactttgggaggctgaggcagatggatcacctgaggttgggagttcaataccagcttggccaacatggtgaaaccctgtctctactaaaaatacaaaaattaactgtccatggtggtgggcatccataatcccagatacttgggagggtgaggcatgagaatcacttgaacccaggaggcggaggttgcagtgagcagagattgtgccactgcactccagcctgggaaatagagtgagactctgtctcaaacaaacaaacaaacaaacaaaaaaattggccaggcacggtggctcacgcctgtaatcccagcactttgggaggccaaggcgggcggatcagttgaggccaggagtttgagaccagcctggccaacatggtgaagccctgtctctactaaaaagaaccaagaacaacaacaaaaaaaactagccagacgtggtggcagggtcctgtaatcccagctactcaggaggctgaggtaggagaactgcttgaaccggggaggtggaggttgcagtgagccaagatcgcaccactgcattccagcctgggcgacagagcaagactccatccaaaaaaaaacaaaaacaagaagtaacctaaattctatttcttcatctttacaatcacagtttattttaaatctattgtttaaatccaagaatacatggtaccaaaggaatagagacacaaattgcacctggaccattatgaatcccgagacgaatatgggtatcagtccacatgtgtcagaggtccaagtgtataactgggagttctccaaattaacttctatgtaggatacaatgtttattatacgctaagaaactaaaaaaaaatgctgatttgaatctttcatttgcattattaaaactcaacaattattatacttattgtttagaatgcgtgccaatattaaataaaaaattggtggggaggggagatagagtatttaattgtggacattcttttgccagaattgccagaacatggtgataatcaaaagctgactgactttctgttgtttcatcattgtgtttaaattatcagtaaacaatgcttctcattattgcctgtgcccaggactgcccacttccccatacttggtacaccactggattggcagtgatccactgttgaaaggaattggcaatgatccactggtgaaaggaaaattaatgatgcagcagggtgcagtggctcatgcctatagtcccagcactttgggaggctgaggcaggtggatcatctgaggtcaggagttcaagaccagcctggccaacatgtcaaacccgatctattctaaaagtacaaaaattagccaggtgtggcagtgcatgcctgtagtcccagatactctggtggctgaggcaggagaatcgcttgaacccgggaggcggaggttgcagtgagtcaggatcgtgtcactgcattccagcctgagtgacagcgtgggtggggaggggggaggaaaagaaaagaaaattaacgatgcaaaggagagagagagagacaattgctaaggccatatctctgagcagatgagaggggaaaggacccaaggcgccagcagaggggctgacagataaaagcacaaacagttcatccacggcaatgaggcaagacagagtctatgggtacggatgaatgcaggcctgtcatctaaggtgttctttcttagtttctttcccagaagtggaacaggggattcagagacttttcaccatcccagagatggaggatcctgtttctttaaggactctttattaccgattttaattttctttttttccccctgggtttttttgtttgtttgtttctgtttttgttttttttttgagagagaatctcactctgccacccaggctggagggcagtggtgtgatttcagctcactgcagcctctgcctcctcggttcaagtgattctcctgcctcagcctcccgattagctgggactacaggtgtccgccaccatttctggcctatttttatattttcagtagagacagggtttcactatattggccaggctggtctcaaactcttgacatcaagtgatctgcccacctcggcctcccaaagtgctgggattacaggcgtgagccactgtactcagcccaattttattttcttgaaaagtttgatcacttcctttaatatgtgttctttaaccgtattttttttttcatggtagaggttgccgtggatgtcactggtattaatgcttcaatatcagctatactgactcaaaagaggacattattgtgattttagaactgagatgatcaattccctctaacagggaataaatggttaaggcagctctgatttgggaaatacatttgtgagcactctagagttcagtttctttttctgcttttcatctctgagagagacgctacagagctgtgagtggccgggtgggggtgggagaggccgcccgggagcagtgcttgtccttttctgtagagttttattttgatattttcacactgctcagagagaattccatccaaaggtcctcaagtgccatgaaaaggacaaggaaagagcatctttgaacagtggcattgttaaatgccaagagcctgcctctccagtggataattttgagatattctgaaacacttttcaaaggctttgccaagtactcattgtggaaaaggacacattctatattaaactctcactgggatcagagatggccttgggtaagactgtgacctagacgatgtttgtagccctctttttcttgcctcttcctccatcagtgatgctccagtcccttcccccacacctcctcaaggcttttagggtctccctgcctccttctttttgtcttatatgattgagtgccacggaagggtagatgtcagtaacttagatcttggtgttcttctgctgcaggcttttccagtggagctacttattcctccaaaccccacagacctttaactgcttctctaccttcagtgtggctgtcctccatcctccagtccaccctttgtgctgcagtcaggaagggacacattatcttgcatttgcttaccagtgagccttagctttcaccacagcttgccttattctctaccctctagccaaaccaaacaaactgctctgttttcctcaaacccatcatgttctcaaaccctgcatgttctcaagccccaagttttggctgatacagtaccctctccctggaatattcttccttgcccccttcctctgtctcctactcattccacagacctcagtttaggggaccaattctaagaagccttccctggccctccccattcaggttaggtgaacctcacaggtattttttttggtactaatcctgttatattgtaattacttgcatctttttctttttgcccaccctctttgggattttgactggggtggctctgcccagttatttctctttttctgggaagagaaccatctgcaggggtggtggtaggtgatggtaggagcaatgccagtgatatggggctaatcccctggccagagattacgacctatgtgttcaataagaaacactacatgaatgaatgatcggataaatttagatcaatgcactacttttctccctatgatagttgcattttaatccgtaattttctcccacatataggctagaaattccattttataagagcttaagaataaattcatatcaataacttttaatgagtgtttttcatatttgaggtactatgctaggaactcaaggggcatataagaatgaataatacacagcctaagccctcaagaaatttaaaaatctattacacttatggttgcaaatgtcctttaaaaaataaacacatacacatatccaaggggttgaaaaatattaaaatatttgttttaaaatttgatttaatcttgtttttgaaagctggtaaaagtggagaggaagcacccttagctttttagcacctgttgtttgtctgggactgtgttttctcatttaatagccagcaacttatgaaggaagtgttacttttctctctctctttttaaatttttttttgagacttaaaaaatttttttttgagtcttcctctctctcccaggctggagtgcagtggcctgatctcggctcactgcaaccttcccctcccaggttcaagtgattctcatgtctcagcctcccaagtagctgggattacaggtatgcaccaccatgtctggctaattttttgaatttttagtagagaaagagtttcactatgttggtcaggttcgaactcctggactcaagcaattcacccacctcggcctcccaaagtgctgggataacaggcgtgagccaccgtgcacggccaaggggtgttgtttctcatcatgaaatgaaaacatctctcttgttaaaggtatcttggaacgcttgtgtggctgtagatggctttttttcttgtacttgaaacaatatcccgtgcttaatttccttgacctgtccatgtaacaataagatgtaacttcaaatgaaaaacattcacataaagaatcattcactagctcatcccatgtaaacacatataagcaaacactgacgttgccactttcaaagccaaaagaaaatgcaatcacaagtagggatgatagtggtaggaaaggggccacagtggttttctgtggtgtttggatagaatacagtggttattgtctaaaagttttctgtcttgatgaccctttcttggtcctttggctagaaaaagcaagcttttttatgtttcctctctgaccattggtatttctgggttgccagcttctccagcacccaatctaggatatgggaggcaaaaagaaaatcagagaactcactgctatgtggctgttgggattgcgaggtccataattggcctgccatattctcctcacttttcagagtcttcttatgtttgtttagatatataacattttagctgttcatagcagaatgaataggaagaagtgtgtttattttatgttgtccctgcctctccgaatatttgaagcatctaagacaacagaatagaacagtcaagatgctgccacttacctcttataaaatgagacaaattaggaaaaaagaaaagcacagttatcgagggaacaaagctggttggttttctgcaggtcatagccttaagttcaaattatttgtctttatctccaccttgtctaggttggagaattaactggagacaataaacattattgttgctaatattttatgtacatgtatgattatatgcattacgattaaagaaatgaaagtataaccatttgttaggtaggaaattactgaatccttatcaagaccttgatgagaatgttgaaaaagtagtgatgaggaaaattgtgtttgaagtcatcccacatactttttatgagttaattataattagtaatacgtgcacgatatatacatctcttgaatattaaaatattttgaagtaggcagtcatatactcattaacagtgttccattgcattgtgtcacatggtcactttaactgaaatcttgttggagtgggaggaggaattcatcatggtggaatagaatcagatgttcaaataaagcaagttgattttggagctgtattagaaaattgaaaatgttacaaaagtgcagagtataaaataaatcagaactgccaacactgtaaccatttcaaagttacagggtgaggcagagattatctggattttcatttcctgtaagatgtaaaggatgaaacagggtcagagaaacaccctgggtttagtgcattggttgcaaaatgttcagaagttaattatgaatatttgctgcctttagtcatatgctcaaataccaacttgtattttaatcaccaataaataattagagtctatacaattattgaaatactttgtatttgactggaaagtttaatacgtaaaaaataatgggctgcctctaaaatatttttctttcctttttttcttttttgggacagagtctcactttgtcgcccaggctggagtgcagtggcatgatcttggctcattgcacctctgcctcccaggttcaagcaattctcctgcctcagcctcctgagtagctgggattacaggcatgcaccaccacacctggctaatttttttatttttagtagagacggtttcactatgttggtaggctggtcttgaattcctgacctcaggtgatctgcccgcctcggcctcccaaagtgctgggattacaggggtgagccactgctcccggcctttctttacatttttatccaacaaaaggacttcacaaatatggcctttgctcacaataagcaaagtgaaattatttctttactttcagaagagtatcactaacacctccaggcaaaagtagtgaggacacatggggaagaaaattaatctgattattaagatttgcttaaatgttgcaaaaactggtattgattatcagtaataaacatatatattatatattatggtctctaaacaaagtaggagaaaaatgaaaatctgatgctccaaattgtgttggccagttaagggggagctttatgctttggcagaggtgtaattcaaaggaataggtacttaaagaaggactaagttttggcatttcttttttattcattatttactaacaaaaaatagccactgtaaaattgcctcactgaggctgtaggatcttgaaatttcaattttaccatcaaaagtaccttgtaggctggatgtagtgactcatgctcataatgccagcacattgggaggctgaggtatgaggattgcttgaggccagcagttcgaggctgcagtgagctatgatcataccactgcactccagcctgggtgatagacctagaccctgtctctctctctaaaaaaagtggattgtttatgcaacatacttcctctctgagtttaaaaaattgacaaaagaaatgtaaccatcatgactatactattctgcatatttcatgataatttgataagctatcaaacgtaagtgttaaaagattcttttacatacttttcaaatgctcttgtgactggtgaggtcactcaagacacttgagattacaatgagggacagtccaatcagagaatgggtgctggtttagttatttcacactgtgtaacaaattatccaaaatgtaactgcaaataaaattacagatattcatgatctcatatagcttctgaggatcaggaatctaggagatgcttagagcgtagatttggttcaagataactcaaagatatgtagtaaagcttgtcagggctgcaatcatctgatagttcaactggggaaggatctatttccgaacttacttatgtgactgtttgagggtttctcatacttgctgactgtgggctggagtctcagttccttgccaaatagacccctccataagctacctgagtatcctcatgacatgacagctggcttcctccaaaatgagagagtgagcccaagaaagaatccacagctatgaataaccttatctcaaaggtgatatgctactacttcttcttttttttttttattttaatttaatttttttttttattgatcattcttgggtgtttctcacagagggggatttggcagggtcataggacactagtggagggaaggtcagcagacaaacaagtgaacaaaggtctctgttttcctaggcagagtgtttgtgtccctgggtacttgagattagggagtggtgatgactcttaatgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccattcgatttctcaatcttttccccaccttgcccccttttctattccagaaaactgccatcgtcatcatggcccattctcaatgagctgttgggtacacctcccagacggggtggtggccgggcagaggggctcctcacttcccagtaggggtggccgggcagaggcgcccctcagctcccggactgggtggctggccaggcggggggctgacccccccacctccctcccggacggggcggctggctgggcagaggggctcctggctgggcagaggggctcctcacttcccagtaggggcggccgggcagaggcgcccctcacctcccggacggggcggctggccgggcggggggctgagccccccacctccctcccggacggggcggctgctgggcggagacgctcctcacttcccagacggggcggttgccaggcggaggggctcctcacttctcagacggggcggttgccaggcggagggtctcctcacttctcagacggggcggcctggcagagacgctcctcacctcccagacggggtcgcggccgggccgaggccctcctcacatcccagacggggcggcggggcagaggcgctccccacatctcagacgatgggctgctgggcagagacgctcctcacttcctagatgggatgggggcccggacgaggtgctcctcacttcccaggtgggatggcggccgggcagagacgctcctcactttccagactgggcagccaggcagagacgctcctcacttcccagaggatgggcagcccggcagagacgctcctcacttcccagacggggtggcggccgggcagaggctgcaatctccgcactttgggaggccaaggcaggcggctgggaggtggaggccgtagcgagccgagatcacgccactgcactccagcctgggcaccattgagcactgaatgaatgagactccgtctgcaatcccggcacctcgggaggccgaggctggcggatcactggcggctaggaggtggagaccagtccggccaacacagcgaaaccccgtccccaccaaaaaaacacgaaaaccagtcaggcgtggcggcgcgcgcctgcaatcgcaggcactcggcaggctgaggcaggagaatcaggcagggaggctgcagcgagccgagatggcagcagtacagtccagctttggcccggcatgagagggagaccgtggaaaggagagggagagggagacgggagagggagagggagacgggagagggagagggagacgggagagggagagggagacgggagagggagagggagacctacttcttctttattttagtggtaaaataaacctaccatggtacaaggtaggaggggacaacaccaagtggtcaataccaggaggcagggatcactgggggccatcttgaaaactggctaccacaggtccacgtggcagatttgcaacttggatttacctagaacttgtgttaaagcatacctcctctagtagtcattgcctgttattgggaagaaatgactagtgaccattcagacaaactgcaaggggcaaatgaaatttgctgacatttctctgctaacattacatagcctctccataacttgagtatactgactgtactaagaaataacaattcaacttttagttacactttttatgggtaccaagatccaagaataatttaaaaaatatacatgatctacgtatagttctgagaagggcagaatgtgtaataaagtaaaacagtatgctgtcacagaaagttaggtgattaccaatcctaagcatttagaaataaagctttaaaaccttcctatgaaaaagatggaaaacaagagacacttttagctttcttatttcccagcttgaataatttaattggattttataatatcagtaggaatcaatgactgcttttagctttcctactttgggtgaaagataagtcactttgaacactcctggtagtaaattgccaggtggagagatatgaccattaaaatgaccatatatagttcttggctttttgtaaaagaaatttctaatagttttcaatgtaggaaagttttctaaagggtatcatataaatcagctacttgaaactcacaaaccataaggtacctgacccaggcaaatcacatacacagtggtaggggataaacagctctactgcacttacttgcacaaataaataaataaacagccaattttaaatataatagagtttttaatcatcaaataacgtatccatctggttaggtcaagacctatttgcaggatagaaaggctgtttagaagagttgtggccaagtgcggcgagtcatgcctatagttccagcactttgggaggctgcggctggtggatcacttgagaccaagagtttgagaccagcctgggcaacatggcgaaaacctgtctctacaaaacacacacacacactcacacacacaaaatagctgggcgtggtggcacacacacctgtagtctcagctccttgggaggctgaagtcagtgggttgcttgagcccaggaggtagacgctgcagcgagctgtgatcatgccactgcactgcagcctgggcaacagtgtgagaccctgccaaaaaggcagagttgtggcaacagatggtgacttcttcccttttctaatcctccaggttatctgtgcttacatcttccctcagtcttagctaggtaacgtatgccccaagatgctctgcccttcaggagagagaattattgtaggtagacagctggtgatttctgcctaactaagaaaaggagataggaacgtattagctgctgactttcttttagcagtggttttccaccttggctgcatattagaatcagattttgccgagtgggatccaggcactaaacttttttttaaagctccccgcgtgattttaatgtgcacccaaaattgagactctttgtcttaggtcagggggtctcatgtcagcgcccattggaatcacctggagagcatgttaaagttacagaatgctaggctccatcctccagtctgattcaggagggctggggtgggacccatcatttgcatatttaacaagttcccagatgctgctgatgctgctgtaccacgctgacaagtcttagaaaaatttggctcttgttatatttttatacaacaaaaaatggagttcagctgtgagtggggtgtagggggaggaatgaaaattggtaaatgcagaggacagatatcactagtctcccctcttttctttccccatcttcttcaaagctgaagttagactgagatctacccctgcatttcccctcctcgattttcatctttcacggattgaggaaacaacctgtgaacggcccaaagccggctagacccaacctaaccatccgttttagcgggtctcttttctcacacaggccgaccgcctctccgccttgacccccacctccactcaaacccgctccatctattaacgttctcttctgcccagccacgcccccggcgttctccgtggttgcgcacctgacgtacatcgttcaaaacgtgcccagtgtttccctccgagggcactgcgtgccgcgcaggcgcaaagggccaggtgctggaggtgctgtcatggcctgcctcaacccggtggtaaggaagacctcaggctctgtgtagagggagcgccctgggactccgggttcacggcagccgaaccctgcaccttttgtttccccctgacactttacagattgtcataaaccctctctcttccttaggggctggggctcttcttcacgtctgtgttggaggaagctgctgagggccagtagttcagcaggaagttgggccagccccgccaaaagaacaagtgccctttttctctttttacccaaactgaggctatctagttggggtgtttagaggtggaactgatcctcaaccctgctggtttcctagatactagaaaacctccaagttcggttgtgttaattttaccgtggacattgttaattccaagctgtattatttactgcttgaaataacaatgtgatatctcatgttacctccccacatgtttttagtgtctttcactacccgcccatttcgttgtcctttaacaacttaatgcttaagtgtacaacctacattaccctcctacctctaacggacacttaatttgcacagtgagaatttctagtctcagtggcacttaggagaccatcaatcttaaaaacctgaatcaaagaacaaaaatcaaggattcatctttattaccaattcatctcaacagacttcacatttcgtgaaaggcaatgtgcctgtccagatctgtgtaattttatgggttccgggtattatatatgcagtataacagctccatttttagagacatgctactttaattatatgtgttttatgatagtgcgttttaagatacataaaatacctatactctgcctgaatataaggttactatgtatgccaatttatctgattgtgaattctatgaaggagtgtctgtattttaaatagaggagttaagatggactagacatagttttaataacagggatgcaatacaaagtctgtggtcatagaagagaaaatatgttcaatacctattttgatttctgaaaaactgtgttctaatgggtactttttgactactgctgtgttaagattttttagacctaagagttttttccttcggtgttaagcgtgatcacactagctgggactaccactgaagcatcaatttagtatgcctttatcaggataaactgttttagaagaagcacctaatttaggggcatttagtcttaatgcatgtgcttgtgaataacattatttaaatgttactgattggcctattcgtataggtttaccctgggtctttagaaggattaaagcatagctttaaatactaaatactcttaggggctgggcacggtggcttacacctgtaatcccagcaccttggaaggtcgaggtgggcagatcacttgagcttaggagtttgagaccagcctggccaacatggtgaaaccccatctctactaaaaatacaaaaaattagccaggtgaggtcgtgcacgcctgtagtgccagctactctggatgctgagacaggagaatcacttgaacttaggaggcagatgttgcagtgggcccagattgtgctaccgtactccagcctgggtgacagagcaagactccatctcaaaaaaaaaaaaataataataataataaaaaaaaagcacagctactcttggcatgaacaggagtatttaggagtatttatttagtactcttaatgagtactgaatagggtaggatgaaaaggcaatcctagagtgccacaattttcattttggcgtgattaagcaatttgaaataagagcaactcaactaaattcctgctttgctgtttcttgccggtggaacttccactaagtcagtattgtcagcacatagcattgccattttggcctgggggcatagtttatatagatatgaagggctgagttttttcacataccctcttttttgttgctataactagtgtttaatctgggtagaaatctgcttaatttcattgtcatggcatgtttgactaggaggtattttagaatgttatttggtctcttcagtatgcacactgtggatgggtaaggttgttcgtgcccttcttaggttctggtaggaaatccgttttggaacaggtgtatttgataatggtccagaatatatattttttggactttgtgtattttggaagtgagatgagctttaattgctctattttaagtgtttaccccagttttctggcttggagtttatttatatttgtggaaataatatagtgaaccctaaaaaattctcctttggccactttgataaagaggtaaattgaaaacagaaggtctatttctggttgacttacattaatttcccttttaaaaggagttgaggaggttaaatactgacacaaaaggcaagtaacatgacaataaccatgcatctttgagattattagctcatatgttattgtagttctgtaattcagtcttgtagataggctgagactatgggtctgaagctaacacagtttatggaaagctaagactatattgggaataggaatgtacatagtaaaagttttaatggtgacttcacaagactagaaggtatgcactgcatatcttttaaggccaaatatgttctaacttgagaagtcagaactttaacaggccgggtgtggtggctcatgcctgtaatcccagcactttgggaggctgaggcgggtggatcacgaggccaggagttcgagaccagcctgaccatcatggtgaaaccctgtctctctaaaaatacaaaaattagcggggcatggtggcatgcacctgtaatcgcacctactcaggaggctgaggcaggagaattgcttgaacctgggacgtggaaattgcagtgaactgagttcgtgccaccgcactccagcctgggcaacagagcatgactccatctcaagaataaataaataaataaataaataaataaataaataaataaaatgaaactttaacaattgcttttatgtagcctaaactctacagatctgtaattgaagatgtaattgaaggagttcggaatctatttgctgaagaaggtatagaggaacaagttttaaaagacttgaagcaggtttgtagccgatacaactttttcttcctgtcttttgttgtttttttcagcatacaaaactgatatagttctgatctctcaaattatagtttagtacttacccattcattgtgccatcaggatgacgttagtttttaagaaactgaaaaaaagagaagtatcattatatgtgtatatatttttttaaagtaaactttttttttcccctctgcagctctgggaaaccaaggttttgcagtctaaagcaacagaagacttcttcagaaatagcatccaatcacctctgtttactcttcagttgccgcacagcttgcaccaaacattgcaatcgtcaacaggttggataccattagtaaatgagtactgttagtatcttcagaacaaattctcatttgggaatgtttttcagttagacagggtaatgttcttagggtgagaaggcttggacacctaaatcatttctattaaatgaacacagtataaatcattgccccatgtaattattgattaaaaactcaggttattcgaactagtttttattttaaatattaaattttacaaagatgataaagcctttctttagaggaaagtcacatagtttgtcagctgttgggagcacccattggtaatttcagataatttgactgggtctagtcaaggattagaagtggcagagggaaaggtgagtgcttgcaagtttgtgtgttctctttctcttattttttgtgtatattataaatctgatatattgggagcaaaatggagagttcagaatatggagattattcaggctacctcactgttttggatatataaaataatggctagaaattgatcatgtgcatttatctttattcttggacttagcaaatctagacttctgcttttaagggaaatgtttgtccacattatgcgtatcaatttaaactggaagggactagctaataaaagataaaacttaagagttttctatccttgtatgcttgattcctttctttttcttctgattcttataatctttatgttactcatatgtgtatatataaatgtatactcgcatacaaacaagttttattgggtttagctgaaattcagcagagtagtctgcaagaagtgagggtagattttggattggattatcagtaataagcagatagttctttgcatgcttgggaaaattcacatgaaaattacatgggccaaggtgaagagaacattgtaaggatgcttgtacttcttctattacaaagtgggagaatttacatgtggcagcaattctaacatataaaaatgaataaattaacaatgaatgttgaattagcaaatacaagttttatcgaatactgtgttaataaagtataattttgctctgtaagaattagtcttggcagttttaattgttgacacattgaaacatttttcatcagttgggtttttggctatgctttaattttaaactactatttcattgggacatctccttctctgtttaaataacattcctttggagttttgttaatcactgttttatttattacagaatgctaaagatgtttttttaacttatggttggcatgagggtgtggtgggtatggaagaggaaaatacttgactgtcttttatcagaagaggccgaggtgggtggatcacctgaggtcaggagttctagaccagcctggccaacatggcgaaaccctgtctctacttaaaaacaaaaacaaaagcacaaaaattagccaggcgtggtggctcatgcctgtaatcctagctacttgggaggctgaggcaggataatcacttgaacttgggaggcagaggttgtagtgagctgagatcgcgccactgcattccagcctgggcgacacagtgagactccatcttaaaaaaaaaaaaaaaaagcatggtgaacacttctaagattctgtcattcaaaattgcaatactagattttgccgcaagatggtaatattaccagtgatttaaataacaaaagtcttgcaactagtgtatcaagtttgtttttactcagctccttattctgtatcttagcagttagaataatagaaataattacattttaaatagtttttctccttattctcttctacatcatttataatgaagaggtttcagaggaattacatgtatcccttaaaagtgctttataggcttgttcctgtctctcttcatctttaggtaccaaacagtaagattcttgaaataaatagtctcataaaattgaagtacttcttaattatatcttctcatggtatgcttttaaaagcctgattaaaataacttaaacttctagaatttttttatctcttttgatagcaagttcaaattaaatctacaattcaataagtcatttgcctttgtctgtaccatcttaaaacttgtttgctcagtcaaaatcacaatgagataccgtctcacactagtcagaatggctattattaaaaaactgaaaaacagatgttggtgaagctgcagaaaaaagggaccacttatgcactgttggtgggaatgtaaatttgttcagccactggaaagcagtttgcagatttctcaacttagagctacaattcaactcatcagttctattactaggcatttacccgaaagaaaataagttgttctaacaaaaagacacccacacttgtatgtttattgcagtactactcacattagcaaagacatggaatcaactcaacccatacatggtggattggataaagaaaatgtggtacatatataccatggaatactatgcaaccttaaaaaagagagaaagaaatgtcctttgcagcaacatgggtgttgctggggccattatcctaagtgaattaacacaggaacagaaaaccatatattgcatgttctcacttataaatgggagttaaacattgggtacatacagacagaaaggtgcgaacactgggtactccaaaaggagagaaggagagaagggggcaagggttgaaaaactacccgtcaggtactatgttcactatttgggtgacaggatcaatagaagcttaaacctcagcatcatgtgatatacccacgtagcaaacctgtacacataccccctgaatctaaacccagaaacttgtttgctctatcatatgttcttcgttttttatttgtgtagtaatttcctgtatcttcagttctctactttgtttggtctcaggacccctttaagctcataaaaattaaggaccccaaatagcttttaaaatgtgggttgtaagtatctatttactatgttggaaattaaaacaaaaatttaaaaaatattggtttatttaaaaatttaattacatgttaacataatagcatatatttatgagtaataattcttcgagaacaaaaatatttagtaagaagagtgtcatcaattaatgtcggcttaatgaggtttgcagaaatgagctggattcttatctatttctatttatttacattttattgtatgtaaggtgttcaccatagtgctttgatatagatagatagatagatagatagatagtgaagaggttggtatagtctagcaaattaacatatctgtcatctcacataggtgctcattttaggtacttttagtatgccttaagtcttctcttttagcaaaaatcccaagtgcagcacaacattattaagtatagccctcatgttatctattagatatttagacttattgatcctatgtatctgtgactttggatcctttcacctacatcttcttattttctcccttcctgcctctggtaactgctattttattctctatgtctgtatttgtggttttttttttttaacatataaatgagatcatgcaatacttttctttttgtgtctggcttatttcacttagtataatgtccttcagtttcatctatgttgtgacaaatggcagactctccctcttttaaaaagctgaatcatattcctctgtgtgtgtgtgtatacagacataccacaatttctttatccatttgtccatttgcagacacttcggttgtttacaaatcttggctatcgtgagtaatattgcaatgaacttggaagtgtagatatttttatgaggtagtagtttaatttcctttgggtatatatccataagaaggattgctgaatcacgtggtaattctatttttaatttatttaggaatctctgcacagttttatacaatggctgaccattctgcattcccaccaacagagtacaggggtttcctttcctctgtactctcaccaacacttgtcgtctcttttctttttggtaatagccatcctaacaggtgtgagttgatatcttaatgcagttttgacttatattcctctgatgaatagtgatgttgagcacctttttgtatacctgttagctgtttttatgttgtctttggaaaaagatctattcaagtcctttgccaatttttgaaaaggttatttgtttttctgttattgagttgtgtaaatcttttaatatattttggatattaagccctttatcagatatatggtttgcaaatattttctccgtatctgttggctgctgttttattttgttatttgttttctttgctgtgcaggagctttttaatttgatgtctgtatttattttattttattttatttttttgagggagggtcttgctctgtcatccatgctggagtacagtggagcaatcataggtcactgtagccttgactttccagggtcaattgatcctctcacctcgacttcatgagtaactgggactacaggcatactctatcatgcctggctaattttcacattttttgtagagaccaggttttgctgtgtcgtccaggctggtcttgaactcttggaatgaagcaatcctcctgcctcggcctcccaaagtgctgggattacagatgtgagcgactgtgcctggcttatttattttcgcttttgtagcccgagcttttggtgtgatatccaaaaaatcattgccaaggccattgtcaaacaggttttcctctgtgtttttgtcttggagttttatggtttaaggtcttatggttaggtcttttgtctattttgaattgatttttatgtatggtatgaaaataagagtccatttcattcttttgtgtgtggaaattcacttcttccaccaacaaccatttattgaagaaactatcctttccccattgtgtcctcttagcacccttgttgaaaatcagttgaccatatgtgtttgggtttatttctgggctctctatactgttctgctggtctttgtgtctgtttttgtcagtgccatactgttttgattactacaggtttgcaatatagttttaaacaagaaaatgtgatacctccaactctgctttttttttcttcccctctgaattgctttggtatttaatgtgttctgttgttccatatgaattttagacttttttttgtatttctataaagaaagtcattggaattttgataagagattttgttgaatccatattttgctttgggtagtatggacattttaatgatatcagttattccagtccatgaacatgggtattttcccatttatttgtgtccttcagtttcttatatcaatgttttatagttttcagtgtacatatctttttttttgaggcagggtctggctctgtcatccaggctggagtgcagtggcacaaccttggctcactgcagcctccaccccctgggcgcaagccattctcccacctcggactcccaaagtagctgggactacaggcatgtgccacaacatctgactaatttttgtattttttgtagaggcagggtttctccatactgcccaggctggtctcaaactcctgagttcaagcaatccacctaccttggcctcctagagtgtgcatatctttcaccttcttggttaaatatattcttaagaattttattttttaagatgctattgtaaatgagattgtttttatgattttttggataggtagttatttgtgtacacaaatcccactgattttttttgttgattttgtatcctgcaactttactgagttcatcctctttaaatatttggtagaattcagccatgaagccatctggttctgggcttttctgtgttgggaggtttttaattactacctcgatctctttattttttatatctgttcctaaattcaatctgttgtgatatgttgtttttgtgaaagtataggaagaaaatctagccttccacagatacatagttggaaaaaagggaagcattttaatagtattttcagataattgataactacactaaaactcaacaaatggtagtttctgagaggttagctgcatgatggaatctggaaccacaaggaactttttggaatatttcattagggtttattggtataccttgcactttgaatggctttttaacacgtgtaatgttacagcatacattggttatttggaaaaattggtttcctgtcatacagttgaaacgttgttcattatacaagtttaaaaaaatcatattcattgatataactaggcctctcatccattgtggttgatatgaattttccaaaattaaatttttgcttgaaaagttgagttttatcattggcaaatacatgctgttagtttttcttaaagtgatgggcatgcttagtttatgtttaaaaaaatgtctgccagatacccagtttgaataactatagttgctgtcagatattctttcaagtaaaaatggtgtttcttgaaaaaagaggccatgtttttttttcttttcaacttttattctagattcaggggtacacaggcaggtttgttacatgggtatattgcatgattctgaggtttggggtacaaatgcatagtacccccaggtactgagcatagtatccagtagttagtttttcaacccttgccttcctctcaccctcatccctctagtagtacccattttctcttgttggcatctttatgtccatgggtactcaatgtttagcttctatttgaaagtaagaatatgtggtatttgtttttctgttcctgcattaattcacttaggataccagcctccagcagcattcgtgttgctgcaaaggacatgatttctttgttttttatgagtgcatagtgttccatggtgtatatataccacattttctttatccaatccactatggatgggcacctggattggttgcatgtcattgctgttgtgaatagtactgtgatgaacatgggagtgcatgtgtcattttggtagaaagatttctttcttttggatatatagccaataatgggattgctgggtcaaatggtagttctattttaagttcttagggaaatctccaaactgttgtccacagtggctgaactaatttacattcccaccaacagtgtacaagtgttcttttttctctgcagccttgccagcattggttgctttttgactttttaataatagccattgtgactggtgtgaggtggtatattcttgtgttttgatttgtatttctctggtgattagtgatgtggagcattttttcatatattggccacttctatatcttttgagaagcatctgtacatgtcttttgcccactttttaatggggttatttgattttttgtgaattgttttaagttccttatagattctggatattacaactttgtcagatgagtagttcgtgaatattttctaccatcctgtaggttgtctgttcactctgttggtagcttcttttgctgtgcagaagctctatagtttaattaggtctcacttgtcaattttgtttttgttgcaattgcttttgagaatttagttataaattattttccaaggccgatttctagaatggtgtttcctaggttttcttctaggattcttatagtttgaggtcttacatttagaactttaacccatctttgtaactgaatgcaagttcagtcactcactgcttgcagagtccagttaacaagagggaggtgtggtaggaagaaagtgactttgcagccaggtgcggtggctcatgcctgtaatcccagcactttgggaggccgaggtgggcggatcatgaggacaggagtttgagaccagcctgaccaacatggtgaaacctgtctttactaaaaatacaaaaattagccaggcttggtggtgcgtgcctgtaatcccagctgctcaggaggctgaggcaggagaattgcttgaacctaggaggcagaggttgcagtgagccaagatcatgtcaccgcactctagcctgggcaacagagcgagactccgtctcaaaaaaaaaaaaagtgactttatttccaaagctggcaaggaggaagtggcttgattcctgtccaaagcaatgattttgaattttgatgagggaaggcaagggtttaaaaaggtaaaacttgatatggaaggcatgtaagaattgtactgagtacaacgtctgtgtgtcttgttctgttggctttcttgggttccagtccacctggagcatgggctggagtcatctcaacaatggcaaggttgtggactagctgccttgcatttatcactgcagttttgcagctgggtccccaggcttggtctgtttgtctcaagattagcccctagaacttctaactaggcacataattagatactagcatacagttagatagatgtgaagggagtatatgcggtgagaaagggaaggacatgaagtctattttcaggctaagggaaaaggcttctgaagtttgcttcaaggttaggtcttgaatccaaagggaaaggaaaaaaaaagttttaaaatgtattttgaatttaagctgcccagttacatcttgagttaatttttgtatgtggtaaaaggtaggagtctagttcattcttctgcatatggctaccagttgccccatcaccatttattgactagggagtcctttccccgttgcttatttttgtcgactttgtcaaagatcagatggctgtaggtgtgtggctttatttctgagttctctattctgtttcattgttctatgtttatgtttttgtactgttgctatgctgtttggttactatagacttatagtatgggtgaagttctgtaatatgatgcctccagttgtgttcttttttgcttatgattgttttggctgttcaggctccttgttggttccatatgaattttagaacagtttttttctagttctgtgaaaaatgacattggtggtttgataggaatagcattgaatctgtagatttctttaggatgtatggccattttaatgttattgattcttgtattccatgagcttggagtgtttctccatttgtttgtgtcatctatgatttctttcagcagtgttttgtagttctccttgtagagatctttcccttccttgagtagatgcgttcctaggtattttatttttgtgtgtggctattgcaaatgggattgtgttcttgatttggcgttcagcttgaacgttgttggtgtaaagaaatgctactaattttatacattggttttgtatcctgaaacttaactgaagacatgtattagttctaagagtcttttggtgaagtccttaggattttctaggtataagaccatattgtcagtgaagagagatagtttgacttgttttcctgtttggatgccttttactttttctcttgagtgattgttctatacctccagtattatattgaataggagtggtgagattgggcatccttgtcttttctggttctcagggagagttcttccaatttttgcccatttagcatggtgttggctgtgagtttgtcatagatggctcttattattttgaggtatgttccctcaatgcctagtttcttgagggtttttcttttatcatgaagtcatgttggattttaccaaaagctttttccatgtatattgagatgatcacaggtttttgcttttaattctgtttattgtatttgtcaataaatcatatttattgatttgcatatgttgaaccaactttacatcccaggaatgaagcttatttagttgtggtgagttaacttttgatgagctgctgggttcagtttgctagtattttgttaaggatttttgctctgtgttcatcagggatgttggcctatacttttctttttttatcatgtctttttcaggttttggtataaaggcgacgctggcttcatagaatgagttagagaggagtcccttctcctcaacattttggaatagttttcagcatatttggaatagtatcagcactactttgaacatctggtagaattcagctgtgagtctatctggtctggggctttttttgggtggtaggttttttattactaattcaattttggaactcgatattggtctgttcagagttttaatttcttcctgattcaatcttgggagattttatgtttctaggaatttatccatttcctctagattttctagtttgtgtatgtagaggtattctaatagtatctgaggatcttttgtatttctgtgattggttgtaatgtcatctttgtcatttctgactgtgcttattggaatcttccctttttttctttgttaatctagttagtgttctatcgatattgtttatcctttcagagaaccggtgtttggtttcattgattctttttttcccccttaatgatcactgtcagaaaatcattgattctttgtatggatttttgggtctcaattttgttgtgtttcactccgattgtagttatttcttttcatctggctctagggttagttcttgtttttctagttcctctaggtttgatgttagattgttaatttgagatctttccaactttttgtggtaggcatttagtactatacagtttcctcttaatactgcttttgcttcatctcagagatttttggtatgttgtgtctgtgttttcatttatttcaaataattttttgatttctgccttaactttgttgtttacccaaaagtcattcaggagcaagttttaaaatttccatgtaattgtgtgatttggaaaaatcttggtatacatttgtttttgtttttgttgttgttgttttttgcttccaactgttattagtctttttattctcttggcaatgtcttccagagttaactacttctgttgtaggtgataaaaatgtataaggctctacttcagatgttggtactgctgtgagcgtggtctcttcctttactcaactgagaattaaaacttgattcttttttatattccagtcccagaagtaattccctctatagaagttatctaatgatagtcttattcatcctagtagtggcttacaaccaggctctaacctctccaggaatactataggatggatttagcataaacatatattaaactaaaaaggattctttcaaatgagtttaagtgcattttatttttagacaacctacttgacaagttttttgttttttttttttgacagagtcttactctgtcactaggctggagtgcagtggcgtgatctcggttcactgcaacctccgactccctggttcaagcgattctcctgcctcagcctcctgagtagctgggattacaggcatgcaccaccatgcccagctaatttttttatttttagtagagatggtgtttcaccatattggccaggttagtctccaactcccaaccttgtgatccaccagccttggcctcccaaagtgctgggattacaggcgtgagccaccacgccagccgacctgtttttcttaaaaacaatgcttccactccaaagatataatggtcgaaataaatgaagagctcaagttgacatcagtccaatttatcttaagtcattgtgtcatgtgggtgataggcagcaagcagttgtgatgacaggtgatagagccaaagtaattgccaattggttaacatttttccatttctaaaccatctttaaagaaaatcatatacagggtcacaccatcctcatggtagagcaactatgccatctggattcatgtttttactggtaaaaaactggtagttgttgaaattagtaagatgtgcttggtttgttctacagcttctgtcataaaaggttttactgtttaggtctctgttcttcatgttggcctttgattgattttatgtaatctttgatgtacttcttgtaggcttctttttgaagtttgtttcctgcaagtgatggttcatgacagtatcaacataagtgattaatgtgctttcggtaccctcaccctcagggccttctgcggaggcatttctgtcaatgttaccctctgtcctactgactatcttcttccccacccccccgtcccacttccaggcacagccagtctgcaatctcccagatattgtaaatgttggagaacagctcatcatggctgataaggtccgggtagataatcttgatggcagctgaagggagatgcggtggtgctggcttagcaggattccagagattagagtgaacatgatgcagctggagcagtgcttggtgggtgggaggagtgggtggaaaaggagatttctgtttttattcctctgtggtctatgagtatggttggtatgataatttttttgaacttattgagatttgctttatggctgagcatacggtcaattgtggagtatgttccatgtgcagatgagaaaagtattgttctatggccaatgggtggagtattctgtagatgtccatgaggtccaattggtcaagtttaaattcataatttctttgttagttttctgcctcgatgatctaatgttttcagtaggatttcaatagggggaagtcccccaccattatcgtatggctgtataagagttttgtaggtctagaagtacttgtttgtaattctgggtgctccaattttgggtgagtgtatatttaggatagttaagacttcttgtggaattgaatgcttatcattatataatggccttctttgttttttattgttggtttaaagtctgttttgtcttatataataatagtgacctctgctctttttttgttttctatttgcttggtggatcactcttcagccctttattttgagcctatgggtgttttatgtgcatcttgttttttatctaacttgccactttgtgcctttttagtggagtgtttagaccatttacattcaaggttaatattgatatgtgaggttttgtttttattgagaaggagtcttgctctgtcactcaggctggagtgcagtggcacaatctcagctcactgtaaccttcgtctccgggttcaagaggttctcctgcctcagcttcctgagtagctgggatggcaggcgagcataaccacgcctggctaatttttgtatttttagtagagacgggatttcaccatgttaccaggctgatctcaaactccttacctcaagtgatctgcctgcctcggcctcccaaagtgttgggattacaggcatgagccactgtgtctctggctgatatgtgaggttttgatcctatcatgaaattgttagctggttgctttgtagtttctgttgtgtggttactttatagggtctgtttataggcctaagtgtgttttcatggtagctggcatcagtcttttgtttccgtgattagaactcccttaaggagctcttgtaatggtggtctagtggtaactaactcctttaatgcttgcatgtctgaaaaaacctttatttctcctgtgcttatgaaacttaacttggcagggtatgaaattcttggttggaatttcttttcattaagaatactgaaaataggcccctagtctctcctggcttgtaaggtttctgctgagaagtctgcttttagcctaaagggtttccttttgtacaggatctgacctttttctctagctgcctctaagattttttctttagcattgacctttgacagtctgggagggcaggggccatgaagagtggggccagattgggcacatccatctacaggtcccccagtggcaggtacaagcactgaagctgagggagaatccagtgggcagccaccaggtgcccagaggtatatctaggcatggaactgggaaacctccttggccccaagttctctgcacagtgatgaggggcagcctaaaattctaatccagggtagtgagtgctccagatatctggagatctgcctgggcatggagtggagagggccttcctgcatcaagatctctgcataggaggggtgggatgactcaggctagtggaccaggcaagcaggtgctatgaatacctggagatctgcctaggtgtgtagcagagagggcccccttgcaccaggatctctgcacaggaagggtggagtggatcaggctgttaatcaaggtgagtgggtgctccaaaggtctagacatctgcctgggcatggagtggagatgacccttctgcagcatgatctctgtccatgaaagatgagtggctcaggctgctggtcacgcaagcaggtgccctgaatgcctggatttctgcttggggggtggagcagaggggaccccacttcacctcgatcccaggggaacagcaggggcaccaagtgatggcacatgcagttcagtttcagattgccaagctggccctggctgcaagtctcattgcccaggagagactgcaactgtagcagctctcctcccactccaggcttgcaatagggaagagtataattccaatacctacttctgaggtgctttccacctcagaagtggtggaggctgtggaggctactaccctgctccagagcaggtgcttcagtctgtggcgcaagagtaaaatgcttgtatggccatgcagctgggttacctagaatggctgactttgtatgcaaccagattaaaaatggcatcctgtgcttggtcctatgtctgggaaagtgtctgcagcttctcctagtgtttttccctcacagcgtctccaaccctttccccaagttagcttcagggattgggaggaaaaaaaaagttctccctcagcctgagttgctctgatctcctgtggaaaggtgagtcactgagggaggctgtctttctctctcatgtactggggcttcacttacttttatcagccaaatgccatcacagtggctgtttggcaggattctcgtctttgggatttggagtatcctgcatgattccattagattctcattttccttcttgaattaaagctcaaaccattgatctttatttactattttgttatttccaaatggtggaggcctgctaacaggctttaatctgccacctgaggaaaaaaaggctatattaactcccagcttaaacaatgacacaaatgcttttccttgtacttttgcatgctgcagaaatgctttatccttctatttcatctcgtaaaatattaaaaggaagtatacttgctagttgaaatttagtataataattcttagattatgcaaaggactttcttaccttaagtgaaatatctttgtggttgttcctgctgtttttgtctgttgtgtttttttaactgtgagtagcaattgagaataaagtgaccacttgcaaggtttggtgctactaacttaattcatgctaagatgtctacagttttacttgttattgcttttgcatcatcagttcaaatgtcaacaaaaccaaataaaaatactaaatgagaaaaaggcatactttgtcttggtatcatgaaaatagttttgaccttataaacaccctgaaaatggtcttaggtagcctcagtggtttgtatattacactccgagaactgttgttctgcatgtagggtgactatatgtaatttataatctagttttgagagagagacaaatggggttctattaataattacctcagaataacaggtgtaaactgggactgtcctgggcaaattgggacgtgtagtcaccctatgattaccttatttctaggggacttcaagtcagcttctgtatttggtcttcatgtcacatgatctttttaaaatgatactatcagtcatgatggaaggaagggaagggaggaacagggacactgagaggtttgtggttgctttcatatttgagcattaaaactcctaaagtataggtgtaaactgtatgtccgattgttcttgaacttagatgtgttgaaaatttcagcaatgtggttggttctttaggtgatttgagagttagaatattgtttggtcatcaggagacatcttttatgctaatgcgtattcacaaagaagaaattcacctgtttctatatttcctgaatcatgtaattttattattaaaatttggattggttcaaagaagatccaagaatcataaaactataactgccgcaatgtatcaaagaatttttgatggtgaataagaaacaatacacttatgaatgtggatattgttatgccatgttagtgtattataacattcttaaaattatgtttgtggagttgaattcttgctatgttaaaatttattgttaaatttactatttctaatgagaacaaagatacaatataccagaatctctgggacacagctaaggcagtgttaagagggaaattcatagcactaaatgcccacatcaaaaagttagagagatctcaaattaagaacgtaacatcacaattgaaagaatcagagaagcaagaacacttcagccccaaagctagcagaagacaagaaatgaacaaaattagagctgaactgaaggaaatcagggcacaaaaaaccattcaaaagattaatgaatccaggagttggtttttgaaaaaattaataagatagataggctgctggctagactactaaagagagaagatccaaataaacacaattagaaatgaagggaatgttaccactgaccccacagaaataaaaataaccatcagaaaccatcagtctagctgctggctagactaataaagagagaagatccaaataaacacaactagaaatgaagggagtgttaccactgaccccacagaaataaaaataaccatcagaaactattgtgaacaacacctctatgcacacaaactagaaagcctagatgagatgaataaattcctgaacacatacaccctcccaagacttaacgaggaagaaattgattccctgaacagaccaataaggaactccaaaattgaatcagtaataaatagcctaccaaccaaaaaaagccaaggacctgatggataaacagctgagttctacctgatgtacgaagaagagctgctactattcttactgaaacgatttcaaaaaattgaggaggaaggactcctccccagctaattctgtgaggccagcatcatcccgataccaaagcctgggagagacacaacaaagaaaccttcaggccaatattcctgttgaacatcactgcaaaaatccttaacaaaatacttgtaaaccgaatttagcagcacatcaaaaagctaatccaccatgatcaagtgggctttatcactgcaatgcaaagttggctcagcatactcaaatcaataaatgtgattcatcacataaacaaaactagacagaaaccaaatgcttatctcaatagatgcagaaaaggctttagataaaattcaacagcctttcatgttaaaaactctcaagaaactaggtattgaaggaatatacctcaaaataatacaagccatctatgacaaacctacagccaacattatactgaatggggaaaagctgaatgcattccccttgaaaacagcacaagacaagcatgccctctctcaccactcctattcaacatagttttggaagtcctagctatagcagtcaggcaagacaaagaaataaaggacatccaaatagaaaagaagaagtcaaactgtccctatttgcagatgatatgattctatatgcagaaaactctatagtctcggccgaaaagctccttcaggtgataaacaacttcagcaaagttttggatacaaaaatcaatgtacaaaaatcactaacattcctatacaccaacaatagccaagcagagaggtaaaccaggataacaaaaagaataagacacctagcaatacagctaaccagggaggtgaaagatctttacaatgagaattacaaaacactgctcaaagaaatcagaagacacaaacaaatgggaaaacatcccacgctcatgggtaggaagaatcaatattattaaaatggccatactacccaaagcaatgtacagatgcaatgctattcctatcaaattaccaatgaaattcttcacagagctggaaaacactattttaaaactcatatggagctaacaaagaacctgaatagccaaggcaatcctaaacaaaaaggacaaagctggaggcatcacattacctgacttaaaactatactacagggccacagtaaccaaaacagcatggtactggtacaaacagacccataggccaatggaacagaatagacagccaggaaataaggctgcacacctgtagccatctgacctttgacaaagtcaacaaaagtaagcaatggtgaaagcactcccaataaaataaatggtgctgggataactggctagccatatgcagaagactgaagctggacccctttcttacaccacatacaaaaatcaactcaagatggattaaagacttaaatataaaaccccaaactgtaaaaaaccctagaaaacaacctaggcaataccatcttggacataggaacaggcaaagatttcatgacaaagacaccaaaagcaatcacaagaaaagcaaaaatttacaagtgagatctaattaaacttaagagtttctgcacagtgaaagaaactatcaacagaggaagcagcctacagaatggaagaaaatatttgcaaactatgtatctgacaaaggtctaatatccagcatctataaggaacttaaacaaatttacaagagaagaacaaacagtcccgttaaaatgtggataaaggacatgaacagacacttttcaaaagaagacatacatgcagccaacaagcatatgaaaaaaagctcaatattactgatcattagagaaatgcaaatcaaaaacacaaggagataccatctcacaccagtctgaatggctgttgttaaaaagtaaaaaatgaacagatactggtgaggttgcagagaaaaggaaatactgatatactgttggtgggagtgcaaattagttcagccattgtgtaaaacagtatggcaattcctcaaagagctaaaagcagaactgctatttgacccagcaatctcattactggatattctcagaggaatataaagcattctaccataaagacgcatgcgaatgttcattacagcacttttcacaatagcaaagacagggaatcaacctaaatgctcatcagtgactgactggataaaggaaatgtggtacgtatacaccatggatactatgcagccataaaaaagaatgagatcatgtcttttgtgggaacatggatggagctggaggctattatcttcaacaaactaatgcaggaaagacagccaaatactgcatgttctaagtgggagctagatgatgagaactcatgaacacaaggaaacaacagacactgggtctacttaagggtggagggtgggcgggggcagaggagtagaaaagataactactaggtactgggcttaattcctggataatgaaataatctgtaaaacaaaataatctgtaaaatctgtgacacgagtttacctgtggaacaaaccttcacatgtacccctgaacttaaaataaaagttaaaaaatttagtatttctagaacatacacatgaagaccaaagttatgacacttttagtttgagtaaaaatatatactcatttaaaacttactttgttattaaaaccatcttgaatattaaaatttgtttgatgcacatttaaaggtataacttgtgagcatataaaaataagttattatttttatatgttcaagtatataacttgttagtttagtatcaaaattaagtaggagctgcatgaaacttcattataaaactgttcaatgcttttattccaatgtctataaagaaactttaaaaactctcttattgtactgtttgatttatttaaatatagagaattatcttacaggatttattgcaaggtacctaaaagaggatgattgttgctattttttctcaaggaattcatttaattgctttagacaatgtgttaacagatttttatttcctctccggctattacttaagctgcagcagcttaagctttgctcacttcagctaatgaagactaataccactgtgttcctgccagttcaattctttctaatttagcttttctaaaataatgcctgttaataagcaaggtcgtagatgaacagaggataaaaataattctgtgcttcattaaccatcaatctgtagcctttcttctgttgtcttaacgtggaaggaatggttagtttaaaaaaatgtttgcttttatgagttgtttgttttatgtgacggagccattctaatgtcaggaacagatctttggggcaattttccttaatgcagtttgtgaaaaacaggccataataaatattacattaacatataaacatgctaaagtttgtgtttttattaaagatgagggaaaatgacattctaacagctatatttagtcatgttcaggtaaaatgaaccttgagtatctaaggtatatggttacattgatcaactaagatccttctactgtagttattattttttctttatgcttatttttaaatgatagattacatttacaactagctggtcaatctttgagatgtattataaatgaaaggctggttagcatagaaaactggtagataataaaggaaagatatatgggactgtaggtctaatgtaggtcgagttgtcattctggggatttgttttcttacatatttttagcaattgtacctgttttattgcagagacttgaggagacatgttcttattcatttgttcctaaaactgttcaggtgtgcttgcttacttgaccaaagtactgtaaataacttttcataaaataatgaattggaatttatgttgaacctatacaatttagaatgggtttatgttgggttaacatatttatgctcaatattatagtctcacggaaatgtgccactttaataaatatttaataaatattacttgacttaataaggacaatctaggtgttttgttatggatttccaaagtacagtatagttgattacaatgagatattttctttcagcacttaaaggagtttatttgtaaagtctttatgtgaagttgttgcaaaaaatataattactttttaccgcacttggaatcaggaagtttagaattcaccatggtttaacctgttagtgatagaaaatattttttaaaaataagctatatttagtgattttattaaattggtaaattctaatgaatgtatatttattttgtttcctatgcagcatcattagttattcctgctggtagaactcttccaagttttaccacagcagaactggtatgtagcttacttaaaatatattttaaaagacatgtcccactgttagcgagtggtggcaaaatgctgaacatagatgtaatttcttaccctccagttgaaagtgaaaagatgtggccgggcgcggtggctcacgcctgtaattccagcactttgggaggctgaggcaggtggattgcctgagatcaggagtttgagaccagcctggccaacatggcaaaaccctgtctctactaaaagtacaaaaattagctgggtgtagtggtgggcgcctagtaatcccagctactcaggaggctgaggcaggagaatctcttgaacctgggaggcggaggttgcagtgagctgagatcatgccattgcactccagcgtgggtgacaagaacaaaattctgtctcaaagaaaaaaaaaaaaagatgtggtaaagagtggggtgacagaatagcatctgtagcatagatgtaataaaacgcagaagttccagaattgacattttcttgccaagttttcctgtctttcagagcagttgttagcatcttccaagactgtacctacaaggttaggaaatgtctgaagttatgttgtatggggttttaatacactatataatgttatatgcttgttacatcctaaataaataattttgaggttttttttcagattttttttcccctctagaatggagcaacatcatagttttgactttaattaaactggaatatttttgtcattttgtaccttcgtgaagtatagcttgtttatattttcccccttagtacttgaaggcagaagatacatttacaagttaacatagaaaaccaagtagtttttcgggtagagaagaatagcagcttttcacttttatctttcttccatggtactgagagtagtacataatctactaactgttttttaattttctttcagcccataggttgcctttgtagggcaaatgcttagtgggctagttatttccatttcttcactaagaacagccaaaaccacacaccttaataggatttttggaaagaatggtgctgcttttgataggagaccaatgaagaaatacctctgcctttggaattcaaacaaatattttttttcctgttaaaataagtaataagcttgtattaataaaaagtaaaaatgggctgagcacagtggctcacacctgtaatctcagtgctttgggagactgaggtactgggcaccatagcaagaccatattaatacaatttttttttttttttttttttttgagacagagtcttactctgtcacccaagtctggagtgcggtggcatgatctcggctcactgcaacctccgcctcccaggttcaagtgattcttctgcttcagcctcccgagtaacgagattacagacgcccgccaccatgcccaactaattttttgtattttagttgagatggggtttcaccatgttggccagggtggtctcaaactcctgacctcaagtgatccacccaccatggcctcccaaagtgctgggattacaggcgtgagccaccgtgcccggcctgtacaaaatttttttaaaaaaattagccaagcatggtggtgtgtgcctgtagtcctggctacttgagaggctgaggcaaaaggatcacttgagcctcgtaattggagattacagtgagttatgattgcaccactgctcttcagcctgggcaacagaatgaaaccctgtctcttaaaaataaaaatgcaaaacatttataaataaaataaagagttctgtagtcttatactccaagaataaatgttttaactctttgatgtttattcatccagacttctttcatgaaagctatattagtttttaggataaaaagtagggatactctttttactgtttctgtaatttctgttttctaatttagtaatatagatggactgctttcaatttcagttagtacaaattgaccttcgtggatgcagcacagtttaattaacaaacttttgttggtgaacatttaaattatttccagcatttttctaatatagtattctattgattatgcttgtgtatatgtctgtgtgtttctgtgataatcaggataaatttctaaaagtagagttcatgggtcaaaggtcatttgtattttcatttttggtatatatattgcaaaaattatcctccaaaagggttgtaccaatatacattcatacaaacagtagtttgagagaaccaatttttatcacattctcaacaacactggatgttatcagtctttcaaatttttgcaggtctgagaaccaatggccctgcaaagctatgtcttgggcaagttttttgagttaatgtttatactgttcattaggacttactagcttcattgctaataactgtagaataggattcctcttgatccttaatgggatgatcgatattgaaaactattttattcaaagaactcagccctaatattaaatgttaagtattgtcaaactattgtccagaatcagattttttgactccctgtgagatcagggaaaaaaagatacaagtaaagtccttttctaactttctaatataaatttcttatatctagggcacttcaaactccagtgcaaactttacttttcctggttatcccattcatgtaccagcaggtgtgacactacagactgtatctggtgagagtatattctaagaatctttttgttttcagcattggtactattttttggacattaagcttcatgatttttaaataaactatataccagaagttataagaacttttaataaaattgattttaaaagtaatgataaatggtggttttgattgttatagagacaatctaccacaaaaggcactgtactaggcctgtcctatatttgattcccagttctctttcccaacattgtataggggttctttgtatatattttttctaattcaagtcagttatctaaattttaacaaatacaaaataaaataacttacctgcattcctgctagctctaattacggattaaagattaggatgatcaacctttgccccctttcttattagggattgcatggtctgataggacatccaatagtttggaggttaaccggtttctgcttttccgagcaccatctcttgattttgaagaggatcatacctcttctttgggttgttgtaaagtttaagtaaagcacctaactcaacactcaaaaataagtccttttttttgagatggagtctcgctctgtcgcccacgctgtagtgcagtggcgcaatctctgctcactgcaagctccgcctcctgggttcacgccattctcctgcctcagcctcccaagtagctgggactacaggcgccggccaccacgcccggctaattttttgtatttttagtagagacagggtttcaccgttttagccaggagggtcttgatctcctgacctcgtgatccacctgccttggcctcccaaagtgctgggattacaggcatgagccaccgcgcctggcctttttttttttttcttttatagtgttattttagaggaagaaaggagaagaaatttgattacttttgaaatcattaaactctcttttggatagcattgtcttgctatatggcattttaaatatatgaagtatattttacatgattatgtttgttaaaatccagttttttggctgataacattaatttatcaaacaatggaagaggttcatggattaaatattggtgtcctttatgtatctcaaagtgtgccataaaagcaattgtgggaaaagtctggaattaaagcaaaacatatgtaattaaaaaaataagaatttatatattgattgtagaaatccaaaaatgtctgaagaataaaagaaaaacccctagagataaccaccattaacatattggtgtatttttttccagcctttgtggatgagatttttttttttttttgtggtggttgtcaaaggaaattttaattctattatacttacaattttgctttctcctttttaaggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggtatagttctgtgtccaacttcttggtatcaggggacagatagtggccagtaactggatatcctgaatattttcaagctgtaatgttaatcagaattatatatattttgtttttttctttagaagattatttcttttttctagtgatttaaaaaaatttttaattgtgataaaatacacgtaacataaagtttaccaacttaaccatttttaagtgtacagatcagtagtgttatatacattcacatgtggtacaaccaagaagattctttctttattgttgtttttagtataactgtcagtccttgaaatattcatgcttagcatttctaaatttttcatttcaataaatgaattataatacttcttcagagaaaatgcgtttgttttaaaaggtaatctgtttaccagtctcttatactgggaaacttattttatgtctgcagataaaaattaaaagacccagaaatccagaccagtagtttgtggaatgttttgagataattaattatcaaatgtaatatacaaaagaagcccacaaagttttttttttcctgctctacctaatttttctgaattcctatatggaaacttttccctacatgagggattatgttgctagtaattttgtttctccctgcctactaaaatactagttttacttaatttcttttggtattgaaaccactaaaaattagcttctagttaacttttgatattgaaaataggtctgaatttttaattttcaaggaattcatagtaatggcagaaagactcatggagaattttggattataaaaattaaaaaaattgcattctttttacaaatataaaatacatcttgtggctaattctatttacacaatttaggacatgtgaaaaatacttaaaggtttttgctccagctagtggtttagccatcatctagacccactgtacaaatctgtagcaatggatagttaagcacaaccttaatattttatcttcatgatatttaaattttgctagttagggaaagacatagggcatagtgaaaggccaggaacaaagaaaatgacaatcagaaactatttggcctgttttagaatgtttcagatatttattgaaacctgttcaagatctctgagcaaatctgtttttagtttttctataagtgttcatattaaaatgttttattgaggttttttttacgttttttaacataacatataacacttagtaaataaatgtaggttaaactaataagtatgaaacatttgattttgaggtaaaactaactacaaatgtaaaatgtttgttttcatcactactacttttggaggcactttttacctggattctgtgtgaattttgcagatgtttggtgtgatgagtcaaggacttattctactgttatgtattgtatgtcatcatgtactttttctgatatggggaaatagattagttaagggatattaatcaaggattgattgggggtagtggttgagaacataagctttggaaccacagtaggttcaaattctaggttcactacttgcaagcaaactatataacattactccctgaaattcaattttagtctttaaattggcccctaataccaatcttgtaattttgagaattatcagagataatatatatgaagtatttaaagcttctggcaccatagtaagctttagattagtgctattatgctctatgagcttgtaatatattgggtaacttttcatgtaacttgtttgttagttttaaaaaaggtctatgtctaacacacaaaatccaaacgtacaagagtatatgtaaaatgcttatttatttattgtaagttacctttaagatagtaagcagtttggtaggtttatgctgaactaattttcaaagactttacaagtagtttttctttttataagtaacttaaagcaagttataatcaactatacttgtttacttttcctgtgttgtaaactactggagagcttatggatctataggtttaagaggtaaggatctatgttgtttgaacattctgtttcacaaaatatattcttgatagcttttaattctgccccttgtaatttctgttctattttctttgtctgaatttgactcttctaggtactttaaaaatggaatcatacaatatttgcccttttgtgactgtcttatttcacttagtataatgttttcaaggttagtcgatatcgtagcatgtgtcagaatttcattcctttttaaggctgaatcatgtgagtttgacaatttttaaattttgtaaatattcctggaatctgttccttcatctccactcctagtgccattgccctaattgtttctcatgtgggataattttatctaactaatttatcagtgtgtagtctcttctacctcttactctgctcctgccaatccatccatcctagaggtcaaaggcctaagcttcagggatcagaattgttttgaatcccttctctattccttaataattgtatgacttagagaagttactcatttgtaaaataaagataatagtatctaccatgtaattgtggtaggattagttaagaaaattaatgtaaagtgctcagcagcacactggcaccgtggtaaatgctcagtgcatgttagcactctcttcctggtggcttccagagatctgtcccaaatgcagcctggttgtgtcttttctccacttaacacatcaccgactgcccttcacctataataaataaacttcaggcaccttaatatacatatacaaagcatattacgcgttctttctctgccaaagtttcctatttactcttccttcctcacatgaatatactttactgggaacaccaaaccgtgagtgattcttggttttcaaccttgttatttcctacttctctttttgctttttgttatcccctctatttgatgcctggagtttcttcccaccatcctttcctctggttaattcctgcttattcattacttcctccagaaatcttcagtacttctccacctaatttttccttcattattaaattggatgtagctcttctgttttgtcacctgaagtatgtctgtcataatgtagttcaaagatacattgatatgttctctttgcattgacagttacatttatctttgtatatgcagtaatctaagaatatatacacactcgtgtgtagtggagtataagcttttaaggataggatctagaattacgtttatttggctcagtggttctgaatcctggctgaatgatcaaatcattgggccattaaaaaaaagtgcaggtctaccctaagagattaaatctaattgatctggaatgaggcttagtcatcaatatttaagagcttctggagtgattgtaatatatagtcaaggctaagaaccactgatgtagctcaaaatcaatgtatgagtgaaaaatggagtgagaggataagagaatatataacttctaagtaagagttttcatttttcttctaagtccacacatattcctctaaaatataaaatgtcctatcaataattgactttagaattcatttaaattgagtaaatactttttgagtctctatatgccattgtgaaattaatatatcaaaatcagagatgtttaaaccagatatgtgactttttcttcattataagaagaaagccaatttaacaaaataattttttatatctgtcaaaatatattaagatatatttcattccaaataagagtggagtggcatgggatgctactgtacatggtcaggcaatatataattatcattgttactctattgtaataaattaaattcctgttaagaattaaagaaaatatgccctgccattacaattatagaccactgaatttgatatagtttacgttgaaaatgtgaaaagaatgtgtattgtaggttaggcttatcttgttttatatttatccccacatatgggtatgaagttctgcaaatttttactagccattgggaaaatagggttctttcattggagggaagcttaaattgcaaagactggaagctggatttggcgaacaaagctttatcatgaagcatcctatttacttgcttattgtactacccagtcacagaagccacatacaatcaaagacaccttggttaagctgagaatattggacattattgagctggtttgttttagtgcagagaaaataaaaaaaaaggaagcatttcctctgtcagatgacatcatctgcattagaattgttgacatttctttcacgtttggctggaattcatagatgtatcagcagcgactttcctttaacattcaacaggctaaaaataccagtgtttcttagggctgccaacatctgattttaatcattatttgtacattgataccatcaaagaatttttatgttgtgagttcttttttttttttttttttaaattggaaactgacatctttgtaataatgaaaagtttggttagtaaaatttggtactctataccattggagctcctgagatgcttggcaaacatggttttgctgctttagtaaagaaagcgttgctgtctatttcagcacatggcatgcattagtgctaagacacagccaataattctaaaagaagtctcatctgctgacataaaactcaaatatattagagccacggttttgaattattgtgtttcccaagacatttatcaaaaaatgtaggcagaatattaaattcttcatgcagaatttttctggcttttcaaaggacaatgcttgaagcccttgtttgatccttggggagacatttactatttttgagagggagcaaaagccccctcataacaatttgatctagaggagttcattgatgatctatgtggtggacgtttggctatatgaaagacttaaatctttgttttcatggtcctgtggtatcagttatggatgttgctgtacaactcctggctattttggtcaaattaccacttcagaagagattggagtcagataatcatgtgaatttttcaatgcctggtggaagtgcttctgaagaaaaaagttgagaatgataactcttttgctgttttgaaattaagtttagatttgtaattttaatcctctcccagagtaaagagggcctcactgattgaaggaaaatggtatgaggctacgtaaattcaagtagaagagtcctggaatcttcagtattcctttataagcttatccttgtctggcaaggtaacatagaagctctgattcatttttcaacagaagatcttgtggcttaaagttttcagtacttgttgctattaaaatgaaaagccaggccgggcatggtggctgctgcctgtaatcccagcactttgggaggccaaagcggatggatcacttgaggttaggagttcgagaccagcctggtcaacgtggtgaaaactcgtctctactaaaaatacaaaaattagcggagtgtggtggcaggcacctgtaatcccagctactcgggatctgaggcaagagaatcacttgaacctgggaggcggaggttgcagtgagccaagatcgtcccactgcactccagcctgggcaacagagcgagaccccatctcaaaaacaacaaacaaacagccaatttcaacatgtggtttaggcctaggacaaatcttatactaattgactttattattattatcatttatttatttttgagatggagtctcgctctgtcgcccagactggagtgcagtggtgtgatctcggcgcactgcaacccttgcctcccaggttcaagagattcttctgcctcagcgtctcaagtagctgggattacaggcctatgccaccacgcccagctagtttttgtatttttggtagacacgggggtttcaccgtgttggccaggctggactcgaactaattgactttaaaataactcaaatttaggccgggcacggtggctcacgcctgtaatcccagcactttgggaggctgaggcgggtggatcacaaggtcaggagatcaagatcattctggctaacatggtgaaaccccatctctactaaaaatacaaaaaattagcctggcgtgcggctgtagtcccagctactcgggaggctgaggcaggaggatggcatgaacccaggaggctgagcttgcagtgacccgagattgcgccactgcactccagcctgggtgacagagccagactctgtctcaaaaaaaaaaaaaaaaaaaagtaaaataactcaaatttaaagaggcatgatatatatacaataaaattcatcttttaaaaggtagcttttagatttaccatatgaattttggcaaacatgaagttatacaaccctacctgagatagagaacattttcattacctcccagtttcctcatgtgcctttgtagtcaataccctctttcaacccccagttcctggcggtcactcactgacctgttttcttttggggtaggtttaccttttccagaatattagacactatcatgcagcatgcatttttagcacaatacatttgagattcatccatgttgttgcatgtatcagtatattccattgtatggttataccacatttatttaccagtttgacatttgggttgtttccagtttttggtatttgtgaataaagcccctgaaagggccgggcactgggtgatcccagcactttgggagactgaggcggttggatcacttgaggtcaggagttcaagaccagcctggccaacatggcaaaaccccatctctactaaaaatacaaaaattagctgggcatggtggcacacacctgtaatcccagctacttgggaggctgaggcatgagagagaatagcttgaacccagtgagctgagatcatgccactgcactgtggcctgggagacagagtgagactgtgtctcaaaaaaaaaaaaaaaaaaaaaaagaaacagccccgaaaacatttatatgtagattttatatgtgtaaatacctaggagtgggattgttagataagatgataaacgtatgcttatgagaaacagtcaaactcatttccaaggtggctgtatttccaccagcaatgtatggtggaattttgcatttctaccagcaatgtataagatttgttgttggtacaccacatccttggtagttaacactatcttttggtaaggagaagtttttaattttgatgaagtccagtttattatttttatcttccagtttatttattttgactttcagtcccgtatattattttgacttctgcttcatgtgtcttatcaaaggctgcaaagattttataatacttctaaaaactgtatagttatagttttgtcatttaggcctgtgatctattctgggctagttttgtatatggtgcaaggttaggatggaggttcatttttttttttggagacagagtctcgctctgtcgcccaggctggagtacagtggtatgatctcagctcactgggttcaagcgattctcctgtctcagtctcccgcgaagctgggattacaggtgcccaccaccatgcctggctaattttttgtatttttagtacagacagggtttcaccatactggtcaggctggccttgacctcctgacctcaggtgatccccctgcctcagcctctcaaagtgctggggaaacaggggtgagccaccgtgcctggatagctcatttttttttacatatggatattcaattgttttagcattgtttgttaaaaagactgccttgtctcactgagttagctgtctgtgcacattatgtatctaaagcacttcacctttagtgaaaattactacatctgtgttggtttattactgaaggttcactctgtttcattaattcatgtgactatctttttgctaggaccacactgtcttgattatggtaaatttatagtaaatcagagagtgtgaatctctcaaatttgttcttttttccaaattgtttgggctattctaattcctttatatttccatataaatattaggatgcgcttgtcaatttctaaaaagaaaaattgctaagactgatttgggtttgtgttgaatctatagatcagtaaggggaattgacgtcttcacaatattgagtcttccaattcatggacataagttttttttttaatttaggtttttgacttctgttactaatattttctagtttttagcatatacatattatacatattctgttatatttttatctaaatatttcatggtttttggtgctattataaatggtacctaaaactgccatcaagaacatttttattcttatttttaagcttcatttgcattgcatttttaaaaatatatttttatttttaattagttaattcattagtttgtagagacagacagagtctcactgtgttatccaggtttgtctcaaatgcctggcctcaagcacttgtctcactttggcttcccaaagtgctgggattatagacgtatgagccaccatgcccagcctaaaatacattttttaaaaggtagaaaaaactgaaaatttctaaggcatttgaagtacattgccacaatattttaaaaagaggttgtgccagtttttcctgccaccagtactttgatcagttttgccacatagtatagtatatcactactgatttttaaaaattcaatttttctcctgtgctaaagtacacataaaattaactatttattttatttttaaattatttttacaatttttaactgtatagcttagtgacagtaagtatattcacattgttgtgtagctatcaccaccacccatctctagaaatttttcatcttcccaaactccatgcccattaagcagtaactccccatttctcactctcccagtccctgacaaacaacaattctactttccatctctatgaatttgaccactttagttacctcatataagtggaatcagacagtacttgcccttcttcatttagcgtaatatctcagggttcatccatgttgtagcatgtatcagaacttatctccttgttttaaggtgaataatatctcattgtatgtatatactgcattttgtttattcattcaagtgtctgtggatacttgggttgcttccagcttttggctattgtgaataatgctgctgtaaacatggcgtacaaatatctcttcaaattcctgtctttaattttttcggatatatatggagaaatggaactgcaaaatcatatgacaattctacttttaatcttattaggaactgccatacagtttccatagaggctgcaccagtttacattctcaacagtagtgcacaagcatctgatttctccatatccccaccaacgcttattttctgtttttttttttttttttttttttttttttaataattgctaccctaaggggtttgaagtggtatcttgtagttttgatatgtatttccctaataattagtgatgttgaacattgttttatgttcttctggccacttgtatgcattctttgtagagaagtctattcaagtcctttgcccatttttttaaaattggactgtttgctctgttgttgttgacttgtagttctttatatatcctggatattcacctcttatcagatgtatgatttgcaaatattttctcccattttatgggttgcctttactctctgttaataatgtcttttgagcacaaaaggttttgattttggtgaagtccattttatctatttttttcttttgttgcctatgcttttggtgtcatatccaataaattattttcaaatccaatgtcatgaaattttcaccacctgttttcctctaagagatttatagttttagttcttatctttagctctttgatccattttgagttaattttcgtagatggtataaatttagggttcaactccattattttcaatgtggtgctagttttcccaaaatgatttgttgaaaagactgtccattccacattgaatggtcttgttacccttatggaaaattgacgttttatgtaacggtttgttgctgggatctttattttattggtgtatacacctgtctatacattaataacacactggttttattttttaatttttattatttatcgtttcagcttttatttaagattcagggagtacatgtgcaaggtttgtgacataggtatattgcatcatgctgaggtttggggtgtgattgatcctgtcatccaggaactatgcatagtacccaaaacagttcttcagcccttgccctcacttccccttctccctttttggagtccccaatgtctattatttccaccactgggtgtccgtatgtgcccaatatttagctcctatttgtaagtgagaacatctctttatggttttctgttcctgtgttaattcacttaggatgatggccttcggcagtatgcatgttgctgcaaagaacatgatttcttttttttggggctgcatagtattccacggtttatatgtaacacattttctttattcagtccaccatgtatgggcacctgggctgattccatgtctttgctattgtgaatagtacttcaataaacataagagtgcaggtacgtttttggtagaaatatttcttttcctttgggtatatatccagtaatgggattgctggattgaacggtagctctattttctttgagaaatctccaaactgctttccacagtggctgaactaatttacattcccaccaacattgtacaaacattccttttcctctgcagccttgctggaatctcttgttttttttttttgactttttaataatatccattctgacttgtgtgagatgatatcttattgcatttttgatttgtatttctctgatgattagtgatgtggaacattttttcatatgtttgttggctgcttctatatcttcttttgagaagtatctgttcatatcatttgcctactttttaacgtggtcatttgatttttgcttgttgaattgtttaagtttcttataaattctggatactacaactttgtcagatgcacagtttgtgaatattttctctaattctgtagattgttcactctgttgatagtttcttttgctgtgcagaacctctttagtttaattaggtctcacttgtcaattattgtttttgttgcaatagcttttgaataattagttataaattatttcccaaggctgatgtccagaatggtgtttctcaagttttttctaggattgtttatagtttgagatcttacatttaaatcttcaatccatcttgagttaagttttgtatatggtgaaaggtaggagtccagtttcattcttctgcatatggctagccagctatcccatcaccatttattgaatagggagtcctttccccattgcttatttttgttgactttgtcaaagatcagatggctttagatgcatggctttatttctaagttctctattctgttccattggtctatgtgtctgtttttgtaccagtgctatgctgctttggttactgtagccttataatatgggttgaagttaggtaatgtgatgcctccagctttgttctttttgtctgtgattgttttggctgttcaggctccttgttggttccacattaattttagaatggtctagggattttttttggctggtaagttttttattattgattcaatttcataattaggtattggtctgtttagagtttcaatttctttctgtttcattcttgggagattgctttcaggaatttattcatttcctctagattttctagtttgtgtgcatagatgtgtttataatagtctctgaggatcttttgtatttttgtgggattggttgtaatgtcacctttgtcttttttattgtgcttatttggatcttctctctgtttttctttgttaatctagctagtgcttgcttgtatgaaaaagctcttatatctccttaacttatgaagcttagtttggtgggatatgaaattgttggttggaatttctttcctttaagatgctagaaataggcctacaatctctcctggctggtaaggtttctgctgagaagtctgctgttaatctgatgggtttccctttgtacatgacttgacttttttctctagttgcctttatatatatattagcagtgtccttccatagtctggtaactatacaccttgataatgttgattttgtatagtgtcttgaaggtgttctctcaatttcttgtatttggatgtctacctttctagcaagattagggaaatgttcttgaattattccatcaaatatgttttctaggttgtttagtttttctctttcaagaatgccagtaattcatatatttgattgctttacataatcccaatatcacactatttttattattgtaattttgtagtatgttttgaaatcaagaaatttaagactttcaatttgattcttctttttcaagattgttttggctatttggcattccttgagatttgaatttttggatagatttttttctttttctgcaaacactcttgttgggtttttgatagagattgtgttggctctttagatggctttggataatattcacatcttaaccttattaatttttgaatccatgaacttggggtgtctttccattgatttttgtctttattttctttcagcaatttttgttgttttcagcatatacaagtcttttgcctctgtggttctgtttgttcctaaataacctattctttttggtgctattgaaaatgaaattattttcctaattttctttttgagtttttaattatttgttgaaatgcagctgattttggtgtgttgattttgtattctttaacattgtggaatttatttatttttcctaacagtttgtttttgtgtgtctgtgtgtatggaaactttagaattttctacatataaaggcataacatctgtaaacagagataattttagtttttcctaattttgatgtcttttatttcttttacttgcctaatcatcctagctagcacttttagtactgtgttgattagaagtggtgaaagtagttgtcctttccttctttctaatcttagagatttcaggggtttaccattcagtatgattttttttttatcttgaactatccttgcatcccaggattaaatctcatttggccatggtgtaggattcctgtaatgtgctattatatctatttgccagtattttgttgaggatttttgcatgaatattcatcagaagtattggtctgtaatttttatgttttgtctttgtctttggtatcagggtaatgctggcctcataaaataagtttggagatattttgttcttccattttttggaagagtttgaggatgattggtattcatctttaaatgtttggtataattttctagtgaagacatttggttctggatttttctttgtaggtagggttttgattacttattcagtctactttccagttaatatacttattaagattttctattgctttctggttcagtctagattgcgtatttctaggactttgttaatttttaaaatagattatctgatttgttgtggtgtaagtgttcatagttttctcttaaagttctttatatttctgtaaaattattaatgatgtcccctcttttatttataattttattttattattattattattgaaacagagtctctgtcgcccaggctgaagtgcggtggtgtgtgatcttggctcactgcaacctctgcctcctgagttcaaatgattcttgtgcctcagccgcctgagaagctgggattgcaggtgtgctctactatgcccggctaatttttgtatttttagtagagttggggttttgccatgctggccaggctggtctctaactcctggcctcaagtgatccacctgcctcggcctctcagagtgttgtgattacaggtgtgagacaccatggccgaccctcattgataattttagttgagtcttctcttcttcttatcagtctagttataaaggtttatcaattttattgatctttttgaagaagcaactcttggttttgttgatttttctccattgtttctcattctgtgttttctttttctctaacattattatttatttcattctgctagctttagttttgatttgttctctcctttatagttttttaagatgtaaagttaaactgttaatttgagattgctcttttaaaatgtaagcacttatacatgtccctccccattgttttcactgcatccccaaacttttttttttttttttttttttttttttgagacagtttcactctgttgcccaggatggagtagagtggcacaatctccgctcactgcaacctttgcctttgggtcaggtgattctcctgcctcagcctcctgagtagccgggattataggtgcccaccaccactcctggctaatttttgtacttttagtagagacggggtttcaccatattggccaggctgatctcgaactcctgacctcaagtaatctgcctgcctcagcttaccaaagtgctgggattacaagcatgagccactgcacctggcctgttgcatatatctgggggctctgatgtttggtgcacatgtatttataattgttatatcgtcttggtatattgattattttatcattatgtgattaaaaattattttttcctttttaaataacagtttttgacctaaaatccattttttttctggtggtaacatagccactgcagctctattggttatcatttgcatggaatttatttttccatcttttcccttccaacctattcatatcctggatctttagtctcttatagagagcatatagttggatcttgttttttatccattcttctaaactatgtcttttgattggggagtttaattcatttgcgtttagagtaattactgatcggaaagaactaactcttgccgttttgctgttttctatatgtatttaggttttctgtgatttcctcctttattaccttcctttgtgtttaattgatttttggtttcccttctcatttcctttgtgtacattctatagatattttctttgtggttaccacgggtattacatataatattttaggcttataataacctgttttaatcagatagtcacttaaattcaatcacatacaaaaagtttactcgtttacaactttgccctcccctactttgtcttattgttgttacagattacttcttcatattttatttacacattaacatagttttttaatgcttttgtcttttaaatgatgtagaagaataaaatcaattataaactaaaattatgttaacactgatttatgtatttgtccatgtatttaactttaccagataattttacattttgtgtagcttcaagttactatctagcatctattcattttaacttaaaggactccttttaatatttcttgtagggaaaatctaactataatgaattcccttggtttttatctaggaatgtcttaatttatctttcattttttaaaggatggtaaggcagagtttattcaaggggatccatggcaataggaactactctagctgggttttgcagcggcagagagagactggaaggaattccctcccttattgttgaaagataattttgccagatacagaaatcttggttgatcttttttttttttttttttttaacactttaaatatatcatcccactgccttgtggtcttcaaacttcggctgaggaatctgccaaaacacttactggggattccttgtacatagatgcgttgcttttctcttgatgctttaaaggtatatattttttaaatttatttccaactaccacatgttctcacttataagtgggagctaaacaacaagaacacgtggatactaggaggggaacaatgaacacgggaataattgagggtggagtgtaggaggagggagacgatcagaaaaaaatacctgctgagtactatgcttattacctgggtgatgaaattatctgtaaactaaacccccgtgacacatagtttacctacataacaaacctgtacatatacccctgaacttaaagtaaaagtgaaaaaaagagagaggtttatttaggaaagaggtctcccttgtagatagattaaaatattacgcattctaaactgaaacttggctggaaacagtggctcatacctgtaatcccagtactttgggaggctgaggaaggaggattgcttgagttcaggagttcaagaccagcctaggcaacattgcaaaaccccatcaatataaaaaatacaaaaaaattagctggccatggtggtgccctcttgtagttccagcttctcgggaggatgaggtgggaggatcgcttgagcccaggaggtcaaggctgcagtaaactgagattggaccactgcatttaagccggggcaacagagtgagaccctatctcaatcaatctgaatcaatctcaatcaatcaaaactgaaacttaatccttcaaatatgtttattttacttgtcctaaaacaatgtccctagaagtattaaagtgtaaagcactgttattttcccattttgagatctctaatgtaaaaatgtattttttgaaaataatttaaaacataaaatgctatataataaacatttaaaaattttttttatttttatattttgagacagggtcttgctgtattgctcaggctggagtgcagtggcaggtcatagctcactgcagccctgatctcccaggctcaagtgattctcctgcctcagcctcctgagtagctgggactgtaggcacacacaaccatacctggctaatttttagtagagataaggttggtcttgaactcctgaactcaagcgatccttttgtcttgtcctcccaaagtgctgagattacaggcataagccaccacacctggtctaaaggtattgtttttaaatttcaatttctaattgtttattgctactatatagatatgcagttgaattttgtaaattgacctaatatcctgtgacctcgttaaacccacttaataattttagtagttgttttgtagaccatttggggttgctttatgtagactataatctattttgatgaataaaaaaaaatatttcttcccagagtgtttttttttcttggcttattgcactgactaggacttccagtacaaaattaaataagagtgccaagagcagaaatcttgttcctgattttaaggggaaagcattctatctttcaccaagtgctatgttagctgtatggttttaatttttttttgtagatatcctttatcagatggaaacagttttctttaatgtagtttttttttttttaaatcatgagttgatgtttaaacaattttcccctctattgaaataaatgggtttccttctttcatgttttgatatggtgagatacactgattgatttttgaatgttcagctttcattttatatattgctggattcaatttgctaagatttcgttgtggatttttgcttctatgttcatgaggagtactggtctgtagttttgttattttgtgctgggtattagggtaatattagtttcatagaatgaattgctatgtatctgtatctcttctgttttctgatagagtttttagctttctgaatttagaatttttccttgtgggaaggtttttaatggaattaaatttctttaactgatacgtctctttaggttatctgtttcttcttgagtaaattttggtaatttcttgcaatggatttatccattttacttaagttgtaaaatttattgaaagttgataatatattattttaatgcctctaggatctatgtaacatcccttctttaattcttaatactgtttgcttgtgtcttctgtctgtctctctctctttctctctctgtctgtcgtgctagaggtttttctatttatttatttgtttatttattgagacagaggctcactctgttgctcgggctggagttcaggtggtatgatctcggctcactgcaaccagcacctcctgggttcacgtgattctcgtgcctcagcctcccgactagctgggattacaggtgtgtgccaccacacctgactaatttttgtatttttagtagagaatgggtttcaccatgttagtcaggctggtctccaactcttggcctcaagtgatccgcctgccttggcctcctaaagtgctgggattacgggtgcgagccaccctgcctggccaggtttttcaattttattgataatttcaaagaatggacttttgaccttactgatttctctctctctttttttttttttttggtttttaatttcactttttttcccttttaaaattttcattatttccttcctcctgtttactttggacttattttggccttctttttctagtttcttaaggtgggatattatgctattgatttgagacgtacttattttctgatataataatttaatgctgtaaatttccctctaggcactgctttgggtacatctcaaaagtttggacattatgttttcatttgcattcaattaaaattattttctaatttatcttatgatttagtctttgaccattgggtatttataattgtgttgtttaatttttaaatatttgggggattttccagatatctttctgttactggtttctagtgtaattcttttgtggtcagagaatatactttatatattttaaatttgttagggtttgttttatgtttcagaatatggtttatcttggcaaacatgatatgtgctcttgaagctatttggctatttttgggtggggtattctctatatattaattaggttaagttggttgattgcattgtccagggtttccatatctttactgaatttcagtccactttttctattgactactgagagaggaattttaagtcttcacctgtaattttagatttgtctattttttatttttattactttttagtttagttttgaagctatgtttgtaggtatataagtatttaggattgtcatcttcaatcgatccctttattatatttaatgttttttatttatctctgataatatttctggttctgaagttaacattttctgatattaatatagcagtttcaggtttattttgattagtgtttgcatggtatgtgttttttctgttcatttacttttaacttacctgtgtcattgtatttaaagtgagtttctttctttctttcttttttttttttgagatggtgtctcgctctgtcacccaggctggagtgcagtggcgcgatctcagctcactgcaacctctgccttccaggttcaagcatttcacctgcctcagcctcctgaagagctgggattacaggcatgtgccaccacgcccagctaatttttaaaaaacatttttagtagagatggggtttcaccatattgaccagactggtcttgaactcctgaccttgtgatctgcccacctcggcctgccagatagacaccatatggttgggtcttgctaatttaacccagtatgataatctctatcttttaaatgagatgtttaggccatttatattcaatatagttattaatcaacttgtcagggtgtgtgtgtgtgtgtgtgtgtgtgtgtttgtgtgtgtgtgtgtttgtgttcttccttttttctgttttcctgaatgcttttgattcttttttgctgtgtcacatctactgatgaccccttcacatgaaatttttactctcatattgtggtttttattgttagaattttgtgctaaaattcttgtttttcttttttctttattttcctaactccccaaacttgttatctgtgctgaaattctttatttgttcatggatttttttccacttttttccctaaattatttggtgtatcaatcatagtttgacatttctaactgtctctgagtctggttctcttgattgctttgcagtgtgatggttggtttttgttgcttttagtttgtattattatttttgagaagagtctcactctgtcacttaggctggagtgctgtggtgcaatcacagctcactgcagcctcaacctccctgggctcaggtgatcttcctgcctccacctcttcagcatgcaccaccactcccagctaatttttttttttttttgtattttttgtagagatgggatcttgctatgtttccaagactagtcctgaacttctgggctcaagcaatctgccagcttcagtgtcccaaagtgctgggattacaggcatgagtggccatgcccagcctcattaattttgattgaatgtcagacatcttatatataaagagagactgaagtaaatagtatttatagttgggaatggacattactcttcttatagagagatatgtttgtatgtcccatctgtaagggctgtccctccttggatttcaggctgcttcaagaaaagttgtgattttgtaatttatccagcttttgttcattgttagtatggtagtggcattcttttcagcttttacattatgggctgtgggccctctaagatttctctaatttattcgtaacagaatacaaatttatcttatttatgtaatttggacttattttcatttttgagcacatagccattaatttttgcatacatgtgatattccttatatttcatctgtgaagcaaatctgtttccaatgtagtaaaaattaattacatgtaaacttacataattttagtcaatttgaatttttctacacagtattatttgttgggtatacttttttgagggttcattattggtaatattcatatgggtttgaatcctagaagggcagttgtccactcaaaaaataagttgagtatatgcatattattaaagttgtatcttaagttattgagatgtgtattattgtattaaacatcacccatgacttgcaaactcagaagaaatatgaataaagggcatctgttcaaaccttagtaaaacttcttggcttctgttaggagccttcttgactctgcaaattcccaagactttccaggctgatacgatgaaggctttttgggtgctgtatcactcttcattcccctcttcatagcccctggtaaccttgattttactgtctgtttttatgaatttgcctgttctaggtacctcatataagtggaatcatataatatttgtcctgtgtttgccttatttcacttactataacctttatatttctgattgtaaaggatggaaagtcatcctttccatttgcttgggctacatttctatattccagtcttaaagctaatgtaacctgttgcttatgtaatatgtgtgtcaacattatgtatggatttccaaaacaaccagcattatagcatctggagctttcaccaagttttcaaggggcctcttacttttccaaagaggttaagaactactgctatagattctgaagcatatataatcatataaaacagcccctgatcttaaggagcttgacattttattgatctttgtcctgtctatgacaaactaatgggttggggtgggtagtattgtatgaccaatatagaagcctacactgaagagtgaagcgcagtgacttacgcctgtaatctcagcactttgggaggccgaggcgggcggatcacgaggtcagcagatctacatcatcctggctaacacggtggaaccctgtctctactaaaaatacaaaaataaaattagccgggcatggttgcgggcacctgtagtcccagctacttgggaggctgaggcgggagaatgctgtgaacccgggaggcagagcttgcagtgagccgagaacgcgccactgcactccagcctgggcgacagagcgagaccccgcctcaaaaaataaataaataaataaataaataaatacacaaataaattagaaaatgcctataaaatacttagcagaggggtttatttgttagctgtgctggatgaaggtaatgataaaataataaccatctacgtgaccagaggtgattactaaatttcctttatatattttttacttttgttgtgctgaattatctataacataaaaatttgccattttacccatttttaggtgtacatttcagtggtactaagtacattcacaatgttgtacaaccatccccactctgtatttccagtactttttcatcttctcaaacagaaactctgtactcattaaacaataacttttcattcccctcttcatatcccctagtaacctcgattttactttctgtttctatgaatttgcctattctaggtgcctcatataagtggaatcatgtaagatttgtccttctgtgtttggcttatttcacttagtgtaatcctttacatttttatttatccattaagcacaatgacatttgtcttttctatttcattgaattactgtttaaagtcaaatgaaatagttaaatcctaataggtactatataaatttaagacggtatgtataaaaactggtaaatattacctgaaagtaataaactcatttgctgtctccctgtgattgtaagtgggttactttatttataatttaaaaaattattcctatgttacatagaaatgctaggcttattctaaaattcaaagttagattttaatgtcataagagagaagtttgcttgaactgaccatttgtggaatgtttgttaattttaaatttggattcaatattttatataccttatttgacttgaactttattgtatttctttctctttttaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggtgaggatgacttttgagctgagacttcctttattaatttataacatttctactttattatgccttggaaccaaaaggaatagcaagattaatcttttctttactcttttgaaataagacttatttggggccgggcacggtggctcacacatgtaatcccagcacttcaggaggctgaggcaggtggatcatttgaggtttggagttcgaggccagcttgggccaacatggtgaaaccctgtctttactaataaaacaaaaattagcagggcatggtggcacatgcctgtaaacccagctactcaggagactgaggcaaaagcattgcaggagacaggttgtagtgaaccaagaaatgccactgtattccagcctgggtgacagagcaagactctttaaaaaaaaaaaagacttattatatgcttggatttaaacttttaatcttcaactgtaatttaaaaccaataataaatatttgggaatgggcttctgtattggtcttaactagaggtagtaggtgatctaggcaatgggagtggctgttaaagaaggcagcctaggtagaaacatatagtatctgctctaattctagtaaatgtcataaaatccaggtagagtgtgcttattaaaaagtgtgtaagtagtattagctataatttatggcagccttatatatgtgccaggcatcatattaagtcttaaatgccttatcttaatagtcccaaagtcctgtggttcttactgctatcctgattttagatatgaggaaactgagatatggagagttttagtaacttgcctaaggtcagtcttgtaattattaaatggccaaacgggatttatttatttatttatttttgagacagggtcttgctctgttgcccaggctggagtgcagtggtgtgatcttgactcactgcaacctctgcttcctgggttcaaatgattcttatgcctcagcctcctgagtagctaggattacaggcacaccaccatgcccagctaatatttatatttttagtagagatggggtttcaccatgctggccaagctggtctcgaactcctggcctcaagtgattctcctgccttggcctttcaaagtgctgggattacaagcatgaaccactgcacccggctcaaacagggatttaaacccaggctatttgacttttagtacaattatattctgctgctctaggttcctttatttctttgttttgttttggtttggtttttgagatggagtctcgctctgtcgctcaggcttgagtgcagtggtgtgatcacagctcactgcagcctcaacttactgggttcagatgattctcctgccttactctcccaagtagctgggattacaggtgtgtgccaccatgccaagttaattttttgtattttcagtagagatgggatttcaccatgttgcccaagtaagtcttgaactcctggcctcaagcaatctgcctgcctaggcctcccgtagtgctgggattataggaatgagccaccacgccgagacaagttcctttatttctatatgtctctttatctttaaacaatttaaagcatcataaaattccttaatgtgatcatctttcgtctttaggaccctttaaattctggagatgatgttagtgaacaggatgtgccagacctgtttgacacggataatgttattgtctgtcagtatgataaggtactgtatttaccttttggactttgggtttattaactgcatttatagtagaaaggtatgtaaaatgatgggaaataagatgaagagttacacttcacaattaatcaaaacagcagtttaattctggaaattctgagtgtgtattttgggtctagcgctgtgctatgtgatctcagtgataccagaaaaagtgacagtccttaaggaagtaatgatcttattgaaacaagatgtttcttttggaaaactagaaagacatacaatgagatggtaggtaaatcaacagctaaaatatgtgacaggtaaatcaaatgctaaaatatgtggaatgtaatcaaatgctaagatgagtggcaggtaaatcaaatgctaagatatgcagcacagatagtaagccctagaagtggctaggaaatgtaagaaatcatttgtagttggagttccccataaatccatgggtgatgtggggttttgaaatgggtcttgaatgacttgtaggatacaggtaaatatggagaataagcatcagatagaatagcccaataaaaagcagagaaatgaatggatgtagtatgtacaagggacactgaagagatagctctggcttgaacaaagtgtcttttattggatgtatagtactaggaagtgaagctgggtgggagacagaataggaagcagattagaatatcctgaatgctagtaggaaaaatctgaacttggtctgagggacactagccttctgagaaggttattgagaaaattgtaattgggtttaaaagccagatgtgtttgatttggaaaaagcaaatggtaaaagtgggtagggcagacgtgaagtgcccagaacccagacagaggatggcagtgtaagaacatggagaagtcagaggttatgatggaaaaatcggtgggacttggtcattagttgaaggtgtctctcaggtttccagcctagagattatgttagtagcagtctaactctagcaactaaaaataatactgctttttaaaaaacactacagctgtgattatgtagtcaaatgggagtttttgtccttaattcatgaatatttatattcttaaagtggctttgagatataatgaacatagtatacaattcgcctatttaaagtatacaattcaatggtttatttagtgtattcatagatatgtataacaattatcacagtcaattttagaaccattttatcacctcaaaaagaaaccccatactttttgtttcttagtgcagtattctccccattttccctactccaagcctgtaggcctaagaaaccactgatctactctctatttctatggattttcctattctggaatttcatatgaaagaaattatataatatgtggtcttttgttactggcttctttcacttagcacagtgttttcaagagtcatccatgttgtaacatatatcacgtcttcgttttttaaaaaaattgctgaataatagtctattgaatggatataccacattttctttttccgtttgtcttttgagggacatttgggttgtttccactgtaggggagaaaaaagtaataccttttccttacccattgctatttccctggttgaggcacctataaaaaagacagattaacaagagaaaatcattcaaatttattttaacgtacattttactgacacaggaaactttttttttttttttttttttgagatggagtctggctctgtcgcccaggctggagtgtagtggcgtgatcttggctcactgcaagctccgcctcccgggttcaaaggatcttcctgcctcagcctcccaagtagctgggactacaggcgcctgccaccacgcccggataattttttgtatttttagtagagatggggtttcaccgtgttagccaggatggtctggatctgacttcgtgatctacccacctgggaagtgctgggattataggtgtgagccactgcacccagccgacacaggaatatttagaaatgaagacccaaagaaacagggaaaactatttttctggacagtcataccgaagtatgataggaggaaaaaaggatatgatctaatgacaataaactggaggaaacgtagtaaggcctgtttgttcagatttttgtgtctctgtgtcttcagagataaggacacttattttcctttgtgtatagggtagggacctctgtaataaaggttttatgacttactttaaaggaaggtcagataatccttttatggcctggttcaggggagaagggtgagggcaaggtcagaaagactttcctgcttctgccattttttcaaatgtcaggatgccagaacacatatggggtaatgtgttctgaaccccatagatacctttttgctgctatgaataatgcctctatgaacatttgggtacaggtttttgcgtggacatatgttttcatctgtcttggcatatactcaggagttgaattcctgggtcatgtggtaacagcttaaggaactattagactattttccaaagtggctgtactattttacattcttattagcagtgttcgagggtttcaatttctccacatcctggccagcactggccataatccgactttctaattctaaccattctaatgagtgtgaaatggtatatcattgcggttttgatttgtgtttccctgataactaatgcgtatttacatatttagccttttttttttccagtcacaatttgaatatatttagggggaaacaaagaataatgttttgaattgctgtaaaaagaaatctttttctctgaaaataaggtcactttctccactataacattttatacaaatagaaaaccgcaatttagatgctgaatacaaatataaacataagaaggaataggggatagaaaaggaacagttcttagtttgaaacttgttttagtttcttataaacaatatattgccttctataaaaaaacattataaggtacttaattatatatacattccataaagtctcatgcagaattttctagaccattatggatgtggtatcctttgtttgccgcaatgtgggagataccttgtaattaattatgtagtactttgtatttttgcggtgttttatcatatattatcttttgtttcttataataaccttatggaatagatagaggtgatattaaatatacactgctaacaaatctagtatctgagaacccttctacttagtgaatattttaagaacagtggtaaaaaattaatggaaagcagggcattggggaaccattgaaacattttaaaaggggagtgatgtagtcagaagatagccaaaagaatgtatctaaaggtcaaagtggggtgaggaacactgttatagtgaatctttatgaaagaaaaactttccagtgctggtcactggttgatttgtttcaaatagtattgaatgtaacccaactcaagtgaattgaaagaactttcagtagtctcttttagagctttactaattcagtgtgttttatgggcttagcacgcttttgttatgccactctgctaacttactcagcttattttaaaggcaggtagtatcagttcctctgggaaactattacaaatgcagaatcctgagtcccacgccagagtactggataagaatgtacattttaacaagactccaaaatgatttgtatggccgttaaattttgagaagcagtgtttggtttctttagtatattttatttggatttgattaacagatggaatttatctttaaaatttagagattaacaattggggggaaaactttgaaaatataaacatgtacagtgcaaaagggctaaatgaaggccactggtttacatactgggtgagaattagttaaatggtatagatattttgtttcagaggcctagagaatgtctaaaattaatataaggatttaaataataaagatattatagcgaaaattaatggtgaaatgaaaccttttactacagatggaggtgttctgtgctacaaataggacactatttatagtggaatgtgaaaccatttgaatatcctatatcttcgtttgacagtttagcagacttgcttatagctgactttatcccttagatgctatacaatgattaatttctaggtgtgtagcatggtttctttatatatacagagagagatatgtatatatgtgtatatatagtctctttatatgtatctatatatctctctatataatagtctatatatatgtacatttcctttgaatagatagtgcatacacatggttaaaaaatcaaaatactgtaaaaaggtatacaatgaaaagtctggttcacattccttcatcatttttgctttctattagtagctccttttcctgttttgaatgcaaataagtagttatattagttttcatcgaatttctttattcaaatacaaatacaaaagatagcataaataacactatattctgtaccttgctttttttctttaaacaacgtatctgtcagatcttcccatatgaggaggctttctttgtgatgatattttaatggctgtataatatcctattgtaggattactaaaattcatttaaccaatcctctactgatggatatttgtgatttttcagtcttttgatttgaaccactatgtatataagacattttcataatgtgtgcagatatatctattaaatccccagaaatgggattctgggtcaaagggcaaatgtacgtggttaggtattcccaaaatgctctctaagagcattttgccattgtgaaagatgaaaagtgataccttgttggaatttttaactttccatatgttaaagggccttttgtatttacattttgtgaactgtttgttcataatctttgtctatttaaaaaattggattatttggtcttatatttagtgatctctaagagctcaatattattttggagaaaatgagctttttgttatacacagaagtactttttactcagttattttcattgctttttcttttcaatatgtagattttggatctgtcaatctttaattttatgtcttctgcattttgagccatgaataaaaagttctttcttacctcagagttttaaagggaagctcatgttttcttcaagtatttcatatatatctatatatctatatctatatctatatcatctatatctatatctatatctatatactcaagtcttgattcatttggtgtttgtcttggtgtataatgtaacatatggtttcaactttttatttttttttttccaggtggctactcaatcttcctaacattttttaagaaatctatttcgtccctaatgttaagacatgatttatcatctgctactgcatttctaaatgtatttgggtctacttattgattttctgttttgttccattggtttgtctgtccataggcctatgctactctgatttaattattaagatttttaatgtctggtaaggttagtaattctttactaatttttttgcagagttttcctggatattcttgttcatttttcatattaactccagaatcaacttgtctggttcaaaataaaaccctgttggtattttcattgagatcacattaaattaataaaatttgttattttaatgatgctggggaggaatagattgcaattttagatggagtgtctaggggggccttattgagaatgtaatagggtaaagatcagaaggaagtaagggaatgaactgtgaggatattagagtgtaagcattttgaacagaaagaacaagaaatacaaaagtcctgaggtaggagtatgcccgtgtgttcagggaacagtgcagaggccagagcagtaagtgaggaaaaataaaggattttgtagtccattgtaaggactttagtttttggatgggaagtcattggagagtttcgacaagagaaatgacatctgatttatgtttttagcagacactctgggtatcctgtttatagtagactgaagtgggtgttgtcagggaacaagggtaaaaacaggaactagttatgaggctattgtattgacctgggcaagagaagatgatggctgagataagagtaacagtagtggaagtggtagaagtttttggaatatgaatatgttttgtaggtagaactaacacttactgatggatctggatatgggatgtaagtagcaagcataaagaatacctctaagatttttgacttgagctcttagaagaataagtggtcatttcccagtgagatggggaagattgtgaggtttggggaagacagtataagtgtcatagttgtaaactctgagatgggtgtgtgtgtgtgtgtgtgtgtgtgtgtgtgtaatacacagtctttaatattttttctggagttttaaaaaatctaatatgcaatagttttattaaatactttttcaacacaattagaggtgattatatgatttgtcagtaactgaagtaatatgatttttatattaataagttcctaacattgaactattgttgtatatctagaaaaaatatagtcactagataaaggtaccacaattagttgttgcttctgttgttctcctaatgctgcttatattttattacctgtgctgagtttgggatgtttgttgtcaccgttgtattcccgagagatttttaagacacgtgcaagtgactgtgcaagacaatttgggaataaaactcagaaaaaatttattaggactttaaaacccccccacaaaaataggggtttatcctgtgtgttttcttatgcttcacaaaatgcatctgaataccagtcacagcctttgttcttggatttgactatttgtagtcaacaactaggtttaaattttactcttgatctcagatcatatattcctagggcttttaaatagtcacttgcagtttacttagaggtagcaatgattttatggcttgttacctcttgaagtattaaaatttcttattttttattgtgtctgtgtctaggctgatttatggaatctagaaaacagccagcagagtcttacagattataagctgtatattctgaccttgttcagtgctttattgggactttcttcctcatgatgaagtatcactttttcatttctgataatattggctacatcttccctgtttattcctttgcagacatactggactctgtgctgttcttgaacaatccaggcatgcccctctttaggactgttcacttctattccttttatctggaatgctcctgagtaaatatctgccttgctttactccttaccttcttcaagtttttgctcaagtgtcacctcaaatgacagcttaatattctacataatttacttatgtattaggtttctgtccttccctattaaaatgtaaactcttaaaaggcagggattttttttggttttacatatacaggatgtgtgtttttatatataatatatacagtatagaaatatatgtatcttaaactaatatatttccagtgcctaaaacagtgtctaacacataggaactcaaatgtttatggaataaacaaactatcttgaggagattttaattttaaggcactcacatttcgggtgagaataatcccatttactgtagcagagaaatgcaggtgatcctttaacttgtaaaattaattaatgtaaactacttttctccctccagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattacacaa

SEQ ID NO: 1779 - DNA, 110591 bp, Homo sapiens
tggactttgggactggacagacctggtcacagtctaggttctacatcttactggtcgagcaactttaggcaagtagcttaactcctccgaacttattttccttttctaccaaataatgataatattacttcatgagtttgtgagtattaaatgagatcatgcatatacagcctacagcccttagcacaccatgaacacatagttatttgataaatgtttgttagtgtggttaattgaacagaaagccttaaatgtcttcctaaccctaaaatccagtgattctttgaactggggagggcagtagagagatttaatttgtggaaaaatgaaaagaccatttaaaattattcaatcagaaatgtattaagctttgtgtatttgtgtcaggcatttgtagacagtgtggaaaatgtcttatccaatgattctttgaactgggagggaagtagagagacttaatttgtggaaaagtgaaaagaccatttaaaattattcaatcagaaatgtattaagctttttgtatttgtgtcacaggcatttgtagacagtgtggaaaatgtcttaataaatgagacatgctctttccttgaaaaagcttcagtctgactcacaaagagtatatgaattttttcctatgatggcttgaaagattttatcttcaaattcctttttgtgagattgtttttccataccagtgcttcttatttatagggcttgttgcaagtaatttgcaatattgttacaggttgagtatcctttacaccaaatgctcagaccagaagtgttttagatttttttggattttggagtatttgcatccccaaatctaaaatgctcaagtgagcttttcctttgagtgtcatgttggcattcaaaacattttgaattttggagcaattcagattttgtgtttttgaattagagataatcaatttgtaataatatttaaggtattgctgtttgtgaaagatgtatttttaaacgatttagagtcaattcatgataatctccgtaatactcttacaagaattccaggctgggcatggtggctcatgcctgtaatcccagcgcattgggaggccaaggcagacagatcacttgaggtcaggagtttgaggccagcctggccaacatggcgaaaccccatctctactaaaaatacaaaaattagcagggcatggtgatgcacatctgtaatctcagctactcgggagcctgaggcaggagaatcacttgaacccgggaggtagaagtgtagtgagctgagattgcaccactgcactccagcctgggtgacagagtgagactcagtctcaaattaaaaaaaaaaagaattccaatatgatttcttaagtgggagaaaggggtggattgtacaaactgtgtgcaagtgcaacctttgttcgtgttttgtgtgaaccctcctattgctgatcaccacttaaaatggtagggacaattagttagttcagggcttccctaaatatggggagtgctaaattctgggtacatccaagagcacgtgctaggcttttgaatgccatttgtcacacatattgaggtctaaggttgcaaaccattgtatactagatccttgttattcctggtgtgaataggcatgtgtgcctacttttaatttcttcttgagttcagtgctttgaaaacagacagctgaagaaaatgtctaatagtctaaagaggaagcaaacactttcctagaaaccttcgaaactcagaaatggatttctagaaattctagccataatacatactccttttctttctgggcctcattcagaatcttgatgtctcaactgtctctgagttttttttttttttttttttttttttttgtctttccccagacagagtcttgcactatcccccaggctggagtgcagtggagtgatcttggctcactgcaacctccacctcctgggctcaagcgattctcctgcctcagcctcccgagtagctgtgaggagcaccaccacacccagctaatttttgtatttttggtagagacagggtttcaccatgttggccaggctgctcttgaactcctggcctccagtgatctgcccgccttggccttccaaagtgctgggattacaggcatgggccactgtgactggccttgtctctgaattttgtgtggaattgtcctctaggagtttgcagggtattccagattgaaagtagacctttgaaaagtatggggcatgcaggctgggatggaatccacagctgagggaaaagccagggaatcaaaatagaggaatctttgcttcagaggaaggcagctggggacttggtgccaggagtgtttggttcccagctctgcactaactggatttgagactttggggaaagtgcccagaagctgtggtctgctctggattgtcatgcagtttaaatgagacgttgcctgtgaagggctttctgggaggaacaggtacatatctagaccaaccctacttgtaatgcaggaacaaaacaaaactgaaattacatagatgctgccccttgaatactcttggattccagggtctcaaagtgcatagggtaaagtagcagatgactgaggaaaatgcatctaaacttctcttagccttcttatctctcggagacccaataggcttctaacagaccaaggctctggacagggtgtggccccctttcctatgagaggattaggagggaaggaaagggaaagaaggtgctgcatgaaattgatcttagttgttgactttgtgccaactggctggtgggggttttgagaccagaatagaaagatgaagtcatatagaaggatcagctgaaagaggtaagagaaacggaagcaagtgtaaaaaggattgataggctgggcacggtggctcacgcctgtaatcccagcactttgggaggccaaggcaggtgaaccacaaggtcaggagttcgagaccagcctggccaacatggtgaaaccctgtctctactaaaaatacaaaaattagcctggcatggtggtgggcgcctgtaatcccagctactcgggaggctgaggcaggagaattgcttgaacctgggaggcagaggttgcagtgagccaagatcatgccactacactccagcctgggtgacagaggaagactccatctctggaaaaaacaaaaaggattaataaaggaagatagcaagagattgaagaggggaggaagaggagggcagtgggaagcaggcctcccctcgacaatggggaatcagagctgctgactccagaacagtattaaacttccaggacaaaggtttgggttcctattgggcaccatatgaagttctatttggttgaataaactcacatcacatttgctgagtgcctcctatggaagagtcctggacgggggtgaaaggtggacagtgagggggtaggagtgcactttgcatagatctgggtttcaaggtaggagatgtttgtgtaaggtttgcttttaaaaaattcagggctgcttacaaagtaatgggcttgatttcttttctcctgcttatggaaatcagtttatttgtctcataataagcaaaaactgaagaaaccaacaccactgttgcaaattttgaagctacaaggaaaactgatgaggtgaaatttttggcatacatcagaatcgtattcagtctgaaacggaattatttcctctttttcttttctttttaataaacccaactaaagtaaatattttcctgagctctcacccctataggagggttattttggccttctgaagagggtgagatggagatatagtgctgctgatttcctacctgtgagcctcctcgtgggtcccatcgaaaccctgctctccctgctctgagggaaggtgcttcacagcaacttcagcctaagggcagtgacagtgaaatggcctccagggagccagcagcctgggctgccctccgctgtgtgtttttgtgccctcaggaatgtgtggatgcagcaaatgacaacagtgagtgctctgtccctagcggagccccaggccctgtcactttttgtcttggctggtttccaaggttgaatgattgcattggttgaagcttcattatccacaaggggaggcaagacagtgggctggagggagaaaaataggcctttcccacgggcatgattccagcagggtttgcatttttacatcagtagatctcagggactttcattttctgtcagtttgggccgtttgccctatcccagctacttgggaggctgaggcaggaggatcacttcagcccaggaatttgagaccagccttggaaacagcaggatcccacttctgaaagataaataaataaatatcccagcactaaagcccatgtatttagtggtaatacaatttctgcttttgacagcattttccactggatgtcagccgccatagcatcactttggagttggaaaggaccacagagctcattctagtgtaatccctgaatgtctggagaggctgtgcacacagctagtgagtgacagagtggtgcccagaatttgggttacccaagccccacatcagtgttgtggtccctacacttcactgcctctggtgtcattagaataatttcagtaatttgttgtatcaggttgggctgaagtgacctgtattcaaatcctggtttttccacacctaggtatatactcaagaaaaaggatcacacgaaacttatacacaaatattcagagcagcatttttcaaagtaactaaaaagtggaaacaaaccaaatgtctatcaactgataaatggataaacaaagtgtgatatttccatgcagtggactactcttcagccttgaaaaggaaggaagcagtgatatgtgctaccacatggatgaccttggaaacattatgctaggtgaaagaagccagacacaaaagccatatgttgtatgattcagtttacataaaatgtcctgaataggcatattcacaggcacagaaagtagtttagtggtttccagggcctgtggggaggggagtatgtggagtgactactaataagcatacagggtttattattgggatgaaaagaatgttgtggaatttggccaggtgcagtggctcacacctgtaatcccagcactatgggaggccgaggcaggtggatcacttgagatcaggagtttgagaccagcttggccaacatggtgaaaccctgtttctactaaaagtacaaaaattagccgggtgtggtggcgtgcacctgtaatcccagctacttgggaggctgaggcaggagaatcgattgaaccctggaggcaaaggttgcagtgagtcgagatcgtgccactgcactccaacctgagcgacagagtgcaactccatctcgaaaaaaaaaaaaagaaaagaaagaatgttgtggaatttgatagttgtgatggtttcacaattgtgttaacatactaaacatactaaaagccactgaactgacacttttttaaaagggtgaattcatggtataagaattatatctcagtaaagctgttatttaaaaaattctggctctacctcttactggctgggcgactttaggcaatgaacctaaagccaagtcatctcagctatgaaactggaataataatacacttcacagggtctttttgataaacgagattgtgaatttgaaaatgcttctaaagtgtaaacctcacatatttttggactgtcaatgggttataagttcattataaattggatttttaatcttctcctcctgtgtttttcacaatactaacaaggtctgggtacatagtgatcactcaaataaagatttattgagttgattcaaatgtatttcagttttattcaattgtggtaaatgaaactacacaacaggaaatctactcttttaaaagttttcaactgttaaaaacggtgttatgaacgatatgcacattgttgtacagcaaatctctagaaccttttcatcttacataactgaaactatatccactgaacagcaacttcccatttttacctactcccagttcctggcaaatgccattttactttctgcggtatgagttagactactttacatacttcgtataagaggagtcatgtaggatttgtccttctgtgatgggcttactgcacttagcataatgtgctgaaggttaatctatgttgcaacttgcgtcagaattttcttccttttaatactgaataatattctattgtatgaatatactgcattttctttatgcatccatccatcaattaacatttaggttgtttccatctgttgactattgtaaataatgatgcagtgaatatgagagtgcaaatattttttcaagaccctgttttaaattcttttggataggctgggttctgtggctcacacctgtaatcccagcactttgggaggccgaggagggtggatcacctgaggtcgggagttcgaaaccagcctgaccaacatggagaaaccccatctctactaaaaatacaaaattagccgggcatggtggtgcatgcctgtaatcccagctactcagagggctgaggcaggagaatcacttgaacccgggaggcagaggttgcggtgagccgagattgcgtcactgcactccagcctgggcaacaagagcaaaactccgtctcaaaaataaataaataaataaataaataaataaatgaattcttttggataaatacccgtaagtggattgctggatcatatggtagttctatttttagtttttgtttgttttttttttttttttgagatgcagttttgctcttgttgcccaggctggagtgcaatggcgtgatacccattcactgcaacatctgcctcctgggttcaagcaattctcctgcctcagcctcccaagcagctgagattacaggtgtgcgccaccacgcctggctaattttgcatttttagtagagacagggtttcaccatgttggctaggctggtcttgaactcctggtcttaggtgatccacctgtcttggcctcccaaagtgcctggattagaggtgtgagccaccgcacctggccctatttttaattttttgagggccttccatattgttccccataatggctgcaccactttacattgccagcaacaatgcacaagggttccgatttcttacatccttgccaagatttgttgttttcctttctttttttttttttttttttttttttgagacagagtctcactgtgttgcccaggctggagtgcagtgggatctctgctcactgcaacctctgcctcttgggttcaagtgattctcatgcctcagcctcctgagtggctgggatttcaggcacccaccaccacacccagctaatttttgtatttttagtagagatgagttttcaccatgttggccagactggtcttgaactcctgacctcaagtgatcctcccgcctcggctttccaaagtgctgggattataggtgtgagccactgtgcctggccatattatcctttttttttttttttttaaaagaaaataatggccattctaaaaggtatgaggtgatagatacctcgttgtagttttgatttgcattgtcctgatgattagtgatgttgagcatcttttcatatattttctggctatttgtatgtcttttttggagacatgtttattcaagtactttgccaattactaaattgcatgatttattttcttgccgttgagtttattgagttccttatatgttttggatattaattccttataagaaataccgtttgcaggccgggcgcggtggctcacgcctgtaatcccagcattttggaggcagagacgggtggagcacaagttcaggagattgagaccatcctggctaacacggtgaaaccctgtctctactaaaaatacaaaaaattagccgggcgcggtggcgggcgcctgtagtcccagctacttgggaggctgaggtaggagaatggcgtgaacctgggagatggagcttgccgtgagccaagatcgcgccactgcactccagcctgggcgactgagcgagattccatctcaaaaaaaaaaagaaaaaaagaaagacagaaataccgtttgcaaatattttctcctattctttatgttacctttttactctgttgattgtttcctttgctgtgcagaaacttttaagtttaatggtgtctcacttttctgtttttgcttttgttgcctgtgctttgctgtcatatccaagaaatcattgccaagaccaatgttatgaagattttcctctgcatttttttctcagagttttatagttttcaccgggcgcggtggctcatccctataatcccagcactttgggaggccgaggtgggcagatcacgaggtcgggagtttgagaccagcctgaccaacgtagggaaaccccatctctactaaaaataccaaaattagcctggcgtggtggtgcgtgcctgcaatcccagctactcaggaggctgaggcaggagaattgattgaaccagggaggcggatgttgcagtgagttgagatcgggccactgcattccagcctgagcgacagagcgagactccgtctcataaaaaaaaaaagaaaaaaaaacaggtttttttgtttgtttgttttttgtaggggaggagattcactcttgttgcccaggctggagtgcagtggcacaatcttgactcactgctacctccacctcctgggttcaagcgattctcctgcctcagcctcctgagtagctgggattacaggcgtccaccaccactcccggctattttttatatttttagtagagacgcgatttcaccatgttgcccaggctgatctccaactcctgacctcaggtgatccgtccacctcggcctcccaaagtgctgggattacaggcatgagccaccgagcccggccaaaaaaaaccaaaaaaacaaaaaaccccccagagttttatagtttcaagtcttatgtttaaatcttttatctattttttttttgagacggagttttgctctgtcgcccaggctgaagtgcagtgacacaaccttggcttactgcaacctctgcctcccaggcaattcccctgccttagcctccagagtagcttggaatacaggtgtgtgccaccaggcctggctaatttttttgtatttatagtagagatggggtttcaccatgttggccatgctggccttggacttctgacctcaggtgatccacccaccttggcctcccaaagttgttgggattacaggtgtgagccactgcacccagcctcttccatccatgttgagttgatggttgtgtatgatataagacaagcttgtccaacgtgcagcccacaggctacatgtagtccaggacggctttgaatgctgcctaacacaaatttgtaaactttcttaaaacatgagatccttttttttctttttttaactcatcagctatctgtagtgttagtgtattttgtgtgtggcccaacacaattctaattctcctttttctcctcctccttctccgcttcctctttctcctccttctcctccttctcctccttctcctcctcctcctcctccttcctttttttttttttttttttttttttgatatagagtttctctctgtcgtccaggctggagtgcaatggtgcaatctcagctcactgcaacctcctcctctcaggttcaagcaattctcctgcccaccaccatgcctggctaatttttgggcaggtacccaccaccatgcttggttaacttttgtatttttagtagagactgggttttgccatgttggccaggctggtctctaactcctgacctcaagtgatctacccaccttggcctcccaaagtgctgggattataggcgtgagccactgtgcctggccttaattcttcctccagtgtggctgagggaagccaaaagattagacatctctggtataagattacagtttagtttcactcttttgcatgtggatatcaagttttttcaacaccacttttttttttttgtttgagacaaagtttcgttctccttgcccaggctggagagtaatgacacagtctctgttcactgcaacctctgcctcccgggctcaagcgattttcctgcctcagcctcctgagtagctgggattacaagtgtgtgccaccatgcccagctaattttttgtatttttagtagagatggggtttctccatgttggccaggctggtctcgaactcctgacctcaggtgatctgctctcctcagcctcccaaagtgctgggattatagatgtgagccactgcacccagccctctttcttcctttttttttttgagacggagtctcactgtgttgcccaggctggagtgcagtggcgcatttgtggctataaagttccctgtgagtactgttttggtgtgctgtgttttcattttcatttgtctcaagatattttctaatttccttttttatttctcctttgatccattggttgttcaagagtatgttaattttcaaatatttgtgaattttttagttttccttctattattaatttctagttttattccattgtggttagaaaaaatgtttgtgtgatttcaatcttctcacatttgttaagatttgttttgtaacctaacgtgatctgctttggcaaatgttctgtgtgtgcttgagaagaatatgtgttctgctgctgttaggtggaatgttctgtatatgtatggcagtttagttgagtttatagtgttcaagtctattgtttctttagtggtcttctgtctggatgttctgtgtattgttgaaagtatggtgttgaaatctccaattattagtgggtggctatctatttctctcttcagttctgttaatgtttgcttcatatatttgggtgctctgatgttggatatataaatatatatatattttcagatggagtttcactctgtcacccaggctggagtgcaatggcactatctcagctcactgcaacctctgcctcccaggttcaagagattctcctgactcagctacctgagtagctgggattacaggtgcccaccaccatgcttggctaatttttgtatttttttgtagagacagggttttgctatgttggccagactgctctcgaactgctgacctcaggtgacctgcttgcctcggcctcccaaagtgctgggattacagttgtgacccaccattcccagctgggttaatatatatttataattgttgcgtcttcctagtgaattgactcttttatcattatattatgtccttctttgtctcctatgatagtttttgacttaaagtttattttgcttaagcatggctactcctgctctctcttggataacatttgcatggaatatgttttttcatcctttcactttcagcatatgtctgtctttaaatctaaagtgagtaccttatagacagcatacagttggatcatgttttttttttaatccacttagccaccaacagaattataatttttaagcatttatcagaagtaaagacatttagtaatgattccccccttcattttatatacctattttctctttattttatttttttaacagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtaaatattcaacaccccaagtttattttcatgggaaatagcttaaatattcttaccttcctccttgggttgaaaccaggtagagacagatggcaatttgtcagctgaggctgtgctttggggtaggagatggaacatttagctaaacagctggtttatttgtttccttttgcacctatttctaccagataagtttaactgttgaacattttttaaatatcatacgaaataccatgctaggctaggaatttgttgtggatggcggcactaagagaaaattcgttgatatccatggttgagattaacgcatcaacttcaaatgttaaaaatatttctaatatagctgagattccctaattaatctctaaagatctgtcatccatgaatatacctgaacttctttgcattctcagctgataccacttcttccttaggtttgctccctgctctttgaaataagactgctttcatttttacccaaattgatttttgttgactgaattcacccatttggtcatctcaacttgtattgtttttgtttttgacatggcatctcactctgtcatccaggctggagtgcagtggcacgatcacggctcactgcagcctccacttcccaggctcaagtgatcttcctgcttcagcctcctcagtacctgggattacagatgcataccatcgtgcctggctaattttttgttttttagtagagacggggtctccctatgttgcccaggctgctcttgaattcctgggctcaagggatcctcccacattggcctcccaaaatgctagcattacaggtgtgagccacctcatctggcctaaactggttgttttagaattaggtggacacacgtgagtgttaaaaattcagttaatttttaaaaattttgcaaataaaaattatctaaaagtcagaacttgaaaagacagttatagtaccacatttattttggagtagtaagtaaatagtagtggacataatataataaagtcaaaaaccaaattttaaaattagagctctttcctattttagttgagggttgttggttttttttttttttcccccctagcagagcactggtcactggtctctggagttaaattggaggtggggttgggggacctgagttgatgcattcatgcatccatcgatccatccatccattgatccaaatcttttttttcttttttttttttttttgagatggagtctcgctttctcacccaggtggagtgcggtggcacaatctcggcttactgcaacctccgcctctcgggttcaagtgattctcctgcctcagcctccggagtagctggaactacaggcgcccaccaccatgcctggctaatttttgtatttcagtagagacagggtttcaccatattggccagggtggtctcaaactcctgactttgtgatcctcccacctcggcctcccatagtgctgggattacaggcttgagccactgtgcccggcccatccatccaaatctttactgagtacttactgtataccaagtgccacatcaagtgctggggataaagataaataaaaatctgatccctgtttccagatggctcacagctgctgtagtccttcagagaaatttaagctcatctaggcccctccaggctgtggacttcagaggaagcatttttctttggggtggccttatggcagtgtttctcaaacctggctatattattattattattattttgagatggagtcttactctgttgctcaggctggagtgcagtgcgatagctcactgcaacctctgcctcccaggttcaagtgattttcctgcctcagcctcccgagtagctgggacgacaggcgtgagccaccacgcctggctagtttttttatttttagtagagacggggttttcccatgttggccagactggtcttgaactcctgacctcaagtgatccacccgccttggcctcccaaagtgttgggattacaggtgtgagccaccatgcctggccaaacctgactatattagaataacttgaaagcttttaaatcatctcaatgtttaggtttcacttcatgctaattaaatcggaatctctggcgggggtgggcggtggggagggagccagattccaagtattttaagatctctccagatacaaggtgtagccagagggaagaacactgctctccaggtgttgtaaagttgtagaaccagaagaacaagccccagactacaattgacttgaggggcagcactgcccgtaccctggaggccatgggaccaccttgtccatgactctctgtttgttggtttaacacctgttgactgatgagagcttgagctatgggcaggatccttcaggtgagagacacaggcctagtgagctgaggagctccaggaccctgtgcagaagggaagttcctacattgtctttcttcctgacaccccatacccttcttcattaatgccaaatttcaccccacagcgttctcaagactcagattaattatgttcagttcccccatactagcaaggatagctcaggcttagggcagagtgaggtggtgatggtgcagcctggtcacagtaaatggtctcaaacagcacattctgatcaactctgctgtgatgggagggaaggtcagtatcttctatgatataatccactgagatgatgtttcctgctttctttttttttctttttttgggatggagtgttgctctgtcacccaggctggagtgcagtggtgcaatcttggctcactgcaaccgctgcctcctgggttcaagcaattctagtggctcaacctcccaagtagctaggattacaggcccgcaccaccacacccggctaacttcttatattttgtgtagagatggggtttcaccatgttggccaggctggtctcgaactcccaacctcaggtgatccacccgcctcggcctcccaaagtgctgggattagaggtttgagccaccgtgcctggcccctgctttcttttataacttggctagagaggcaaattgaaccatttgcatcatcatgccagagaaaccagttttaaggtcttcatacaaggttccaaatggtctattctaaaagttacttgtgctagttttaggttagagggtttaaacaaaatcagagtattagcttttgttttgctcaacaaaaagggaaagagaggcaggcagaaagtcaggcaggctggaatgcctattggaaactcctggatctgcaggtttcccctgaaatctgggtgataaactaactcctgttgttttccgttgatcctagagatggtctcgaggactagaacaaaaggtccaaagcagtttttgcatagacttgaagtggtaattatgcttttgagagagaagcacaataggctcaggctgtgggcttgcccacgtggtgtgagagggacaagagcacaggctccctttgtagtccattcctattgctctacttagagcaggtgctccgggaggccctgaaggaaataagcacttggctaaagcctggccagggtaaccacacttatttttcaaactgagaacccataccaatcatcttttctaattttgggagtgcagacacgtatgaagctttttgtgaaaatgatcctgtttataatactgcatttttttcagagtcattggtgtagttaactgattcaatcaacaagaatttattgagaaggagtctcactcatttactccacaaacatctactaaagttcttctaggtataggttctgtgctgagtgtttaagagatacagacacaaacatgattcctactctaccagaaacttaacagtctagaaggtgagacagactctgaagcagctacccaaatgcactgtggaaaagtgcatagttccaggcttggacaaacatatgcacttagggatcccagaggaaagggtaataaactgcctggggactagggagggcttcgctgaagagctgatggctgggagagtcaatagagtttccatcaaagaaagaaacagcagaaccacaggtgtgtgggtgggggatcttacctaagttttggggctgagggagtggtcggggaagagaccagtgtattaagaccttgtgggccatgctgtggggtgtgaagtttatctgtcaacagggcctcggggttgttttcggcatgactgctacagaatcatatcttgtttcagaaaggctggcatgcagtgcagaggaaagatttaggagtagattatagacacagggaagttgggaggaggtaagggttgctgagcaaaggcagtggcagagagagagaggcaagagatgggtgagcgaattcaggggaggtgcccctaagtgatgacagattctctatgggcatgagggaaagggagggaatgggacaaggtcaggtgctctggctgtggtggataggtgggcaatggtgccattagccgagatagcctgggatcttctcatcactcatccttttaaagtctgtttcccagtcctggccacatgttagcatcattaaagcttcaaacacatacccatatttgggccccatcccctactaatcgggctctatgaagatgaggctcaggtgttgatgtttataaaggctcatgcagccggggttgagaactactgacgtgatcccctaggcagagatcattcctccctgctctgcatatgcctttgtcttccagacctctgttattgctctcccatgagtatttatttatttatttatttatttatgagacggagtctcgctctgccacccaggctggagtgcaatggcaccatcttggctcactgcaacctccacctcctgtgttcaagagatttttctgcctcagcctcccaagtagctgggactacaggtgcgcaccaccacgcctggctaattttcgtgtttttagtagagatggggtttcgccatattggccaggctggtctcaaactcctgacctcgtgacctgcccagtttggcctcccaaagtgctgggattataggcatgagccactgcgtccggcctcccatgagtatttattagcagtggagctcaccaagaacaatgacaagaatggacatttccagggaaactggctggacctgatcttggccttcaggaattcttttgtaaaaccgtcatatcaccaggcccacagaggacaacattttacaggcatttcagtcaattacacagtgataattcactgaacaaatcctttgggatcacagctgctttattgagatcaggtctgtgcacaaagaggaggcccagggaaaacacagtggggctgtgtcaggtggcgtccagagggcatggtgcagctgtgggcctggcttggggcaggacatttctgggattacagggccctgccccaagcttctccgttgagggggtagggagggcaatgcagagagtgagagggtgccagggcaggctataagctaatttgcctcttgagaagtagggtaataataaggttggagcagagaggaaatctttgtcctaaggcagtgcttctcaaacttttgtgggcccaggaatcaccttgttaaaatgtggattttgactgagcaagtgggatctggaatactgtgtttctaacaagtgctgatgtgacgccaatgcatctggcccaaggaatacgcttagaatagcaggatcccagaatgcatctctatttttctatatgacttttagatcagttgtgtatttagagaacataaagtttttaaaaagctctttaaaattttatccttttcaagattgtctcggaaaactttgcattatttgaaaagatacttcgaaaatggaaactgaatgaatagcactggagtgcagtggcgaggtctcagctcactgcaacctctacctcccaggctcaagccatcctcccacctcagcctcccaagtagctgggaccacagcacgtgccatcacacctggttaattttttgtatttttggtagagatgaggttttgccgtgttgctcaggctggtctcgaacttctcagctcaggcaacccacccgccttggccttccgagtgctgggattataggtataagctacctaccgcacctggcaagaacatataaactagtctactatgttctaattataaaacttttttttaaattttttttccttcctgggaatttgagggatcaggattgaccttttttactggggaaatcacctgtgatttctggaaaggtggggagggctgctggtcccttaatgtcccttctaaccagcttgtcaatgcttagtattcctttgacagtgggcaggtctttcattttgcaacaaaggtttgcctgaggcactagctcacagacttcattcatactaaggtgtgaatgacagcagaggagcttaggctttgttggggtgatagagagagaaagagaaaggaagaaagagaaagacagctgaagacaaatgaggatgctggttagccagaggaggtgtatatggtggcacagaattattaaggggaatgagagtggtggaggagcaattaaatatatctacctctaacttcccaatttttcgacttttctctttttttcttctgccctgtcatcagcacgttggttgctctctcctcctccactctgtcatcctcttgctattctttcccttcggccctctaacagttcagtttcaggtgtaaaatattttggttcaggagggactggatatcaactagacctaagattttgtgatttacattccccgtcctaagaaaaggaattatgttgagtgaacaatgaccaaagctggacagttccccctggtggtcagcactgcgacaacacgattttcctctatcttttattcattaattggtgaatttgaaaataatctgttaagccccaaacatgacagacattgtgctaaggacagacatgacacctgtccctgtggggcagaaagtctgaagagggagtgtgttactaaacattgtagagcatttagcattttcaaaagccttaaaaaataagccagaaaacttgaaaggaaaaaggcttttaccatttttaaagaaaagcaggtagaaaggttttgtttctgacattttttgtaccactaagtcttcaatttgggtttagttcttcaattttcatcgtaaaatttccccaaataattttttcttataaagtgtgagtatcaaatcagatcatgtgtagtataatttttaactccgaatgtgtaacattcacagtccctttattagcaaaattatagtaattaaataatactggctttataattgaatagcactttgcaaaataatatgtctggctcatctatattgctatagaatactactgccccagtgctgtatgcatatgaactggttaatcctcacaacagcccttataaggttcaggttatcctcattatccacatttttagatgaagaaactgaggctcagagagataagcaatttgtaaccctagccttaaccactttgccataacaagacagaagaatgcctgcagtaagtgtaaatgaacttactgtatcctcactgcagacagaggactaaaaagagtaatggggtttgcaatctttctgggtgtgtgtgtatgagaatgaagttatcacttgcctccagtgatcaggttgttaagagcacctcagaggccactgttgtcctacccttcctgtaagtggtagagatggctaatgagcatctgttggttaactgattgatgatttctcaaggctttttacagccttagaattctattagtcactctacaagaaacaggttgtatggaacgaaaggtaatttatcttttaagaattaagtgaaatcctttaaactcttgtttttgtgcctaaagctatattctgatggaaatgctctttctctagctatgtcagtggtacagtaatttaatctggttcttgaaattactctttatctcatacatttatttaagtaaagatagccacattagatatggagatgctatgaacaatgcaacagaatcatggaatgtttgtaaagctgctgcagtgattacaatgaaaatattgatcatttccttataacacacacacacacacacacacactatatgacccccatctaaaatctttgaaatatatccagtatctctgggtctggcactgaacctggcctggcatagcacagatgctcaataagtgacaaattgagtgaaaaccaatattagattaaaatattaaaggccaatatgcccatttctactctgtatagctgttccagtcaaagtattttggaaggatgagtgagaattacagtagggaaaaataatttgttccactgaaaaaagaattcttggcctggaacattttctgaaagttaagtttaacttttaaaaatcagaattttaaaataatgcgacttaatttgggctgaagtttatttttgagttatctgtaaatagatggtaaggaaatgaataaattaataattataagatgttactcagtctaagagaaagaggcttgtacaggtcttgagcacattgtagccaaataattatgtttaatataaatattactcatatcttttaattaaggaaaacaattaagtttaagcatattactatattgtttaatataaattaaacattaatattaaaaatattgcttaaaataaatatttagcaaattatattagtataatatagtaattatattgttatatactaatataatttgctaaatatagtaatatttctaattaatattagtaatatttctaattgaaaacatttttaggagttcatctgtgcctgcatatagtaatatattttttatttttatatttttgccattcttattcaaaatagtaatgaagttgtacttgtttttaaagctagtacttaaaaatggcagacagctttccccctagttggtgcaaaattgtagattttcatggtatgttgtttaaatggaatttgcactgctgcagtgctaatgaaattccttattaaggagagagatgagtgccttttatgttcaagagaaatgttcaatggccattaaaatactttgactatttgattttttttccctcgaggtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggtacatcccaaaacttctagaactgtgacctgatttggctttaaatatttgttttgctgtcttttgtgatcgtgtatgtgttgtgtgtgtgtgtatatgtgtggtgagatttgccctagagaggatctcagctatggaaacttgatggccaccattgagcttagttcttcctatccattctggagaatgttgggaacacttaataatttagctctcaatgaaaaacaggacattaaaaatgaatctacattttagaagcatatttataataaaaattatgatgttaggacaccatttctcaaaatatgtgctgcagaacatgtgtcccatataattatccaacaaaagaataagttggggaatgccgtatactaaattaatgttaaataaaggctcccaagaagtcctgcaataaggaaacttgttaaacttagttaacccagtttttcccaactcattggctattgtgtcttgtctttgtgggtatgtgtatgtaaaacacttatccctatcttgtggaatagtgttctgtggagcatgctttaggaaatgctgagttactctattatggtagttttcagtttttttttttttaagacggcatctcactctgtcacccaggctggagtgcagtggcattatcttggctcactgcaacctccgcctcctgggtccaagcgattctcctgcctcagcctctcaagtaactgggattacagccacccaccaccacacccagctattattattattattattattattattattattattctatttttagtagagatggggttttgccatgttggccaggctggtctcaaactcccgaccttaggtaatctgaccctctcggcctccccaagtgctgggattacaggcgtaagccaccatgcctagcctattggtagcttaaagttttattttaaatttttaaatagagatgggatctcactatgttggtcaggctggtctcaaattcctggtctcaagtgatcctcctgcctcggcctcccaaagtgctgggattacaagcgtgagccaccgtatccagcctggtattatggtagttttaaatgtttgccatcagctcttctgcattcttaggcagatgaactaaaggaggacatacacttacatctgtttctaaacttgttttcccttcttatcctcaagtttagtagatatatggatgtctcctgccacatatttcccacagtatcttgaaatggtgatgcatcttgctgattttgtttaaaaggttttctttattttgagacagagtcttgctctgttgcccaggttggagtgcagtggcatggtctcggctcactgcaacctccgcttcctaggttcaagtaattctcctgcctcagcctcccgagtagctgggattacaggtgcctgccaccacgcctggctaattttttgtgtttatagtagagatggggtttcaccatgttggccaggctggtctcgaactcctgaccttgtgatctgtctgcctcggcctcccaaagtgctgggattagaggtgtgagccaccacacctggcctaaaagtatttttaactagaaaatatttcaaaaatcacaaaaattaaatagtgcattacagacaggtggttcagtttagaatgtatgtttcccttctgtctttcacatgagcaacattttataatttctaatagcatttattttatttttaaaaatttaaattttgcctgttacacagccctcaggaggtcctgagaacatgtgcctctcaaatagcattttaaaatctatgtgttgcttgacttgcagcaaagattaatgccattctgattttctactaatttatttctattaaaaatagtgatattatacatgacatcgctaatatcaactgggtttcctatactatagtaatgtgagtcaggatttttctttattttggactatctgtttagaagtctatgtttgggtccagttatctttttctactgataaaagtaatgataggtagtgctgtcctgtgcagccccttcagacctgaaggatgtatttccccagcaggtgggaattgccgccgctgaagatagctgcctttcctgaggtcatgcctccttcctggaatctatgcaggggtgtataggcccctttgcatcaacttgggctaacgctgtaggtcagcccagcttcagctctccagggcatggacagaagccttcattctgactacattgcatcccagcttctctctctgcccatttagcttcatttcctgcctcactcccccatgaatgttgaactcaacggcactctccagtaaactttctgcacacagatctccatctcagagtttatttcttggggaacctgacctataacactaggtatatatatattatgtgtgactgaaatgtgggtcaagtggcatggagactgtgtttatacttattttcctattcacagggcatgccaggttcatgcaattttagtggacaattaaaaattactttacaaagtatctcttgctttagtagcatttactagttgatgtgcacctggtggcagtttcaaaatgttttcttccatttagtaattatctgttgccagatactgctccacatgcagggacacagcagtgtgaacagagagacaaagtccctgtcctcatggagcatagtttctagtgggggtaaacgaaaaatagttagtagataaataaataaataaatatgatttcaactaataacaaattccaagaaggtaataaaatagggtaacgggatagagagtgactggagggctttatcaggggtagtcctggaggacctccaggaggatgtgacatttgagctgagacaaaaatgatgaagagcagatggtttactattaggttgctgcaaaagtaatcacggtttttgccattagttttgcagcaacctaatagtttgtaagatggcttgtttcaattagataattttgggtgcattataaatcttaagggggccaatggctagatacatgatacagccatatattcaggtagagggataattgatcatatgtctagtcagatctgtaaattttttttcagtatacatattctgtatacattttataaaaactacgtttgacttagaagacagttttggtgctcttgaagacttgaccctggcggggaggatttgaggggctctgttgttcaaaaggagagcagagcgcctcacttggaagctactgtaggagggtagagggctgtgtctgtgtccaaagggtgaggtttgtgcagtctgtgccacatgtataaaataggactgaagaggtgtgagtgctgtgttgcatttgttaatgctgcctgtgttttgcttttgcataacaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaactattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggctgaagcgggtggatcatgaggtcagaagatcaagaccatactggctaacacggtgaaaccccgtctctactaaaaatacaaaaaaaaaaaaaaaaaaaaaaaaaaaattagttgggcgtggtggcgggcgcctatagtcccagctactggggaggctgaggcaggagaatggtgtgaacccgggaggcggagcttgcagtgagcagagattgcgccactgcactccagtctgggcaacagagtgagactccatctcaaaaaaaaaaaaaaaaaaaaaaaaagaaatatatgaaatgaatacatgcataagattaccactattcaaagcctttcacaatttttccttgaaaacaggaaaaactttgtccacagaattccatggaattttcaacctttggcaacttgtagagtagtcctgtagaattaatgtgcacctaaaagccacatttttaaagtttagaaaaccagttttacaaaattgcacagaatatatatcaggtaagatatacgtgtgggtggtagggagttgggggagagtggaggagagttgtgcgggagtggagggaggctgtaggagatatgaagggaatcagtgcttataaaggacgaacctaacaacctctccaccctcctttttataagaaatctgccttgtgttgaaattaaatttttattgagctactaaagttaatatttcaaaaaggcatcagtacttcatagaagacagagcatgaagcaccattttagccactgctagcactcacaaggcttggccctagttcttcaggaacagcaaaaggattgactggcaaaaactgaccatatttgtaacaacagtcctcaaaatcccatcaatcaattcttccctgttttgtctcaactctggctagactgtcccaccgcttttgtgtagacacagggtagattttgatgttgtctctcctagaccctccccatcctctgcaactactgtattccaaggaacttatacccttagccagggccctaaaacacagggttatgtgtattctgttgaatcatatgtaatcgccaatatttacctttcttgatgggaatttcacgggctcaatctaattatccacatatttccctaggtcatatgatacaagcactttttgttatcctgcttagaaatggcaatgaaatatgaatttgactaatttttaaagcaagacagagttgctagtcaagaagcaaatagttgaattacaaaaatccatagatacaagctacagataatattgtgcctttaaaatcatctgtaaggaatgtaatcattttcctctgtaaggaaaaggaaaactgattagattaattgccccaagttttaaaatatttcagttcatttccgtgagacttcctggggaagaaaggcacagcatcattagactctgggttttgctgcttacccttcatgtatctgcactcgcacagccttccaaacttcagagggaagagtggcttctttaaataatatgactgtgcgtgttgacattttcctgagaagtcccttttgtagaatccagaattgtgaactccatgaaatgtaatttgcagtacattctttaaacagaagagggtgctctcgggcaagctgatgctacccagctctagaaatataagcatttaaatttggtggtgcttgtattatgattagtgcaagatcttgggggcatttaataaagcatttcaaagcattgtgagtccagtggagtataattaaaattaatgcaatagacaaacacattaaagtattcttaatgcctagtctaaaaatgctgtcaaatacagttttacacatccgaaagatttaaatactatgcttgtctctgaacatttctaactgttacagagaaagaaaaacagtgtcttccttctccacaggtttcaaacaaaatttttctaatgagagttaataaaatcttctttctttaaaagatttataagatattataattaattcatcctgctttggcatgtgtcaaggtcaatgtggtctctaaaaatctccagtccaggattgtactttcagcttcttaggtaagaacaagcaaagatatatgctttcaggagaatatttcatgctgccttgactcagggacaagccttggttctgtttcagtcctcagaaaggagtaatgaatattgttcttttcaagatgggctctgtatttctctcagaaatctccctgggtggatgttgttgttttttgtaaagccagttaggacactctctttccaaaagtcttatatcatgagtagtctatgagtgtagctgtacgcacgcagcattcccaaagccttctgaagtacagaaggcttcctaaagacattggctgccagtttggcactctgagtcacctcaaaatgctatgtgaccttcgttccaaataatcatcttgctgatcattctaattttcttaagtgcttactatatgtctgcatttttctaggtactagggacaagtaattacaaaaacagttaattcctgctgttatagagagcatataatagtgggggaagtcaggcaataaatatcaagttgtgattattgctatgcagaaaaataaagcagggtaaaacaataaagagtggtagaagcgtgccattttagataggttggtaagggacgttctctttgatgagatgacattctagcagcgagacctgaaagaaatgaggtagagtgccactcagatccccagggaagagtgtgtccagcagagggctctgctagtgcataggtgcgggactcggggtgctaacccgtcagaggaacatcacagaggacagatggctgctggatggccatatcggagtgagcaagggggtgggatggaggtggaaagagatcagagagattgtggggaggtgggggaggcagaccacctagggttttgtgggccatggattttactctgagtgagatgggagcccctggaaggctttgtgtagaggaggggtagaactttgttacatgttaagatgatcgtgtggacataaaaaggaggtagaggcagaagcaaagaaagtagttaagagtctattgcagtatctcaggtgtcttagtcctttcttgctgctatacctgagactgagggatagcagaaatttctcacaacacaaatttctcacaatcttggaggctgggaggtccaagatcaaggtgccaatagattcagtgtctggtgagtgcctgtctgtttcttatagtaggcacgttcttgccgtgtcctcacatggcaggaggggcaaaagggctccctgaaccctcttttataagggcactaatcctgttcataaggacagagccttcatacctaattacctcccaaaggccccacctttcactaccatcatcttgggggttaggtttcaatatatgaattttgcgtgggacacaaacattcagatgatagcatcaggtgagaggtgacggtgattgagagtggtgacaggagatgaaaaatggttgaattcagaacatatttgaaatatggagccaatagtatatgccgatggattagatgtggcgcgtgagggaaagaagggaaccaaaacaactgccagatttttggcctgagcaacgaaagagtggagttgattttatggacgaggggaagggtgttgtaggagcaggttttggggagaaagatcaggaattcatgtttggatgtgttaactttgagatgcctattagacgtctaatggagacagcaagtagcaattgaatgtacaaggcaggaaagagggctgggataaagatgcgcctcttagagatatcagcgctttcagccatgggactaactgggatcacctgggagtaaatatacactaggagtgggctgagaattgagcccttgggctccctggagtttagaggtcaggaaaatgagggcaatgtcataaaggacactgaggaagagtagctggagtagaagaaaaaagagaatggcattcattccaggggtcaagtgaaaaaggatgtaatgagtttcctcaaatgctgctgctagagtaagatgaggactgagagttgactactgaatctagcaacatggaaatggtgaccttgacagaaacagtgtcactgaagtgagagcaatggaagcaaactcaagcaggtttggactcagggagtaaatggctttgtaggggaagcaaaatttccttctaccctcttcagttctgttgttggtccaagaattaaactgacataagacagattaacaggagaaaagcataccaattttattaatatttttacacggacgtggcagtcttcaaaagggaaatgaagaccctaggaagacagtaggccgtgaagcttatatacattttcacgcaaagaacaataaattatggggatgtgacaagacaaaggggcttgggcttggggcattaaattgtaggacagtgcctaggaaatacatgggggaaattaacgaaagacagggtcgttttggtagtttgttgtggaagtccatttcggcatcaactcctagtctctggtgataagaatgttctcttcctagtacagggaaggcacctttttcatggaaaattttatgatctgtttttaggtagaaatgaggaggtcagagagcctatgttagtttgttttgcatcgctgtaaaggaatacctgagactcagtaatttataaagaaaagaggtttaattggctcacagtttggcaagctgctcaagcatggaaccagcatttgcttggcttctggcgaggcctcaggaagtttttactcatggcagaaggtgaagcgggagcaggcatgtcacatggtgagaaagaagcaggagcgagaggaggagcttccaggctcagctctgcatgaatgaacagagtgagaactcactcattatcgcagggacagcatgaagacattcatgagggatctgcccccatgacccaaacacctcccactaggctcatctctaacactggaggtcacaatgcaacataaaatttggaggggaaacacatccataccatatcagagcccttctgcatgagctgtttctcaagtgccttcagattaaaataatcaatatgccaaaacagcatattttgggatggcacgaatcccttcagccccctttttttttgggaatagagtcttgctcttgttgcccaggctggagtgcagtggtgccatctcagttcactgcaacctccacctcccaggttcaagtgattcttgtgcctcagcttctcaagtagctgggattacaggtgtgtgccaccactcccggctaatttttgtatttttagtagagacaggggttcaccatattggccaggctggtctcaaaactcttgacctcaggcgatccacccacctctgcctcccaaagtgctgggattacaggcatgagccagtacacctgttccccttcagctcttttgaggagttttgctgtcaatatgaacactggaacagtggctggggaggatgagatctcaatacttccctgacatcccttaagactcaagtcttgatactttgtctgctctctggctctttctttgtcattactattatttttatcttcttgatgttgactcttgctaaaattttttgtcttccttattgttaatgcttatagaaaatgattccttgttatcttttagcccatgtcatccgaatcatttgctgtttctagcctaggtgctttgactatgccagcttgtatttcttcagaattttcattaactatatgtgtggtattgtaggcattacatattttaaaataaatttagccattgcttcaatcacatcctgctttgttttaaaatttttcttggttgaatttcactgggtcaatgtcatttcatattaggatggtaatcccacttcaaattttcttatcaaattcagaataattataaaccagttgctggtttcataatcttaagaatgccaacaaagttcctgcaggataaaaaaagcacacctatttattcatagtttttatatctacctaatagtttgaacttcgattctttattatagatgatacactaatattctatgtaaataattgtccagtaattaataagtgaattttaataaaattaaagtatctgtgaaaggtacaatttaggcaactgtgaaatcatactattagtgggatattttattgttttgattcattatttattttaaagctgttttgtatggttcaaataaggaggtgatcaaaatattatttcacgactcacatggcttattgtcacacacagggaattttttccatgatgtttaaagagggaaagaatcacaagaacaaatctcatagggaatacacttgatagatgaagtacattaaccatgtaatgaatgagttccaaaattactaaagcctagttgctcaattaggatgaatgcaggctctatggaaagtgaaagctagttgaagtgtcaggtatgagtgtaagagaggattttgggagagatagcttgatcagcacaacagagatccatgcagacacaggaggtccctccatgcaagagtgtgggtgttgctgctgagtcttcggagatgaccccaaaggctaacaggatgtagtcctgccatacctggagctcacgatctttggagaagcaactcaacagagtgcagtcatgccatggcctaatctctcaaagtgtctgccaaactattagatttgtaggtaagtcatgcattacttaccaatgggaaaatgtacaaaatgagaaatgtgttgttaggagacttcgttgttgtgcaagcatcatagaatttactgacacaaacctagatagtatagcccactacacacctaagctatatagtatggtctattgctcctaggctacaaacatgtttttggtaacagcatgctactatactgaatactgtaggcagtagtaatacaatggttttgtgtatcgaaacatatctaaacaaagaaaagatacagtaaaactatggtattataatctcatgggactaccattttataagccgtccctcattgacagaaacattgttatgaagcacaccactgtattttggagtccagtagttgaagtcagtagttcacatatggggtttgataaggtgtgatgtaacattctcggaggaagtgggagtacatcgcaagttcttatcatagtaaaacatatgtcactcatagcaaactatacatgtgttaggaataatttcaaagctgtgcaacaaaaacagttcacaattaaaatagaagaataaacttcaatttaaaaatattattactcaaaaatagtaaatatttaatgtataaagtaatgaaacaaaacttactaaacaaaaatattacatcttgcaattcacactccattttagtcttttaaatttaaagatacaaataaaaactccaaatggtcacatagaatgacagaattgaagtaacctaagtttggctgggcacagtggctcacgcctgtaatcccaacactttgggaggctgaggcagatggatcacctgaggttgggagttcaataccagcttggccaacatggtgaaaccctgtctctactaaaaatacaaaaattaactgtccatggtggtgggcatccataatcccagatacttgggagggtgaggcatgagaatcacttgaacccaggaggcggaggttgcagtgagcagagattgtgccactgcactccagcctgggaaatagagtgagactctgtctcaaacaaacaaacaaacaaacaaaaaaattggccaggcacggtggctcacgcctgtaatcccagcactttgggaggccaaggcgggcggatcagttgaggccaggagtttgagaccagcctggccaacatggtgaagccctgtctctactaaaaagaaccaagaacaacaacaaaaaaaactagccagacgtggtggcagggtcctgtaatcccagctactcaggaggctgaggtaggagaactgcttgaaccggggaggtggaggttgcagtgagccaagatcgcaccactgcattccagcctgggcgacagagcaagactccatccaaaaaaaaacaaaaacaagaagtaacctaaattctatttcttcatctttacaatcacagtttattttaaatctattgtttaaatccaagaatacatggtaccaaaggaatagagacacaaattgcacctggaccattatgaatcccgagacgaatatgggtatcagtccacatgtgtcagaggtccaagtgtataactgggagttctccaaattaacttctatgtaggatacaatgtttattatacgctaagaaactaaaaaaaaatgctgatttgaatctttcatttgcattattaaaactcaacaattattatacttattgtttagaatgcgtgccaatattaaataaaaaattggtggggaggggagatagagtatttaattgtggacattcttttgccagaattgccagaacatggtgataatcaaaagctgactgactttctgttgtttcatcattgtgtttaaattatcagtaaacaatgcttctcattattgcctgtgcccaggactgcccacttccccatacttggtacaccactggattggcagtgatccactgttgaaaggaattggcaatgatccactggtgaaaggaaaattaatgatgcagcagggtgcagtggctcatgcctatagtcccagcactttgggaggctgaggcaggtggatcatctgaggtcaggagttcaagaccagcctggccaacatgtcaaacccgatctattctaaaagtacaaaaattagccaggtgtggcagtgcatgcctgtagtcccagatactctggtggctgaggcaggagaatcgcttgaacccgggaggcggaggttgcagtgagtcaggatcgtgtcactgcattccagcctgagtgacagcgtgggtggggaggggggaggaaaagaaaagaaaattaacgatgcaaaggagagagagagagacaattgctaaggccatatctctgagcagatgagaggggaaaggacccaaggcgccagcagaggggctgacagataaaagcacaaacagttcatccacggcaatgaggcaagacagagtctatgggtacggatgaatgcaggcctgtcatctaaggtgttctttcttagtttctttcccagaagtggaacaggggattcagagacttttcaccatcccagagatggaggatcctgtttctttaaggactctttattaccgattttaattttctttttttccccctgggtttttttgtttgtttgtttctgtttttgttttttttttgagagagaatctcactctgccacccaggctggagggcagtggtgtgatttcagctcactgcagcctctgcctcctcggttcaagtgattctcctgcctcagcctcccgattagctgggactacaggtgtccgccaccatttctggcctatttttatattttcagtagagacagggtttcactatattggccaggctggtctcaaactcttgacatcaagtgatctgcccacctcggcctcccaaagtgctgggattacaggcgtgagccactgtactcagcccaattttattttcttgaaaagtttgatcacttcctttaatatgtgttctttaaccgtattttttttttcatggtagaggttgccgtggatgtcactggtattaatgcttcaatatcagctatactgactcaaaagaggacattattgtgattttagaactgagatgatcaattccctctaacagggaataaatggttaaggcagctctgatttgggaaatacatttgtgagcactctagagttcagtttctttttctgcttttcatctctgagagagacgctacagagctgtgagtggccgggtgggggtgggagaggccgcccgggagcagtgcttgtccttttctgtagagttttattttgatattttcacactgctcagagagaattccatccaaaggtcctcaagtgccatgaaaaggacaaggaaagagcatctttgaacagtggcattgttaaatgccaagagcctgcctctccagtggataattttgagatattctgaaacacttttcaaaggctttgccaagtactcattgtggaaaaggacacattctatattaaactctcactgggatcagagatggccttgggtaagactgtgacctagacgatgtttgtagccctctttttcttgcctcttcctccatcagtgatgctccagtcccttcccccacacctcctcaaggcttttagggtctccctgcctccttctttttgtcttatatgattgagtgccacggaagggtagatgtcagtaacttagatcttggtgttcttctgctgcaggcttttccagtggagctacttattcctccaaaccccacagacctttaactgcttctctaccttcagtgtggctgtcctccatcctccagtccaccctttgtgctgcagtcaggaagggacacattatcttgcatttgcttaccagtgagccttagctttcaccacagcttgccttattctctaccctctagccaaaccaaacaaactgctctgttttcctcaaacccatcatgttctcaaaccctgcatgttctcaagccccaagttttggctgatacagtaccctctccctggaatattcttccttgcccccttcctctgtctcctactcattccacagacctcagtttaggggaccaattctaagaagccttccctggccctccccattcaggttaggtgaacctcacaggtattttttttggtactaatcctgttatattgtaattacttgcatctttttctttttgcccaccctctttgggattttgactggggtggctctgcccagttatttctctttttctgggaagagaaccatctgcaggggtggtggtaggtgatggtaggagcaatgccagtgatatggggctaatcccctggccagagattacgacctatgtgttcaataagaaacactacatgaatgaatgatcggataaatttagatcaatgcactacttttctccctatgatagttgcattttaatccgtaattttctcccacatataggctagaaattccattttataagagcttaagaataaattcatatcaataacttttaatgagtgtttttcatatttgaggtactatgctaggaactcaaggggcatataagaatgaataatacacagcctaagccctcaagaaatttaaaaatctattacacttatggttgcaaatgtcctttaaaaaataaacacatacacatatccaaggggttgaaaaatattaaaatatttgttttaaaatttgatttaatcttgtttttgaaagctggtaaaagtggagaggaagcacccttagctttttagcacctgttgtttgtctgggactgtgttttctcatttaatagccagcaacttatgaaggaagtgttacttttctctctctctttttaaatttttttttgagacttaaaaaatttttttttgagtcttcctctctctcccaggctggagtgcagtggcctgatctcggctcactgcaaccttcccctcccaggttcaagtgattctcatgtctcagcctcccaagtagctgggattacaggtatgcaccaccatgtctggctaattttttgaatttttagtagagaaagagtttcactatgttggtcaggttcgaactcctggactcaagcaattcacccacctcggcctcccaaagtgctgggataacaggcgtgagccaccgtgcacggccaaggggtgttgtttctcatcatgaaatgaaaacatctctcttgttaaaggtatcttggaacgcttgtgtggctgtagatggctttttttcttgtacttgaaacaatatcccgtgcttaatttccttgacctgtccatgtaacaataagatgtaacttcaaatgaaaaacattcacataaagaatcattcactagctcatcccatgtaaacacatataagcaaacactgacgttgccactttcaaagccaaaagaaaatgcaatcacaagtagggatgatagtggtaggaaaggggccacagtggttttctgtggtgtttggatagaatacagtggttattgtctaaaagttttctgtcttgatgaccctttcttggtcctttggctagaaaaagcaagcttttttatgtttcctctctgaccattggtatttctgggttgccagcttctccagcacccaatctaggatatgggaggcaaaaagaaaatcagagaactcactgctatgtggctgttgggattgcgaggtccataattggcctgccatattctcctcacttttcagagtcttcttatgtttgtttagatatataacattttagctgttcatagcagaatgaataggaagaagtgtgtttattttatgttgtccctgcctctccgaatatttgaagcatctaagacaacagaatagaacagtcaagatgctgccacttacctcttataaaatgagacaaattaggaaaaaagaaaagcacagttatcgagggaacaaagctggttggttttctgcaggtcatagccttaagttcaaattatttgtctttatctccaccttgtctaggttggagaattaactggagacaataaacattattgttgctaatattttatgtacatgtatgattatatgcattacgattaaagaaatgaaagtataaccatttgttaggtaggaaattactgaatccttatcaagaccttgatgagaatgttgaaaaagtagtgatgaggaaaattgtgtttgaagtcatcccacatactttttatgagttaattataattagtaatacgtgcacgatatatacatctcttgaatattaaaatattttgaagtaggcagtcatatactcattaacagtgttccattgcattgtgtcacatggtcactttaactgaaatcttgttggagtgggaggaggaattcatcatggtggaatagaatcagatgttcaaataaagcaagttgattttggagctgtattagaaaattgaaaatgttacaaaagtgcagagtataaaataaatcagaactgccaacactgtaaccatttcaaagttacagggtgaggcagagattatctggattttcatttcctgtaagatgtaaaggatgaaacagggtcagagaaacaccctgggtttagtgcattggttgcaaaatgttcagaagttaattatgaatatttgctgcctttagtcatatgctcaaataccaacttgtattttaatcaccaataaataattagagtctatacaattattgaaatactttgtatttgactggaaagtttaatacgtaaaaaataatgggctgcctctaaaatatttttctttcctttttttcttttttgggacagagtctcactttgtcgcccaggctggagtgcagtggcatgatcttggctcattgcacctctgcctcccaggttcaagcaattctcctgcctcagcctcctgagtagctgggattacaggcatgcaccaccacacctggctaatttttttatttttagtagagacggtttcactatgttggtaggctggtcttgaattcctgacctcaggtgatctgcccgcctcggcctcccaaagtgctgggattacaggggtgagccactgctcccggcctttctttacatttttatccaacaaaaggacttcacaaatatggcctttgctcacaataagcaaagtgaaattatttctttactttcagaagagtatcactaacacctccaggcaaaagtagtgaggacacatggggaagaaaattaatctgattattaagatttgcttaaatgttgcaaaaactggtattgattatcagtaataaacatatatattatatattatggtctctaaacaaagtaggagaaaaatgaaaatctgatgctccaaattgtgttggccagttaagggggagctttatgctttggcagaggtgtaattcaaaggaataggtacttaaagaaggactaagttttggcatttcttttttattcattatttactaacaaaaaatagccactgtaaaattgcctcactgaggctgtaggatcttgaaatttcaattttaccatcaaaagtaccttgtaggctggatgtagtgactcatgctcataatgccagcacattgggaggctgaggtatgaggattgcttgaggccagcagttcgaggctgcagtgagctatgatcataccactgcactccagcctgggtgatagacctagaccctgtctctctctctaaaaaaagtggattgtttatgcaacatacttcctctctgagtttaaaaaattgacaaaagaaatgtaaccatcatgactatactattctgcatatttcatgataatttgataagctatcaaacgtaagtgttaaaagattcttttacatacttttcaaatgctcttgtgactggtgaggtcactcaagacacttgagattacaatgagggacagtccaatcagagaatgggtgctggtttagttatttcacactgtgtaacaaattatccaaaatgtaactgcaaataaaattacagatattcatgatctcatatagcttctgaggatcaggaatctaggagatgcttagagcgtagatttggttcaagataactcaaagatatgtagtaaagcttgtcagggctgcaatcatctgatagttcaactggggaaggatctatttccgaacttacttatgtgactgtttgagggtttctcatacttgctgactgtgggctggagtctcagttccttgccaaatagacccctccataagctacctgagtatcctcatgacatgacagctggcttcctccaaaatgagagagtgagcccaagaaagaatccacagctatgaataaccttatctcaaaggtgatatgctactacttcttcttttttttttttattttaatttaatttttttttttattgatcattcttgggtgtttctcacagagggggatttggcagggtcataggacactagtggagggaaggtcagcagacaaacaagtgaacaaaggtctctgttttcctaggcagagtgtttgtgtccctgggtacttgagattagggagtggtgatgactcttaatgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccattcgatttctcaatcttttccccaccttgcccccttttctattccagaaaactgccatcgtcatcatggcccattctcaatgagctgttgggtacacctcccagacggggtggtggccgggcagaggggctcctcacttcccagtaggggtggccgggcagaggcgcccctcagctcccggactgggtggctggccaggcggggggctgacccccccacctccctcccggacggggcggctggctgggcagaggggctcctggctgggcagaggggctcctcacttcccagtaggggcggccgggcagaggcgcccctcacctcccggacggggcggctggccgggcggggggctgagccccccacctccctcccggacggggcggctgctgggcggagacgctcctcacttcccagacggggcggttgccaggcggaggggctcctcacttctcagacggggcggttgccaggcggagggtctcctcacttctcagacggggcggcctggcagagacgctcctcacctcccagacggggtcgcggccgggccgaggccctcctcacatcccagacggggcggcggggcagaggcgctccccacatctcagacgatgggctgctgggcagagacgctcctcacttcctagatgggatgggggcccggacgaggtgctcctcacttcccaggtgggatggcggccgggcagagacgctcctcactttccagactgggcagccaggcagagacgctcctcacttcccagaggatgggcagcccggcagagacgctcctcacttcccagacggggtggcggccgggcagaggctgcaatctccgcactttgggaggccaaggcaggcggctgggaggtggaggccgtagcgagccgagatcacgccactgcactccagcctgggcaccattgagcactgaatgaatgagactccgtctgcaatcccggcacctcgggaggccgaggctggcggatcactggcggctaggaggtggagaccagtccggccaacacagcgaaaccccgtccccaccaaaaaaacacgaaaaccagtcaggcgtggcggcgcgcgcctgcaatcgcaggcactcggcaggctgaggcaggagaatcaggcagggaggctgcagcgagccgagatggcagcagtacagtccagctttggcccggcatgagagggagaccgtggaaaggagagggagagggagacgggagagggagagggagacgggagagggagagggagacgggagagggagagggagacgggagagggagagggagacctacttcttctttattttagtggtaaaataaacctaccatggtacaaggtaggaggggacaacaccaagtggtcaataccaggaggcagggatcactgggggccatcttgaaaactggctaccacaggtccacgtggcagatttgcaacttggatttacctagaacttgtgttaaagcatacctcctctagtagtcattgcctgttattgggaagaaatgactagtgaccattcagacaaactgcaaggggcaaatgaaatttgctgacatttctctgctaacattacatagcctctccataacttgagtatactgactgtactaagaaataacaattcaacttttagttacactttttatgggtaccaagatccaagaataatttaaaaaatatacatgatctacgtatagttctgagaagggcagaatgtgtaataaagtaaaacagtatgctgtcacagaaagttaggtgattaccaatcctaagcatttagaaataaagctttaaaaccttcctatgaaaaagatggaaaacaagagacacttttagctttcttatttcccagcttgaataatttaattggattttataatatcagtaggaatcaatgactgcttttagctttcctactttgggtgaaagataagtcactttgaacactcctggtagtaaattgccaggtggagagatatgaccattaaaatgaccatatatagttcttggctttttgtaaaagaaatttctaatagttttcaatgtaggaaagttttctaaagggtatcatataaatcagctacttgaaactcacaaaccataaggtacctgacccaggcaaatcacatacacagtggtaggggataaacagctctactgcacttacttgcacaaataaataaataaacagccaattttaaatataatagagtttttaatcatcaaataacgtatccatctggttaggtcaagacctatttgcaggatagaaaggctgtttagaagagttgtggccaagtgcggcgagtcatgcctatagttccagcactttgggaggctgcggctggtggatcacttgagaccaagagtttgagaccagcctgggcaacatggcgaaaacctgtctctacaaaacacacacacacactcacacacacaaaatagctgggcgtggtggcacacacacctgtagtctcagctccttgggaggctgaagtcagtgggttgcttgagcccaggaggtagacgctgcagcgagctgtgatcatgccactgcactgcagcctgggcaacagtgtgagaccctgccaaaaaggcagagttgtggcaacagatggtgacttcttcccttttctaatcctccaggttatctgtgcttacatcttccctcagtcttagctaggtaacgtatgccccaagatgctctgcccttcaggagagagaattattgtaggtagacagctggtgatttctgcctaactaagaaaaggagataggaacgtattagctgctgactttcttttagcagtggttttccaccttggctgcatattagaatcagattttgccgagtgggatccaggcactaaacttttttttaaagctccccgcgtgattttaatgtgcacccaaaattgagactctttgtcttaggtcagggggtctcatgtcagcgcccattggaatcacctggagagcatgttaaagttacagaatgctaggctccatcctccagtctgattcaggagggctggggtgggacccatcatttgcatatttaacaagttcccagatgctgctgatgctgctgtaccacgctgacaagtcttagaaaaatttggctcttgttatatttttatacaacaaaaaatggagttcagctgtgagtggggtgtagggggaggaatgaaaattggtaaatgcagaggacagatatcactagtctcccctcttttctttccccatcttcttcaaagctgaagttagactgagatctacccctgcatttcccctcctcgattttcatctttcacggattgaggaaacaacctgtgaacggcccaaagccggctagacccaacctaaccatccgttttagcgggtctcttttctcacacaggccgaccgcctctccgccttgacccccacctccactcaaacccgctccatctattaacgttctcttctgcccagccacgcccccggcgttctccgtggttgcgcacctgacgtacatcgttcaaaacgtgcccagtgtttccctccgagggcactgcgtgccgcgcaggcgcaaagggccaggtgctggaggtgctgtcatggcctgcctcaacccggtggtaaggaagacctcaggctctgtgtagagggagcgccctgggactccgggttcacggcagccgaaccctgcaccttttgtttccccctgacactttacagattgtcataaaccctctctcttccttaggggctggggctcttcttcacgtctgtgttggaggaagctgctgagggccagtagttcagcaggaagttgggccagccccgccaaaagaacaagtgccctttttctctttttacccaaactgaggctatctagttggggtgtttagaggtggaactgatcctcaaccctgctggtttcctagatactagaaaacctccaagttcggttgtgttaattttaccgtggacattgttaattccaagctgtattatttactgcttgaaataacaatgtgatatctcatgttacctccccacatgtttttagtgtctttcactacccgcccatttcgttgtcctttaacaacttaatgcttaagtgtacaacctacattaccctcctacctctaacggacacttaatttgcacagtgagaatttctagtctcagtggcacttaggagaccatcaatcttaaaaacctgaatcaaagaacaaaaatcaaggattcatctttattaccaattcatctcaacagacttcacatttcgtgaaaggcaatgtgcctgtccagatctgtgtaattttatgggttccgggtattatatatgcagtataacagctccatttttagagacatgctactttaattatatgtgttttatgatagtgcgttttaagatacataaaatacctatactctgcctgaatataaggttactatgtatgccaatttatctgattgtgaattctatgaaggagtgtctgtattttaaatagaggagttaagatggactagacatagttttaataacagggatgcaatacaaagtctgtggtcatagaagagaaaatatgttcaatacctattttgatttctgaaaaactgtgttctaatgggtactttttgactactgctgtgttaagattttttagacctaagagttttttccttcggtgttaagcgtgatcacactagctgggactaccactgaagcatcaatttagtatgcctttatcaggataaactgttttagaagaagcacctaatttaggggcatttagtcttaatgcatgtgcttgtgaataacattatttaaatgttactgattggcctattcgtataggtttaccctgggtctttagaaggattaaagcatagctttaaatactaaatactcttaggggctgggcacggtggcttacacctgtaatcccagcaccttggaaggtcgaggtgggcagatcacttgagcttaggagtttgagaccagcctggccaacatggtgaaaccccatctctactaaaaatacaaaaaattagccaggtgaggtcgtgcacgcctgtagtgccagctactctggatgctgagacaggagaatcacttgaacttaggaggcagatgttgcagtgggcccagattgtgctaccgtactccagcctgggtgacagagcaagactccatctcaaaaaaaaaaaaataataataataataaaaaaaaagcacagctactcttggcatgaacaggagtatttaggagtatttatttagtactcttaatgagtactgaatagggtaggatgaaaaggcaatcctagagtgccacaattttcattttggcgtgattaagcaatttgaaataagagcaactcaactaaattcctgctttgctgtttcttgccggtggaacttccactaagtcagtattgtcagcacatagcattgccattttggcctgggggcatagtttatatagatatgaagggctgagttttttcacataccctcttttttgttgctataactagtgtttaatctgggtagaaatctgcttaatttcattgtcatggcatgtttgactaggaggtattttagaatgttatttggtctcttcagtatgcacactgtggatgggtaaggttgttcgtgcccttcttaggttctggtaggaaatccgttttggaacaggtgtatttgataatggtccagaatatatattttttggactttgtgtattttggaagtgagatgagctttaattgctctattttaagtgtttaccccagttttctggcttggagtttatttatatttgtggaaataatatagtgaaccctaaaaaattctcctttggccactttgataaagaggtaaattgaaaacagaaggtctatttctggttgacttacattaatttcccttttaaaaggagttgaggaggttaaatactgacacaaaaggcaagtaacatgacaataaccatgcatctttgagattattagctcatatgttattgtagttctgtaattcagtcttgtagataggctgagactatgggtctgaagctaacacagtttatggaaagctaagactatattgggaataggaatgtacatagtaaaagttttaatggtgacttcacaagactagaaggtatgcactgcatatcttttaaggccaaatatgttctaacttgagaagtcagaactttaacaggccgggtgtggtggctcatgcctgtaatcccagcactttgggaggctgaggcgggtggatcacgaggccaggagttcgagaccagcctgaccatcatggtgaaaccctgtctctctaaaaatacaaaaattagcggggcatggtggcatgcacctgtaatcgcacctactcaggaggctgaggcaggagaattgcttgaacctgggacgtggaaattgcagtgaactgagttcgtgccaccgcactccagcctgggcaacagagcatgactccatctcaagaataaataaataaataaataaataaataaataaataaataaaatgaaactttaacaattgcttttatgtagcctaaactctacagatctgtaattgaagatgtaattgaaggagttcggaatctatttgctgaagaaggtatagaggaacaagttttaaaagacttgaagcaggtttgtagccgatacaactttttcttcctgtcttttgttgtttttttcagcatacaaaactgatatagttctgatctctcaaattatagtttagtacttacccattcattgtgccatcaggatgacgttagtttttaagaaactgaaaaaaagagaagtatcattatatgtgtatatatttttttaaagtaaactttttttttcccctctgcagctctgggaaaccaaggttttgcagtctaaagcaacagaagacttcttcagaaatagcatccaatcacctctgtttactcttcagttgccgcacagcttgcaccaaacattgcaatcgtcaacaggttggataccattagtaaatgagtactgttagtatcttcagaacaaattctcatttgggaatgtttttcagttagacagggtaatgttcttagggtgagaaggcttggacacctaaatcatttctattaaatgaacacagtataaatcattgccccatgtaattattgattaaaaactcaggttattcgaactagtttttattttaaatattaaattttacaaagatgataaagcctttctttagaggaaagtcacatagtttgtcagctgttgggagcacccattggtaatttcagataatttgactgggtctagtcaaggattagaagtggcagagggaaaggtgagtgcttgcaagtttgtgtgttctctttctcttattttttgtgtatattataaatctgatatattgggagcaaaatggagagttcagaatatggagattattcaggctacctcactgttttggatatataaaataatggctagaaattgatcatgtgcatttatctttattcttggacttagcaaatctagacttctgcttttaagggaaatgtttgtccacattatgcgtatcaatttaaactggaagggactagctaataaaagataaaacttaagagttttctatccttgtatgcttgattcctttctttttcttctgattcttataatctttatgttactcatatgtgtatatataaatgtatactcgcatacaaacaagttttattgggtttagctgaaattcagcagagtagtctgcaagaagtgagggtagattttggattggattatcagtaataagcagatagttctttgcatgcttgggaaaattcacatgaaaattacatgggccaaggtgaagagaacattgtaaggatgcttgtacttcttctattacaaagtgggagaatttacatgtggcagcaattctaacatataaaaatgaataaattaacaatgaatgttgaattagcaaatacaagttttatcgaatactgtgttaataaagtataattttgctctgtaagaattagtcttggcagttttaattgttgacacattgaaacatttttcatcagttgggtttttggctatgctttaattttaaactactatttcattgggacatctccttctctgtttaaataacattcctttggagttttgttaatcactgttttatttattacagaatgctaaagatgtttttttaacttatggttggcatgagggtgtggtgggtatggaagaggaaaatacttgactgtcttttatcagaagaggccgaggtgggtggatcacctgaggtcaggagttctagaccagcctggccaacatggcgaaaccctgtctctacttaaaaacaaaaacaaaagcacaaaaattagccaggcgtggtggctcatgcctgtaatcctagctacttgggaggctgaggcaggataatcacttgaacttgggaggcagaggttgtagtgagctgagatcgcgccactgcattccagcctgggcgacacagtgagactccatcttaaaaaaaaaaaaaaaaagcatggtgaacacttctaagattctgtcattcaaaattgcaatactagattttgccgcaagatggtaatattaccagtgatttaaataacaaaagtcttgcaactagtgtatcaagtttgtttttactcagctccttattctgtatcttagcagttagaataatagaaataattacattttaaatagtttttctccttattctcttctacatcatttataatgaagaggtttcagaggaattacatgtatcccttaaaagtgctttataggcttgttcctgtctctcttcatctttaggtaccaaacagtaagattcttgaaataaatagtctcataaaattgaagtacttcttaattatatcttctcatggtatgcttttaaaagcctgattaaaataacttaaacttctagaatttttttatctcttttgatagcaagttcaaattaaatctacaattcaataagtcatttgcctttgtctgtaccatcttaaaacttgtttgctcagtcaaaatcacaatgagataccgtctcacactagtcagaatggctattattaaaaaactgaaaaacagatgttggtgaagctgcagaaaaaagggaccacttatgcactgttggtgggaatgtaaatttgttcagccactggaaagcagtttgcagatttctcaacttagagctacaattcaactcatcagttctattactaggcatttacccgaaagaaaataagttgttctaacaaaaagacacccacacttgtatgtttattgcagtactactcacattagcaaagacatggaatcaactcaacccatacatggtggattggataaagaaaatgtggtacatatataccatggaatactatgcaaccttaaaaaagagagaaagaaatgtcctttgcagcaacatgggtgttgctggggccattatcctaagtgaattaacacaggaacagaaaaccatatattgcatgttctcacttataaatgggagttaaacattgggtacatacagacagaaaggtgcgaacactgggtactccaaaaggagagaaggagagaagggggcaagggttgaaaaactacccgtcaggtactatgttcactatttgggtgacaggatcaatagaagcttaaacctcagcatcatgtgatatacccacgtagcaaacctgtacacataccccctgaatctaaacccagaaacttgtttgctctatcatatgttcttcgttttttatttgtgtagtaatttcctgtatcttcagttctctactttgtttggtctcaggacccctttaagctcataaaaattaaggaccccaaatagcttttaaaatgtgggttgtaagtatctatttactatgttggaaattaaaacaaaaatttaaaaaatattggtttatttaaaaatttaattacatgttaacataatagcatatatttatgagtaataattcttcgagaacaaaaatatttagtaagaagagtgtcatcaattaatgtcggcttaatgaggtttgcagaaatgagctggattcttatctatttctatttatttacattttattgtatgtaaggtgttcaccatagtgctttgatatagatagatagatagatagatagatagtgaagaggttggtatagtctagcaaattaacatatctgtcatctcacataggtgctcattttaggtacttttagtatgccttaagtcttctcttttagcaaaaatcccaagtgcagcacaacattattaagtatagccctcatgttatctattagatatttagacttattgatcctatgtatctgtgactttggatcctttcacctacatcttcttattttctcccttcctgcctctggtaactgctattttattctctatgtctgtatttgtggttttttttttttaacatataaatgagatcatgcaatacttttctttttgtgtctggcttatttcacttagtataatgtccttcagtttcatctatgttgtgacaaatggcagactctccctcttttaaaaagctgaatcatattcctctgtgtgtgtgtgtatacagacataccacaatttctttatccatttgtccatttgcagacacttcggttgtttacaaatcttggctatcgtgagtaatattgcaatgaacttggaagtgtagatatttttatgaggtagtagtttaatttcctttgggtatatatccataagaaggattgctgaatcacgtggtaattctatttttaatttatttaggaatctctgcacagttttatacaatggctgaccattctgcattcccaccaacagagtacaggggtttcctttcctctgtactctcaccaacacttgtcgtctcttttctttttggtaatagccatcctaacaggtgtgagttgatatcttaatgcagttttgacttatattcctctgatgaatagtgatgttgagcacctttttgtatacctgttagctgtttttatgttgtctttggaaaaagatctattcaagtcctttgccaatttttgaaaaggttatttgtttttctgttattgagttgtgtaaatcttttaatatattttggatattaagccctttatcagatatatggtttgcaaatattttctccgtatctgttggctgctgttttattttgttatttgttttctttgctgtgcaggagctttttaatttgatgtctgtatttattttattttattttatttttttgagggagggtcttgctctgtcatccatgctggagtacagtggagcaatcataggtcactgtagccttgactttccagggtcaattgatcctctcacctcgacttcatgagtaactgggactacaggcatactctatcatgcctggctaattttcacattttttgtagagaccaggttttgctgtgtcgtccaggctggtcttgaactcttggaatgaagcaatcctcctgcctcggcctcccaaagtgctgggattacagatgtgagcgactgtgcctggcttatttattttcgcttttgtagcccgagcttttggtgtgatatccaaaaaatcattgccaaggccattgtcaaacaggttttcctctgtgtttttgtcttggagttttatggtttaaggtcttatggttaggtcttttgtctattttgaattgatttttatgtatggtatgaaaataagagtccatttcattcttttgtgtgtggaaattcacttcttccaccaacaaccatttattgaagaaactatcctttccccattgtgtcctcttagcacccttgttgaaaatcagttgaccatatgtgtttgggtttatttctgggctctctatactgttctgctggtctttgtgtctgtttttgtcagtgccatactgttttgattactacaggtttgcaatatagttttaaacaagaaaatgtgatacctccaactctgctttttttttcttcccctctgaattgctttggtatttaatgtgttctgttgttccatatgaattttagacttttttttgtatttctataaagaaagtcattggaattttgataagagattttgttgaatccatattttgctttgggtagtatggacattttaatgatatcagttattccagtccatgaacatgggtattttcccatttatttgtgtccttcagtttcttatatcaatgttttatagttttcagtgtacatatctttttttttgaggcagggtctggctctgtcatccaggctggagtgcagtggcacaaccttggctcactgcagcctccaccccctgggcgcaagccattctcccacctcggactcccaaagtagctgggactacaggcatgtgccacaacatctgactaatttttgtattttttgtagaggcagggtttctccatactgcccaggctggtctcaaactcctgagttcaagcaatccacctaccttggcctcctagagtgtgcatatctttcaccttcttggttaaatatattcttaagaattttattttttaagatgctattgtaaatgagattgtttttatgattttttggataggtagttatttgtgtacacaaatcccactgattttttttgttgattttgtatcctgcaactttactgagttcatcctctttaaatatttggtagaattcagccatgaagccatctggttctgggcttttctgtgttgggaggtttttaattactacctcgatctctttattttttatatctgttcctaaattcaatctgttgtgatatgttgtttttgtgaaagtataggaagaaaatctagccttccacagatacatagttggaaaaaagggaagcattttaatagtattttcagataattgataactacactaaaactcaacaaatggtagtttctgagaggttagctgcatgatggaatctggaaccacaaggaactttttggaatatttcattagggtttattggtataccttgcactttgaatggctttttaacacgtgtaatgttacagcatacattggttatttggaaaaattggtttcctgtcatacagttgaaacgttgttcattatacaagtttaaaaaaatcatattcattgatataactaggcctctcatccattgtggttgatatgaattttccaaaattaaatttttgcttgaaaagttgagttttatcattggcaaatacatgctgttagtttttcttaaagtgatgggcatgcttagtttatgtttaaaaaaatgtctgccagatacccagtttgaataactatagttgctgtcagatattctttcaagtaaaaatggtgtttcttgaaaaaagaggccatgtttttttttcttttcaacttttattctagattcaggggtacacaggcaggtttgttacatgggtatattgcatgattctgaggtttggggtacaaatgcatagtacccccaggtactgagcatagtatccagtagttagtttttcaacccttgccttcctctcaccctcatccctctagtagtacccattttctcttgttggcatctttatgtccatgggtactcaatgtttagcttctatttgaaagtaagaatatgtggtatttgtttttctgttcctgcattaattcacttaggataccagcctccagcagcattcgtgttgctgcaaaggacatgatttctttgttttttatgagtgcatagtgttccatggtgtatatataccacattttctttatccaatccactatggatgggcacctggattggttgcatgtcattgctgttgtgaatagtactgtgatgaacatgggagtgcatgtgtcattttggtagaaagatttctttcttttggatatatagccaataatgggattgctgggtcaaatggtagttctattttaagttcttagggaaatctccaaactgttgtccacagtggctgaactaatttacattcccaccaacagtgtacaagtgttcttttttctctgcagccttgccagcattggttgctttttgactttttaataatagccattgtgactggtgtgaggtggtatattcttgtgttttgatttgtatttctctggtgattagtgatgtggagcattttttcatatattggccacttctatatcttttgagaagcatctgtacatgtcttttgcccactttttaatggggttatttgattttttgtgaattgttttaagttccttatagattctggatattacaactttgtcagatgagtagttcgtgaatattttctaccatcctgtaggttgtctgttcactctgttggtagcttcttttgctgtgcagaagctctatagtttaattaggtctcacttgtcaattttgtttttgttgcaattgcttttgagaatttagttataaattattttccaaggccgatttctagaatggtgtttcctaggttttcttctaggattcttatagtttgaggtcttacatttagaactttaacccatctttgtaactgaatgcaagttcagtcactcactgcttgcagagtccagttaacaagagggaggtgtggtaggaagaaagtgactttgcagccaggtgcggtggctcatgcctgtaatcccagcactttgggaggccgaggtgggcggatcatgaggacaggagtttgagaccagcctgaccaacatggtgaaacctgtctttactaaaaatacaaaaattagccaggcttggtggtgcgtgcctgtaatcccagctgctcaggaggctgaggcaggagaattgcttgaacctaggaggcagaggttgcagtgagccaagatcatgtcaccgcactctagcctgggcaacagagcgagactccgtctcaaaaaaaaaaaaagtgactttatttccaaagctggcaaggaggaagtggcttgattcctgtccaaagcaatgattttgaattttgatgagggaaggcaagggtttaaaaaggtaaaacttgatatggaaggcatgtaagaattgtactgagtacaacgtctgtgtgtcttgttctgttggctttcttgggttccagtccacctggagcatgggctggagtcatctcaacaatggcaaggttgtggactagctgccttgcatttatcactgcagttttgcagctgggtccccaggcttggtctgtttgtctcaagattagcccctagaacttctaactaggcacataattagatactagcatacagttagatagatgtgaagggagtatatgcggtgagaaagggaaggacatgaagtctattttcaggctaagggaaaaggcttctgaagtttgcttcaaggttaggtcttgaatccaaagggaaaggaaaaaaaaagttttaaaatgtattttgaatttaagctgcccagttacatcttgagttaatttttgtatgtggtaaaaggtaggagtctagttcattcttctgcatatggctaccagttgccccatcaccatttattgactagggagtcctttccccgttgcttatttttgtcgactttgtcaaagatcagatggctgtaggtgtgtggctttatttctgagttctctattctgtttcattgttctatgtttatgtttttgtactgttgctatgctgtttggttactatagacttatagtatgggtgaagttctgtaatatgatgcctccagttgtgttcttttttgcttatgattgttttggctgttcaggctccttgttggttccatatgaattttagaacagtttttttctagttctgtgaaaaatgacattggtggtttgataggaatagcattgaatctgtagatttctttaggatgtatggccattttaatgttattgattcttgtattccatgagcttggagtgtttctccatttgtttgtgtcatctatgatttctttcagcagtgttttgtagttctccttgtagagatctttcccttccttgagtagatgcgttcctaggtattttatttttgtgtgtggctattgcaaatgggattgtgttcttgatttggcgttcagcttgaacgttgttggtgtaaagaaatgctactaattttatacattggttttgtatcctgaaacttaactgaagacatgtattagttctaagagtcttttggtgaagtccttaggattttctaggtataagaccatattgtcagtgaagagagatagtttgacttgttttcctgtttggatgccttttactttttctcttgagtgattgttctatacctccagtattatattgaataggagtggtgagattgggcatccttgtcttttctggttctcagggagagttcttccaatttttgcccatttagcatggtgttggctgtgagtttgtcatagatggctcttattattttgaggtatgttccctcaatgcctagtttcttgagggtttttcttttatcatgaagtcatgttggattttaccaaaagctttttccatgtatattgagatgatcacaggtttttgcttttaattctgtttattgtatttgtcaataaatcatatttattgatttgcatatgttgaaccaactttacatcccaggaatgaagcttatttagttgtggtgagttaacttttgatgagctgctgggttcagtttgctagtattttgttaaggatttttgctctgtgttcatcagggatgttggcctatacttttctttttttatcatgtctttttcaggttttggtataaaggcgacgctggcttcatagaatgagttagagaggagtcccttctcctcaacattttggaatagttttcagcatatttggaatagtatcagcactactttgaacatctggtagaattcagctgtgagtctatctggtctggggctttttttgggtggtaggttttttattactaattcaattttggaactcgatattggtctgttcagagttttaatttcttcctgattcaatcttgggagattttatgtttctaggaatttatccatttcctctagattttctagtttgtgtatgtagaggtattctaatagtatctgaggatcttttgtatttctgtgattggttgtaatgtcatctttgtcatttctgactgtgcttattggaatcttccctttttttctttgttaatctagttagtgttctatcgatattgtttatcctttcagagaaccggtgtttggtttcattgattctttttttcccccttaatgatcactgtcagaaaatcattgattctttgtatggatttttgggtctcaattttgttgtgtttcactccgattgtagttatttcttttcatctggctctagggttagttcttgtttttctagttcctctaggtttgatgttagattgttaatttgagatctttccaactttttgtggtaggcatttagtactatacagtttcctcttaatactgcttttgcttcatctcagagatttttggtatgttgtgtctgtgttttcatttatttcaaataattttttgatttctgccttaactttgttgtttacccaaaagtcattcaggagcaagttttaaaatttccatgtaattgtgtgatttggaaaaatcttggtatacatttgtttttgtttttgttgttgttgttttttgcttccaactgttattagtctttttattctcttggcaatgtcttccagagttaactacttctgttgtaggtgataaaaatgtataaggctctacttcagatgttggtactgctgtgagcgtggtctcttcctttactcaactgagaattaaaacttgattcttttttatattccagtcccagaagtaattccctctatagaagttatctaatgatagtcttattcatcctagtagtggcttacaaccaggctctaacctctccaggaatactataggatggatttagcataaacatatattaaactaaaaaggattctttcaaatgagtttaagtgcattttatttttagacaacctacttgacaagttttttgttttttttttttgacagagtcttactctgtcactaggctggagtgcagtggcgtgatctcggttcactgcaacctccgactccctggttcaagcgattctcctgcctcagcctcctgagtagctgggattacaggcatgcaccaccatgcccagctaatttttttatttttagtagagatggtgtttcaccatattggccaggttagtctccaactcccaaccttgtgatccaccagccttggcctcccaaagtgctgggattacaggcgtgagccaccacgccagccgacctgtttttcttaaaaacaatgcttccactccaaagatataatggtcgaaataaatgaagagctcaagttgacatcagtccaatttatcttaagtcattgtgtcatgtgggtgataggcagcaagcagttgtgatgacaggtgatagagccaaagtaattgccaattggttaacatttttccatttctaaaccatctttaaagaaaatcatatacagggtcacaccatcctcatggtagagcaactatgccatctggattcatgtttttactggtaaaaaactggtagttgttgaaattagtaagatgtgcttggtttgttctacagcttctgtcataaaaggttttactgtttaggtctctgttcttcatgttggcctttgattgattttatgtaatctttgatgtacttcttgtaggcttctttttgaagtttgtttcctgcaagtgatggttcatgacagtatcaacataagtgattaatgtgctttcggtaccctcaccctcagggccttctgcggaggcatttctgtcaatgttaccctctgtcctactgactatcttcttccccacccccccgtcccacttccaggcacagccagtctgcaatctcccagatattgtaaatgttggagaacagctcatcatggctgataaggtccgggtagataatcttgatggcagctgaagggagatgcggtggtgctggcttagcaggattccagagattagagtgaacatgatgcagctggagcagtgcttggtgggtgggaggagtgggtggaaaaggagatttctgtttttattcctctgtggtctatgagtatggttggtatgataatttttttgaacttattgagatttgctttatggctgagcatacggtcaattgtggagtatgttccatgtgcagatgagaaaagtattgttctatggccaatgggtggagtattctgtagatgtccatgaggtccaattggtcaagtttaaattcataatttctttgttagttttctgcctcgatgatctaatgttttcagtaggatttcaatagggggaagtcccccaccattatcgtatggctgtataagagttttgtaggtctagaagtacttgtttgtaattctgggtgctccaattttgggtgagtgtatatttaggatagttaagacttcttgtggaattgaatgcttatcattatataatggccttctttgttttttattgttggtttaaagtctgttttgtcttatataataatagtgacctctgctctttttttgttttctatttgcttggtggatcactcttcagccctttattttgagcctatgggtgttttatgtgcatcttgttttttatctaacttgccactttgtgcctttttagtggagtgtttagaccatttacattcaaggttaatattgatatgtgaggttttgtttttattgagaaggagtcttgctctgtcactcaggctggagtgcagtggcacaatctcagctcactgtaaccttcgtctccgggttcaagaggttctcctgcctcagcttcctgagtagctgggatggcaggcgagcataaccacgcctggctaatttttgtatttttagtagagacgggatttcaccatgttaccaggctgatctcaaactccttacctcaagtgatctgcctgcctcggcctcccaaagtgttgggattacaggcatgagccactgtgtctctggctgatatgtgaggttttgatcctatcatgaaattgttagctggttgctttgtagtttctgttgtgtggttactttatagggtctgtttataggcctaagtgtgttttcatggtagctggcatcagtcttttgtttccgtgattagaactcccttaaggagctcttgtaatggtggtctagtggtaactaactcctttaatgcttgcatgtctgaaaaaacctttatttctcctgtgcttatgaaacttaacttggcagggtatgaaattcttggttggaatttcttttcattaagaatactgaaaataggcccctagtctctcctggcttgtaaggtttctgctgagaagtctgcttttagcctaaagggtttccttttgtacaggatctgacctttttctctagctgcctctaagattttttctttagcattgacctttgacagtctgggagggcaggggccatgaagagtggggccagattgggcacatccatctacaggtcccccagtggcaggtacaagcactgaagctgagggagaatccagtgggcagccaccaggtgcccagaggtatatctaggcatggaactgggaaacctccttggccccaagttctctgcacagtgatgaggggcagcctaaaattctaatccagggtagtgagtgctccagatatctggagatctgcctgggcatggagtggagagggccttcctgcatcaagatctctgcataggaggggtgggatgactcaggctagtggaccaggcaagcaggtgctatgaatacctggagatctgcctaggtgtgtagcagagagggcccccttgcaccaggatctctgcacaggaagggtggagtggatcaggctgttaatcaaggtgagtgggtgctccaaaggtctagacatctgcctgggcatggagtggagatgacccttctgcagcatgatctctgtccatgaaagatgagtggctcaggctgctggtcacgcaagcaggtgccctgaatgcctggatttctgcttggggggtggagcagaggggaccccacttcacctcgatcccaggggaacagcaggggcaccaagtgatggcacatgcagttcagtttcagattgccaagctggccctggctgcaagtctcattgcccaggagagactgcaactgtagcagctctcctcccactccaggcttgcaatagggaagagtataattccaatacctacttctgaggtgctttccacctcagaagtggtggaggctgtggaggctactaccctgctccagagcaggtgcttcagtctgtggcgcaagagtaaaatgcttgtatggccatgcagctgggttacctagaatggctgactttgtatgcaaccagattaaaaatggcatcctgtgcttggtcctatgtctgggaaagtgtctgcagcttctcctagtgtttttccctcacagcgtctccaaccctttccccaagttagcttcagggattgggaggaaaaaaaaagttctccctcagcctgagttgctctgatctcctgtggaaaggtgagtcactgagggaggctgtctttctctctcatgtactggggcttcacttacttttatcagccaaatgccatcacagtggctgtttggcaggattctcgtctttgggatttggagtatcctgcatgattccattagattctcattttccttcttgaattaaagctcaaaccattgatctttatttactattttgttatttccaaatggtggaggcctgctaacaggctttaatctgccacctgaggaaaaaaaggctatattaactcccagcttaaacaatgacacaaatgcttttccttgtacttttgcatgctgcagaaatgctttatccttctatttcatctcgtaaaatattaaaaggaagtatacttgctagttgaaatttagtataataattcttagattatgcaaaggactttcttaccttaagtgaaatatctttgtggttgttcctgctgtttttgtctgttgtgtttttttaactgtgagtagcaattgagaataaagtgaccacttgcaaggtttggtgctactaacttaattcatgctaagatgtctacagttttacttgttattgcttttgcatcatcagttcaaatgtcaacaaaaccaaataaaaatactaaatgagaaaaaggcatactttgtcttggtatcatgaaaatagttttgaccttataaacaccctgaaaatggtcttaggtagcctcagtggtttgtatattacactccgagaactgttgttctgcatgtagggtgactatatgtaatttataatctagttttgagagagagacaaatggggttctattaataattacctcagaataacaggtgtaaactgggactgtcctgggcaaattgggacgtgtagtcaccctatgattaccttatttctaggggacttcaagtcagcttctgtatttggtcttcatgtcacatgatctttttaaaatgatactatcagtcatgatggaaggaagggaagggaggaacagggacactgagaggtttgtggttgctttcatatttgagcattaaaactcctaaagtataggtgtaaactgtatgtccgattgttcttgaacttagatgtgttgaaaatttcagcaatgtggttggttctttaggtgatttgagagttagaatattgtttggtcatcaggagacatcttttatgctaatgcgtattcacaaagaagaaattcacctgtttctatatttcctgaatcatgtaattttattattaaaatttggattggttcaaagaagatccaagaatcataaaactataactgccgcaatgtatcaaagaatttttgatggtgaataagaaacaatacacttatgaatgtggatattgttatgccatgttagtgtattataacattcttaaaattatgtttgtggagttgaattcttgctatgttaaaatttattgttaaatttactatttctaatgagaacaaagatacaatataccagaatctctgggacacagctaaggcagtgttaagagggaaattcatagcactaaatgcccacatcaaaaagttagagagatctcaaattaagaacgtaacatcacaattgaaagaatcagagaagcaagaacacttcagccccaaagctagcagaagacaagaaatgaacaaaattagagctgaactgaaggaaatcagggcacaaaaaaccattcaaaagattaatgaatccaggagttggtttttgaaaaaattaataagatagataggctgctggctagactactaaagagagaagatccaaataaacacaattagaaatgaagggaatgttaccactgaccccacagaaataaaaataaccatcagaaaccatcagtctagctgctggctagactaataaagagagaagatccaaataaacacaactagaaatgaagggagtgttaccactgaccccacagaaataaaaataaccatcagaaactattgtgaacaacacctctatgcacacaaactagaaagcctagatgagatgaataaattcctgaacacatacaccctcccaagacttaacgaggaagaaattgattccctgaacagaccaataaggaactccaaaattgaatcagtaataaatagcctaccaaccaaaaaaagccaaggacctgatggataaacagctgagttctacctgatgtacgaagaagagctgctactattcttactgaaacgatttcaaaaaattgaggaggaaggactcctccccagctaattctgtgaggccagcatcatcccgataccaaagcctgggagagacacaacaaagaaaccttcaggccaatattcctgttgaacatcactgcaaaaatccttaacaaaatacttgtaaaccgaatttagcagcacatcaaaaagctaatccaccatgatcaagtgggctttatcactgcaatgcaaagttggctcagcatactcaaatcaataaatgtgattcatcacataaacaaaactagacagaaaccaaatgcttatctcaatagatgcagaaaaggctttagataaaattcaacagcctttcatgttaaaaactctcaagaaactaggtattgaaggaatatacctcaaaataatacaagccatctatgacaaacctacagccaacattatactgaatggggaaaagctgaatgcattccccttgaaaacagcacaagacaagcatgccctctctcaccactcctattcaacatagttttggaagtcctagctatagcagtcaggcaagacaaagaaataaaggacatccaaatagaaaagaagaagtcaaactgtccctatttgcagatgatatgattctatatgcagaaaactctatagtctcggccgaaaagctccttcaggtgataaacaacttcagcaaagttttggatacaaaaatcaatgtacaaaaatcactaacattcctatacaccaacaatagccaagcagagaggtaaaccaggataacaaaaagaataagacacctagcaatacagctaaccagggaggtgaaagatctttacaatgagaattacaaaacactgctcaaagaaatcagaagacacaaacaaatgggaaaacatcccacgctcatgggtaggaagaatcaatattattaaaatggccatactacccaaagcaatgtacagatgcaatgctattcctatcaaattaccaatgaaattcttcacagagctggaaaacactattttaaaactcatatggagctaacaaagaacctgaatagccaaggcaatcctaaacaaaaaggacaaagctggaggcatcacattacctgacttaaaactatactacagggccacagtaaccaaaacagcatggtactggtacaaacagacccataggccaatggaacagaatagacagccaggaaataaggctgcacacctgtagccatctgacctttgacaaagtcaacaaaagtaagcaatggtgaaagcactcccaataaaataaatggtgctgggataactggctagccatatgcagaagactgaagctggacccctttcttacaccacatacaaaaatcaactcaagatggattaaagacttaaatataaaaccccaaactgtaaaaaaccctagaaaacaacctaggcaataccatcttggacataggaacaggcaaagatttcatgacaaagacaccaaaagcaatcacaagaaaagcaaaaatttacaagtgagatctaattaaacttaagagtttctgcacagtgaaagaaactatcaacagaggaagcagcctacagaatggaagaaaatatttgcaaactatgtatctgacaaaggtctaatatccagcatctataaggaacttaaacaaatttacaagagaagaacaaacagtcccgttaaaatgtggataaaggacatgaacagacacttttcaaaagaagacatacatgcagccaacaagcatatgaaaaaaagctcaatattactgatcattagagaaatgcaaatcaaaaacacaaggagataccatctcacaccagtctgaatggctgttgttaaaaagtaaaaaatgaacagatactggtgaggttgcagagaaaaggaaatactgatatactgttggtgggagtgcaaattagttcagccattgtgtaaaacagtatggcaattcctcaaagagctaaaagcagaactgctatttgacccagcaatctcattactggatattctcagaggaatataaagcattctaccataaagacgcatgcgaatgttcattacagcacttttcacaatagcaaagacagggaatcaacctaaatgctcatcagtgactgactggataaaggaaatgtggtacgtatacaccatggatactatgcagccataaaaaagaatgagatcatgtcttttgtgggaacatggatggagctggaggctattatcttcaacaaactaatgcaggaaagacagccaaatactgcatgttctaagtgggagctagatgatgagaactcatgaacacaaggaaacaacagacactgggtctacttaagggtggagggtgggcgggggcagaggagtagaaaagataactactaggtactgggcttaattcctggataatgaaataatctgtaaaacaaaataatctgtaaaatctgtgacacgagtttacctgtggaacaaaccttcacatgtacccctgaacttaaaataaaagttaaaaaatttagtatttctagaacatacacatgaagaccaaagttatgacacttttagtttgagtaaaaatatatactcatttaaaacttactttgttattaaaaccatcttgaatattaaaatttgtttgatgcacatttaaaggtataacttgtgagcatataaaaataagttattatttttatatgttcaagtatataacttgttagtttagtatcaaaattaagtaggagctgcatgaaacttcattataaaactgttcaatgcttttattccaatgtctataaagaaactttaaaaactctcttattgtactgtttgatttatttaaatatagagaattatcttacaggatttattgcaaggtacctaaaagaggatgattgttgctattttttctcaaggaattcatttaattgctttagacaatgtgttaacagatttttatttcctctccggctattacttaagctgcagcagcttaagctttgctcacttcagctaatgaagactaataccactgtgttcctgccagttcaattctttctaatttagcttttctaaaataatgcctgttaataagcaaggtcgtagatgaacagaggataaaaataattctgtgcttcattaaccatcaatctgtagcctttcttctgttgtcttaacgtggaaggaatggttagtttaaaaaaatgtttgcttttatgagttgtttgttttatgtgacggagccattctaatgtcaggaacagatctttggggcaattttccttaatgcagtttgtgaaaaacaggccataataaatattacattaacatataaacatgctaaagtttgtgtttttattaaagatgagggaaaatgacattctaacagctatatttagtcatgttcaggtaaaatgaaccttgagtatctaaggtatatggttacattgatcaactaagatccttctactgtagttattattttttctttatgcttatttttaaatgatagattacatttacaactagctggtcaatctttgagatgtattataaatgaaaggctggttagcatagaaaactggtagataataaaggaaagatatatgggactgtaggtctaatgtaggtcgagttgtcattctggggatttgttttcttacatatttttagcaattgtacctgttttattgcagagacttgaggagacatgttcttattcatttgttcctaaaactgttcaggtgtgcttgcttacttgaccaaagtactgtaaataacttttcataaaataatgaattggaatttatgttgaacctatacaatttagaatgggtttatgttgggttaacatatttatgctcaatattatagtctcacggaaatgtgccactttaataaatatttaataaatattacttgacttaataaggacaatctaggtgttttgttatggatttccaaagtacagtatagttgattacaatgagatattttctttcagcacttaaaggagtttatttgtaaagtctttatgtgaagttgttgcaaaaaatataattactttttaccgcacttggaatcaggaagtttagaattcaccatggtttaacctgttagtgatagaaaatattttttaaaaataagctatatttagtgattttattaaattggtaaattctaatgaatgtatatttattttgtttcctatgcagcatcattagttattcctgctggtagaactcttccaagttttaccacagcagaactggtatgtagcttacttaaaatatattttaaaagacatgtcccactgttagcgagtggtggcaaaatgctgaacatagatgtaatttcttaccctccagttgaaagtgaaaagatgtggccgggcgcggtggctcacgcctgtaattccagcactttgggaggctgaggcaggtggattgcctgagatcaggagtttgagaccagcctggccaacatggcaaaaccctgtctctactaaaagtacaaaaattagctgggtgtagtggtgggcgcctagtaatcccagctactcaggaggctgaggcaggagaatctcttgaacctgggaggcggaggttgcagtgagctgagatcatgccattgcactccagcgtgggtgacaagaacaaaattctgtctcaaagaaaaaaaaaaaaagatgtggtaaagagtggggtgacagaatagcatctgtagcatagatgtaataaaacgcagaagttccagaattgacattttcttgccaagttttcctgtctttcagagcagttgttagcatcttccaagactgtacctacaaggttaggaaatgtctgaagttatgttgtatggggttttaatacactatataatgttatatgcttgttacatcctaaataaataattttgaggttttttttcagattttttttcccctctagaatggagcaacatcatagttttgactttaattaaactggaatatttttgtcattttgtaccttcgtgaagtatagcttgtttatattttcccccttagtacttgaaggcagaagatacatttacaagttaacatagaaaaccaagtagtttttcgggtagagaagaatagcagcttttcacttttatctttcttccatggtactgagagtagtacataatctactaactgttttttaattttctttcagcccataggttgcctttgtagggcaaatgcttagtgggctagttatttccatttcttcactaagaacagccaaaaccacacaccttaataggatttttggaaagaatggtgctgcttttgataggagaccaatgaagaaatacctctgcctttggaattcaaacaaatattttttttcctgttaaaataagtaataagcttgtattaataaaaagtaaaaatgggctgagcacagtggctcacacctgtaatctcagtgctttgggagactgaggtactgggcaccatagcaagaccatattaatacaatttttttttttttttttttttttgagacagagtcttactctgtcacccaagtctggagtgcggtggcatgatctcggctcactgcaacctccgcctcccaggttcaagtgattcttctgcttcagcctcccgagtaacgagattacagacgcccgccaccatgcccaactaattttttgtattttagttgagatggggtttcaccatgttggccagggtggtctcaaactcctgacctcaagtgatccacccaccatggcctcccaaagtgctgggattacaggcgtgagccaccgtgcccggcctgtacaaaatttttttaaaaaaattagccaagcatggtggtgtgtgcctgtagtcctggctacttgagaggctgaggcaaaaggatcacttgagcctcgtaattggagattacagtgagttatgattgcaccactgctcttcagcctgggcaacagaatgaaaccctgtctcttaaaaataaaaatgcaaaacatttataaataaaataaagagttctgtagtcttatactccaagaataaatgttttaactctttgatgtttattcatccagacttctttcatgaaagctatattagtttttaggataaaaagtagggatactctttttactgtttctgtaatttctgttttctaatttagtaatatagatggactgctttcaatttcagttagtacaaattgaccttcgtggatgcagcacagtttaattaacaaacttttgttggtgaacatttaaattatttccagcatttttctaatatagtattctattgattatgcttgtgtatatgtctgtgtgtttctgtgataatcaggataaatttctaaaagtagagttcatgggtcaaaggtcatttgtattttcatttttggtatatatattgcaaaaattatcctccaaaagggttgtaccaatatacattcatacaaacagtagtttgagagaaccaatttttatcacattctcaacaacactggatgttatcagtctttcaaatttttgcaggtctgagaaccaatggccctgcaaagctatgtcttgggcaagttttttgagttaatgtttatactgttcattaggacttactagcttcattgctaataactgtagaataggattcctcttgatccttaatgggatgatcgatattgaaaactattttattcaaagaactcagccctaatattaaatgttaagtattgtcaaactattgtccagaatcagattttttgactccctgtgagatcagggaaaaaaagatacaagtaaagtccttttctaactttctaatataaatttcttatatctagggcacttcaaactccagtgcaaactttacttttcctggttatcccattcatgtaccagcaggtgtgacactacagactgtatctggtgagagtatattctaagaatctttttgttttcagcattggtactattttttggacattaagcttcatgatttttaaataaactatataccagaagttataagaacttttaataaaattgattttaaaagtaatgataaatggtggttttgattgttatagagacaatctaccacaaaaggcactgtactaggcctgtcctatatttgattcccagttctctttcccaacattgtataggggttctttgtatatattttttctaattcaagtcagttatctaaattttaacaaatacaaaataaaataacttacctgcattcctgctagctctaattacggattaaagattaggatgatcaacctttgccccctttcttattagggattgcatggtctgataggacatccaatagtttggaggttaaccggtttctgcttttccgagcaccatctcttgattttgaagaggatcatacctcttctttgggttgttgtaaagtttaagtaaagcacctaactcaacactcaaaaataagtccttttttttgagatggagtctcgctctgtcgcccacgctgtagtgcagtggcgcaatctctgctcactgcaagctccgcctcctgggttcacgccattctcctgcctcagcctcccaagtagctgggactacaggcgccggccaccacgcccggctaattttttgtatttttagtagagacagggtttcaccgttttagccaggagggtcttgatctcctgacctcgtgatccacctgccttggcctcccaaagtgctgggattacaggcatgagccaccgcgcctggcctttttttttttttcttttatagtgttattttagaggaagaaaggagaagaaatttgattacttttgaaatcattaaactctcttttggatagcattgtcttgctatatggcattttaaatatatgaagtatattttacatgattatgtttgttaaaatccagttttttggctgataacattaatttatcaaacaatggaagaggttcatggattaaatattggtgtcctttatgtatctcaaagtgtgccataaaagcaattgtgggaaaagtctggaattaaagcaaaacatatgtaattaaaaaaataagaatttatatattgattgtagaaatccaaaaatgtctgaagaataaaagaaaaacccctagagataaccaccattaacatattggtgtatttttttccagcctttgtggatgagatttttttttttttttgtggtggttgtcaaaggaaattttaattctattatacttacaattttgctttctcctttttaaggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggtatagttctgtgtccaacttcttggtatcaggggacagatagtggccagtaactggatatcctgaatattttcaagctgtaatgttaatcagaattatatatattttgtttttttctttagaagattatttcttttttctagtgatttaaaaaaatttttaattgtgataaaatacacgtaacataaagtttaccaacttaaccatttttaagtgtacagatcagtagtgttatatacattcacatgtggtacaaccaagaagattctttctttattgttgtttttagtataactgtcagtccttgaaatattcatgcttagcatttctaaatttttcatttcaataaatgaattataatacttcttcagagaaaatgcgtttgttttaaaaggtaatctgtttaccagtctcttatactgggaaacttattttatgtctgcagataaaaattaaaagacccagaaatccagaccagtagtttgtggaatgttttgagataattaattatcaaatgtaatatacaaaagaagcccacaaagttttttttttcctgctctacctaatttttctgaattcctatatggaaacttttccctacatgagggattatgttgctagtaattttgtttctccctgcctactaaaatactagttttacttaatttcttttggtattgaaaccactaaaaattagcttctagttaacttttgatattgaaaataggtctgaatttttaattttcaaggaattcatagtaatggcagaaagactcatggagaattttggattataaaaattaaaaaaattgcattctttttacaaatataaaatacatcttgtggctaattctatttacacaatttaggacatgtgaaaaatacttaaaggtttttgctccagctagtggtttagccatcatctagacccactgtacaaatctgtagcaatggatagttaagcacaaccttaatattttatcttcatgatatttaaattttgctagttagggaaagacatagggcatagtgaaaggccaggaacaaagaaaatgacaatcagaaactatttggcctgttttagaatgtttcagatatttattgaaacctgttcaagatctctgagcaaatctgtttttagtttttctataagtgttcatattaaaatgttttattgaggttttttttacgttttttaacataacatataacacttagtaaataaatgtaggttaaactaataagtatgaaacatttgattttgaggtaaaactaactacaaatgtaaaatgtttgttttcatcactactacttttggaggcactttttacctggattctgtgtgaattttgcagatgtttggtgtgatgagtcaaggacttattctactgttatgtattgtatgtcatcatgtactttttctgatatggggaaatagattagttaagggatattaatcaaggattgattgggggtagtggttgagaacataagctttggaaccacagtaggttcaaattctaggttcactacttgcaagcaaactatataacattactccctgaaattcaattttagtctttaaattggcccctaataccaatcttgtaattttgagaattatcagagataatatatatgaagtatttaaagcttctggcaccatagtaagctttagattagtgctattatgctctatgagcttgtaatatattgggtaacttttcatgtaacttgtttgttagttttaaaaaaggtctatgtctaacacacaaaatccaaacgtacaagagtatatgtaaaatgcttatttatttattgtaagttacctttaagatagtaagcagtttggtaggtttatgctgaactaattttcaaagactttacaagtagtttttctttttataagtaacttaaagcaagttataatcaactatacttgtttacttttcctgtgttgtaaactactggagagcttatggatctataggtttaagaggtaaggatctatgttgtttgaacattctgtttcacaaaatatattcttgatagcttttaattctgccccttgtaatttctgttctattttctttgtctgaatttgactcttctaggtactttaaaaatggaatcatacaatatttgcccttttgtgactgtcttatttcacttagtataatgttttcaaggttagtcgatatcgtagcatgtgtcagaatttcattcctttttaaggctgaatcatgtgagtttgacaatttttaaattttgtaaatattcctggaatctgttccttcatctccactcctagtgccattgccctaattgtttctcatgtgggataattttatctaactaatttatcagtgtgtagtctcttctacctcttactctgctcctgccaatccatccatcctagaggtcaaaggcctaagcttcagggatcagaattgttttgaatcccttctctattccttaataattgtatgacttagagaagttactcatttgtaaaataaagataatagtatctaccatgtaattgtggtaggattagttaagaaaattaatgtaaagtgctcagcagcacactggcaccgtggtaaatgctcagtgcatgttagcactctcttcctggtggcttccagagatctgtcccaaatgcagcctggttgtgtcttttctccacttaacacatcaccgactgcccttcacctataataaataaacttcaggcaccttaatatacatatacaaagcatattacgcgttctttctctgccaaagtttcctatttactcttccttcctcacatgaatatactttactgggaacaccaaaccgtgagtgattcttggttttcaaccttgttatttcctacttctctttttgctttttgttatcccctctatttgatgcctggagtttcttcccaccatcctttcctctggttaattcctgcttattcattacttcctccagaaatcttcagtacttctccacctaatttttccttcattattaaattggatgtagctcttctgttttgtcacctgaagtatgtctgtcataatgtagttcaaagatacattgatatgttctctttgcattgacagttacatttatctttgtatatgcagtaatctaagaatatatacacactcgtgtgtagtggagtataagcttttaaggataggatctagaattacgtttatttggctcagtggttctgaatcctggctgaatgatcaaatcattgggccattaaaaaaaagtgcaggtctaccctaagagattaaatctaattgatctggaatgaggcttagtcatcaatatttaagagcttctggagtgattgtaatatatagtcaaggctaagaaccactgatgtagctcaaaatcaatgtatgagtgaaaaatggagtgagaggataagagaatatataacttctaagtaagagttttcatttttcttctaagtccacacatattcctctaaaatataaaatgtcctatcaataattgactttagaattcatttaaattgagtaaatactttttgagtctctatatgccattgtgaaattaatatatcaaaatcagagatgtttaaaccagatatgtgactttttcttcattataagaagaaagccaatttaacaaaataattttttatatctgtcaaaatatattaagatatatttcattccaaataagagtggagtggcatgggatgctactgtacatggtcaggcaatatataattatcattgttactctattgtaataaattaaattcctgttaagaattaaagaaaatatgccctgccattacaattatagaccactgaatttgatatagtttacgttgaaaatgtgaaaagaatgtgtattgtaggttaggcttatcttgttttatatttatccccacatatgggtatgaagttctgcaaatttttactagccattgggaaaatagggttctttcattggagggaagcttaaattgcaaagactggaagctggatttggcgaacaaagctttatcatgaagcatcctatttacttgcttattgtactacccagtcacagaagccacatacaatcaaagacaccttggttaagctgagaatattggacattattgagctggtttgttttagtgcagagaaaataaaaaaaaaggaagcatttcctctgtcagatgacatcatctgcattagaattgttgacatttctttcacgtttggctggaattcatagatgtatcagcagcgactttcctttaacattcaacaggctaaaaataccagtgtttcttagggctgccaacatctgattttaatcattatttgtacattgataccatcaaagaatttttatgttgtgagttcttttttttttttttttttaaattggaaactgacatctttgtaataatgaaaagtttggttagtaaaatttggtactctataccattggagctcctgagatgcttggcaaacatggttttgctgctttagtaaagaaagcgttgctgtctatttcagcacatggcatgcattagtgctaagacacagccaataattctaaaagaagtctcatctgctgacataaaactcaaatatattagagccacggttttgaattattgtgtttcccaagacatttatcaaaaaatgtaggcagaatattaaattcttcatgcagaatttttctggcttttcaaaggacaatgcttgaagcccttgtttgatccttggggagacatttactatttttgagagggagcaaaagccccctcataacaatttgatctagaggagttcattgatgatctatgtggtggacgtttggctatatgaaagacttaaatctttgttttcatggtcctgtggtatcagttatggatgttgctgtacaactcctggctattttggtcaaattaccacttcagaagagattggagtcagataatcatgtgaatttttcaatgcctggtggaagtgcttctgaagaaaaaagttgagaatgataactcttttgctgttttgaaattaagtttagatttgtaattttaatcctctcccagagtaaagagggcctcactgattgaaggaaaatggtatgaggctacgtaaattcaagtagaagagtcctggaatcttcagtattcctttataagcttatccttgtctggcaaggtaacatagaagctctgattcatttttcaacagaagatcttgtggcttaaagttttcagtacttgttgctattaaaatgaaaagccaggccgggcatggtggctgctgcctgtaatcccagcactttgggaggccaaagcggatggatcacttgaggttaggagttcgagaccagcctggtcaacgtggtgaaaactcgtctctactaaaaatacaaaaattagcggagtgtggtggcaggcacctgtaatcccagctactcgggatctgaggcaagagaatcacttgaacctgggaggcggaggttgcagtgagccaagatcgtcccactgcactccagcctgggcaacagagcgagaccccatctcaaaaacaacaaacaaacagccaatttcaacatgtggtttaggcctaggacaaatcttatactaattgactttattattattatcatttatttatttttgagatggagtctcgctctgtcgcccagactggagtgcagtggtgtgatctcggcgcactgcaacccttgcctcccaggttcaagagattcttctgcctcagcgtctcaagtagctgggattacaggcctatgccaccacgcccagctagtttttgtatttttggtagacacgggggtttcaccgtgttggccaggctggactcgaactaattgactttaaaataactcaaatttaggccgggcacggtggctcacgcctgtaatcccagcactttgggaggctgaggcgggtggatcacaaggtcaggagatcaagatcattctggctaacatggtgaaaccccatctctactaaaaatacaaaaaattagcctggcgtgcggctgtagtcccagctactcgggaggctgaggcaggaggatggcatgaacccaggaggctgagcttgcagtgacccgagattgcgccactgcactccagcctgggtgacagagccagactctgtctcaaaaaaaaaaaaaaaaaaaagtaaaataactcaaatttaaagaggcatgatatatatacaataaaattcatcttttaaaaggtagcttttagatttaccatatgaattttggcaaacatgaagttatacaaccctacctgagatagagaacattttcattacctcccagtttcctcatgtgcctttgtagtcaataccctctttcaacccccagttcctggcggtcactcactgacctgttttcttttggggtaggtttaccttttccagaatattagacactatcatgcagcatgcatttttagcacaatacatttgagattcatccatgttgttgcatgtatcagtatattccattgtatggttataccacatttatttaccagtttgacatttgggttgtttccagtttttggtatttgtgaataaagcccctgaaagggccgggcactgggtgatcccagcactttgggagactgaggcggttggatcacttgaggtcaggagttcaagaccagcctggccaacatggcaaaaccccatctctactaaaaatacaaaaattagctgggcatggtggcacacacctgtaatcccagctacttgggaggctgaggcatgagagagaatagcttgaacccagtgagctgagatcatgccactgcactgtggcctgggagacagagtgagactgtgtctcaaaaaaaaaaaaaaaaaaaaaaagaaacagccccgaaaacatttatatgtagattttatatgtgtaaatacctaggagtgggattgttagataagatgataaacgtatgcttatgagaaacagtcaaactcatttccaaggtggctgtatttccaccagcaatgtatggtggaattttgcatttctaccagcaatgtataagatttgttgttggtacaccacatccttggtagttaacactatcttttggtaaggagaagtttttaattttgatgaagtccagtttattatttttatcttccagtttatttattttgactttcagtcccgtatattattttgacttctgcttcatgtgtcttatcaaaggctgcaaagattttataatacttctaaaaactgtatagttatagttttgtcatttaggcctgtgatctattctgggctagttttgtatatggtgcaaggttaggatggaggttcatttttttttttggagacagagtctcgctctgtcgcccaggctggagtacagtggtatgatctcagctcactgggttcaagcgattctcctgtctcagtctcccgcgaagctgggattacaggtgcccaccaccatgcctggctaattttttgtatttttagtacagacagggtttcaccatactggtcaggctggccttgacctcctgacctcaggtgatccccctgcctcagcctctcaaagtgctggggaaacaggggtgagccaccgtgcctggatagctcatttttttttacatatggatattcaattgttttagcattgtttgttaaaaagactgccttgtctcactgagttagctgtctgtgcacattatgtatctaaagcacttcacctttagtgaaaattactacatctgtgttggtttattactgaaggttcactctgtttcattaattcatgtgactatctttttgctaggaccacactgtcttgattatggtaaatttatagtaaatcagagagtgtgaatctctcaaatttgttcttttttccaaattgtttgggctattctaattcctttatatttccatataaatattaggatgcgcttgtcaatttctaaaaagaaaaattgctaagactgatttgggtttgtgttgaatctatagatcagtaaggggaattgacgtcttcacaatattgagtcttccaattcatggacataagttttttttttaatttaggtttttgacttctgttactaatattttctagtttttagcatatacatattatacatattctgttatatttttatctaaatatttcatggtttttggtgctattataaatggtacctaaaactgccatcaagaacatttttattcttatttttaagcttcatttgcattgcatttttaaaaatatatttttatttttaattagttaattcattagtttgtagagacagacagagtctcactgtgttatccaggtttgtctcaaatgcctggcctcaagcacttgtctcactttggcttcccaaagtgctgggattatagacgtatgagccaccatgcccagcctaaaatacattttttaaaaggtagaaaaaactgaaaatttctaaggcatttgaagtacattgccacaatattttaaaaagaggttgtgccagtttttcctgccaccagtactttgatcagttttgccacatagtatagtatatcactactgatttttaaaaattcaatttttctcctgtgctaaagtacacataaaattaactatttattttatttttaaattatttttacaatttttaactgtatagcttagtgacagtaagtatattcacattgttgtgtagctatcaccaccacccatctctagaaatttttcatcttcccaaactccatgcccattaagcagtaactccccatttctcactctcccagtccctgacaaacaacaattctactttccatctctatgaatttgaccactttagttacctcatataagtggaatcagacagtacttgcccttcttcatttagcgtaatatctcagggttcatccatgttgtagcatgtatcagaacttatctccttgttttaaggtgaataatatctcattgtatgtatatactgcattttgtttattcattcaagtgtctgtggatacttgggttgcttccagcttttggctattgtgaataatgctgctgtaaacatggcgtacaaatatctcttcaaattcctgtctttaattttttcggatatatatggagaaatggaactgcaaaatcatatgacaattctacttttaatcttattaggaactgccatacagtttccatagaggctgcaccagtttacattctcaacagtagtgcacaagcatctgatttctccatatccccaccaacgcttattttctgtttttttttttttttttttttttttttttaataattgctaccctaaggggtttgaagtggtatcttgtagttttgatatgtatttccctaataattagtgatgttgaacattgttttatgttcttctggccacttgtatgcattctttgtagagaagtctattcaagtcctttgcccatttttttaaaattggactgtttgctctgttgttgttgacttgtagttctttatatatcctggatattcacctcttatcagatgtatgatttgcaaatattttctcccattttatgggttgcctttactctctgttaataatgtcttttgagcacaaaaggttttgattttggtgaagtccattttatctatttttttcttttgttgcctatgcttttggtgtcatatccaataaattattttcaaatccaatgtcatgaaattttcaccacctgttttcctctaagagatttatagttttagttcttatctttagctctttgatccattttgagttaattttcgtagatggtataaatttagggttcaactccattattttcaatgtggtgctagttttcccaaaatgatttgttgaaaagactgtccattccacattgaatggtcttgttacccttatggaaaattgacgttttatgtaacggtttgttgctgggatctttattttattggtgtatacacctgtctatacattaataacacactggttttattttttaatttttattatttatcgtttcagcttttatttaagattcagggagtacatgtgcaaggtttgtgacataggtatattgcatcatgctgaggtttggggtgtgattgatcctgtcatccaggaactatgcatagtacccaaaacagttcttcagcccttgccctcacttccccttctccctttttggagtccccaatgtctattatttccaccactgggtgtccgtatgtgcccaatatttagctcctatttgtaagtgagaacatctctttatggttttctgttcctgtgttaattcacttaggatgatggccttcggcagtatgcatgttgctgcaaagaacatgatttcttttttttggggctgcatagtattccacggtttatatgtaacacattttctttattcagtccaccatgtatgggcacctgggctgattccatgtctttgctattgtgaatagtacttcaataaacataagagtgcaggtacgtttttggtagaaatatttcttttcctttgggtatatatccagtaatgggattgctggattgaacggtagctctattttctttgagaaatctccaaactgctttccacagtggctgaactaatttacattcccaccaacattgtacaaacattccttttcctctgcagccttgctggaatctcttgttttttttttttgactttttaataatatccattctgacttgtgtgagatgatatcttattgcatttttgatttgtatttctctgatgattagtgatgtggaacattttttcatatgtttgttggctgcttctatatcttcttttgagaagtatctgttcatatcatttgcctactttttaacgtggtcatttgatttttgcttgttgaattgtttaagtttcttataaattctggatactacaactttgtcagatgcacagtttgtgaatattttctctaattctgtagattgttcactctgttgatagtttcttttgctgtgcagaacctctttagtttaattaggtctcacttgtcaattattgtttttgttgcaatagcttttgaataattagttataaattatttcccaaggctgatgtccagaatggtgtttctcaagttttttctaggattgtttatagtttgagatcttacatttaaatcttcaatccatcttgagttaagttttgtatatggtgaaaggtaggagtccagtttcattcttctgcatatggctagccagctatcccatcaccatttattgaatagggagtcctttccccattgcttatttttgttgactttgtcaaagatcagatggctttagatgcatggctttatttctaagttctctattctgttccattggtctatgtgtctgtttttgtaccagtgctatgctgctttggttactgtagccttataatatgggttgaagttaggtaatgtgatgcctccagctttgttctttttgtctgtgattgttttggctgttcaggctccttgttggttccacattaattttagaatggtctagggattttttttggctggtaagttttttattattgattcaatttcataattaggtattggtctgtttagagtttcaatttctttctgtttcattcttgggagattgctttcaggaatttattcatttcctctagattttctagtttgtgtgcatagatgtgtttataatagtctctgaggatcttttgtatttttgtgggattggttgtaatgtcacctttgtcttttttattgtgcttatttggatcttctctctgtttttctttgttaatctagctagtgcttgcttgtatgaaaaagctcttatatctccttaacttatgaagcttagtttggtgggatatgaaattgttggttggaatttctttcctttaagatgctagaaataggcctacaatctctcctggctggtaaggtttctgctgagaagtctgctgttaatctgatgggtttccctttgtacatgacttgacttttttctctagttgcctttatatatatattagcagtgtccttccatagtctggtaactatacaccttgataatgttgattttgtatagtgtcttgaaggtgttctctcaatttcttgtatttggatgtctacctttctagcaagattagggaaatgttcttgaattattccatcaaatatgttttctaggttgtttagtttttctctttcaagaatgccagtaattcatatatttgattgctttacataatcccaatatcacactatttttattattgtaattttgtagtatgttttgaaatcaagaaatttaagactttcaatttgattcttctttttcaagattgttttggctatttggcattccttgagatttgaatttttggatagatttttttctttttctgcaaacactcttgttgggtttttgatagagattgtgttggctctttagatggctttggataatattcacatcttaaccttattaatttttgaatccatgaacttggggtgtctttccattgatttttgtctttattttctttcagcaatttttgttgttttcagcatatacaagtcttttgcctctgtggttctgtttgttcctaaataacctattctttttggtgctattgaaaatgaaattattttcctaattttctttttgagtttttaattatttgttgaaatgcagctgattttggtgtgttgattttgtattctttaacattgtggaatttatttatttttcctaacagtttgtttttgtgtgtctgtgtgtatggaaactttagaattttctacatataaaggcataacatctgtaaacagagataattttagtttttcctaattttgatgtcttttatttcttttacttgcctaatcatcctagctagcacttttagtactgtgttgattagaagtggtgaaagtagttgtcctttccttctttctaatcttagagatttcaggggtttaccattcagtatgattttttttttatcttgaactatccttgcatcccaggattaaatctcatttggccatggtgtaggattcctgtaatgtgctattatatctatttgccagtattttgttgaggatttttgcatgaatattcatcagaagtattggtctgtaatttttatgttttgtctttgtctttggtatcagggtaatgctggcctcataaaataagtttggagatattttgttcttccattttttggaagagtttgaggatgattggtattcatctttaaatgtttggtataattttctagtgaagacatttggttctggatttttctttgtaggtagggttttgattacttattcagtctactttccagttaatatacttattaagattttctattgctttctggttcagtctagattgcgtatttctaggactttgttaatttttaaaatagattatctgatttgttgtggtgtaagtgttcatagttttctcttaaagttctttatatttctgtaaaattattaatgatgtcccctcttttatttataattttattttattattattattattgaaacagagtctctgtcgcccaggctgaagtgcggtggtgtgtgatcttggctcactgcaacctctgcctcctgagttcaaatgattcttgtgcctcagccgcctgagaagctgggattgcaggtgtgctctactatgcccggctaatttttgtatttttagtagagttggggttttgccatgctggccaggctggtctctaactcctggcctcaagtgatccacctgcctcggcctctcagagtgttgtgattacaggtgtgagacaccatggccgaccctcattgataattttagttgagtcttctcttcttcttatcagtctagttataaaggtttatcaattttattgatctttttgaagaagcaactcttggttttgttgatttttctccattgtttctcattctgtgttttctttttctctaacattattatttatttcattctgctagctttagttttgatttgttctctcctttatagttttttaagatgtaaagttaaactgttaatttgagattgctcttttaaaatgtaagcacttatacatgtccctccccattgttttcactgcatccccaaacttttttttttttttttttttttttttttgagacagtttcactctgttgcccaggatggagtagagtggcacaatctccgctcactgcaacctttgcctttgggtcaggtgattctcctgcctcagcctcctgagtagccgggattataggtgcccaccaccactcctggctaatttttgtacttttagtagagacggggtttcaccatattggccaggctgatctcgaactcctgacctcaagtaatctgcctgcctcagcttaccaaagtgctgggattacaagcatgagccactgcacctggcctgttgcatatatctgggggctctgatgtttggtgcacatgtatttataattgttatatcgtcttggtatattgattattttatcattatgtgattaaaaattattttttcctttttaaataacagtttttgacctaaaatccattttttttctggtggtaacatagccactgcagctctattggttatcatttgcatggaatttatttttccatcttttcccttccaacctattcatatcctggatctttagtctcttatagagagcatatagttggatcttgttttttatccattcttctaaactatgtcttttgattggggagtttaattcatttgcgtttagagtaattactgatcggaaagaactaactcttgccgttttgctgttttctatatgtatttaggttttctgtgatttcctcctttattaccttcctttgtgtttaattgatttttggtttcccttctcatttcctttgtgtacattctatagatattttctttgtggttaccacgggtattacatataatattttaggcttataataacctgttttaatcagatagtcacttaaattcaatcacatacaaaaagtttactcgtttacaactttgccctcccctactttgtcttattgttgttacagattacttcttcatattttatttacacattaacatagttttttaatgcttttgtcttttaaatgatgtagaagaataaaatcaattataaactaaaattatgttaacactgatttatgtatttgtccatgtatttaactttaccagataattttacattttgtgtagcttcaagttactatctagcatctattcattttaacttaaaggactccttttaatatttcttgtagggaaaatctaactataatgaattcccttggtttttatctaggaatgtcttaatttatctttcattttttaaaggatggtaaggcagagtttattcaaggggatccatggcaataggaactactctagctgggttttgcagcggcagagagagactggaaggaattccctcccttattgttgaaagataattttgccagatacagaaatcttggttgatcttttttttttttttttttttaacactttaaatatatcatcccactgccttgtggtcttcaaacttcggctgaggaatctgccaaaacacttactggggattccttgtacatagatgcgttgcttttctcttgatgctttaaaggtatatattttttaaatttatttccaactaccacatgttctcacttataagtgggagctaaacaacaagaacacgtggatactaggaggggaacaatgaacacgggaataattgagggtggagtgtaggaggagggagacgatcagaaaaaaatacctgctgagtactatgcttattacctgggtgatgaaattatctgtaaactaaacccccgtgacacatagtttacctacataacaaacctgtacatatacccctgaacttaaagtaaaagtgaaaaaaagagagaggtttatttaggaaagaggtctcccttgtagatagattaaaatattacgcattctaaactgaaacttggctggaaacagtggctcatacctgtaatcccagtactttgggaggctgaggaaggaggattgcttgagttcaggagttcaagaccagcctaggcaacattgcaaaaccccatcaatataaaaaatacaaaaaaattagctggccatggtggtgccctcttgtagttccagcttctcgggaggatgaggtgggaggatcgcttgagcccaggaggtcaaggctgcagtaaactgagattggaccactgcatttaagccggggcaacagagtgagaccctatctcaatcaatctgaatcaatctcaatcaatcaaaactgaaacttaatccttcaaatatgtttattttacttgtcctaaaacaatgtccctagaagtattaaagtgtaaagcactgttattttcccattttgagatctctaatgtaaaaatgtattttttgaaaataatttaaaacataaaatgctatataataaacatttaaaaattttttttatttttatattttgagacagggtcttgctgtattgctcaggctggagtgcagtggcaggtcatagctcactgcagccctgatctcccaggctcaagtgattctcctgcctcagcctcctgagtagctgggactgtaggcacacacaaccatacctggctaatttttagtagagataaggttggtcttgaactcctgaactcaagcgatccttttgtcttgtcctcccaaagtgctgagattacaggcataagccaccacacctggtctaaaggtattgtttttaaatttcaatttctaattgtttattgctactatatagatatgcagttgaattttgtaaattgacctaatatcctgtgacctcgttaaacccacttaataattttagtagttgttttgtagaccatttggggttgctttatgtagactataatctattttgatgaataaaaaaaaatatttcttcccagagtgtttttttttcttggcttattgcactgactaggacttccagtacaaaattaaataagagtgccaagagcagaaatcttgttcctgattttaaggggaaagcattctatctttcaccaagtgctatgttagctgtatggttttaatttttttttgtagatatcctttatcagatggaaacagttttctttaatgtagtttttttttttttaaatcatgagttgatgtttaaacaattttcccctctattgaaataaatgggtttccttctttcatgttttgatatggtgagatacactgattgatttttgaatgttcagctttcattttatatattgctggattcaatttgctaagatttcgttgtggatttttgcttctatgttcatgaggagtactggtctgtagttttgttattttgtgctgggtattagggtaatattagtttcatagaatgaattgctatgtatctgtatctcttctgttttctgatagagtttttagctttctgaatttagaatttttccttgtgggaaggtttttaatggaattaaatttctttaactgatacgtctctttaggttatctgtttcttcttgagtaaattttggtaatttcttgcaatggatttatccattttacttaagttgtaaaatttattgaaagttgataatatattattttaatgcctctaggatctatgtaacatcccttctttaattcttaatactgtttgcttgtgtcttctgtctgtctctctctctttctctctctgtctgtcgtgctagaggtttttctatttatttatttgtttatttattgagacagaggctcactctgttgctcgggctggagttcaggtggtatgatctcggctcactgcaaccagcacctcctgggttcacgtgattctcgtgcctcagcctcccgactagctgggattacaggtgtgtgccaccacacctgactaatttttgtatttttagtagagaatgggtttcaccatgttagtcaggctggtctccaactcttggcctcaagtgatccgcctgccttggcctcctaaagtgctgggattacgggtgcgagccaccctgcctggccaggtttttcaattttattgataatttcaaagaatggacttttgaccttactgatttctctctctctttttttttttttttggtttttaatttcactttttttcccttttaaaattttcattatttccttcctcctgtttactttggacttattttggccttctttttctagtttcttaaggtgggatattatgctattgatttgagacgtacttattttctgatataataatttaatgctgtaaatttccctctaggcactgctttgggtacatctcaaaagtttggacattatgttttcatttgcattcaattaaaattattttctaatttatcttatgatttagtctttgaccattgggtatttataattgtgttgtttaatttttaaatatttgggggattttccagatatctttctgttactggtttctagtgtaattcttttgtggtcagagaatatactttatatattttaaatttgttagggtttgttttatgtttcagaatatggtttatcttggcaaacatgatatgtgctcttgaagctatttggctatttttgggtggggtattctctatatattaattaggttaagttggttgattgcattgtccagggtttccatatctttactgaatttcagtccactttttctattgactactgagagaggaattttaagtcttcacctgtaattttagatttgtctattttttatttttattactttttagtttagttttgaagctatgtttgtaggtatataagtatttaggattgtcatcttcaatcgatccctttattatatttaatgttttttatttatctctgataatatttctggttctgaagttaacattttctgatattaatatagcagtttcaggtttattttgattagtgtttgcatggtatgtgttttttctgttcatttacttttaacttacctgtgtcattgtatttaaagtgagtttctttctttctttcttttttttttttgagatggtgtctcgctctgtcacccaggctggagtgcagtggcgcgatctcagctcactgcaacctctgccttccaggttcaagcatttcacctgcctcagcctcctgaagagctgggattacaggcatgtgccaccacgcccagctaatttttaaaaaacatttttagtagagatggggtttcaccatattgaccagactggtcttgaactcctgaccttgtgatctgcccacctcggcctgccagatagacaccatatggttgggtcttgctaatttaacccagtatgataatctctatcttttaaatgagatgtttaggccatttatattcaatatagttattaatcaacttgtcagggtgtgtgtgtgtgtgtgtgtgtgtgtgtttgtgtgtgtgtgtgtttgtgttcttccttttttctgttttcctgaatgcttttgattcttttttgctgtgtcacatctactgatgaccccttcacatgaaatttttactctcatattgtggtttttattgttagaattttgtgctaaaattcttgtttttcttttttctttattttcctaactccccaaacttgttatctgtgctgaaattctttatttgttcatggatttttttccacttttttccctaaattatttggtgtatcaatcatagtttgacatttctaactgtctctgagtctggttctcttgattgctttgcagtgtgatggttggtttttgttgcttttagtttgtattattatttttgagaagagtctcactctgtcacttaggctggagtgctgtggtgcaatcacagctcactgcagcctcaacctccctgggctcaggtgatcttcctgcctccacctcttcagcatgcaccaccactcccagctaatttttttttttttttgtattttttgtagagatgggatcttgctatgtttccaagactagtcctgaacttctgggctcaagcaatctgccagcttcagtgtcccaaagtgctgggattacaggcatgagtggccatgcccagcctcattaattttgattgaatgtcagacatcttatatataaagagagactgaagtaaatagtatttatagttgggaatggacattactcttcttatagagagatatgtttgtatgtcccatctgtaagggctgtccctccttggatttcaggctgcttcaagaaaagttgtgattttgtaatttatccagcttttgttcattgttagtatggtagtggcattcttttcagcttttacattatgggctgtgggccctctaagatttctctaatttattcgtaacagaatacaaatttatcttatttatgtaatttggacttattttcatttttgagcacatagccattaatttttgcatacatgtgatattccttatatttcatctgtgaagcaaatctgtttccaatgtagtaaaaattaattacatgtaaacttacataattttagtcaatttgaatttttctacacagtattatttgttgggtatacttttttgagggttcattattggtaatattcatatgggtttgaatcctagaagggcagttgtccactcaaaaaataagttgagtatatgcatattattaaagttgtatcttaagttattgagatgtgtattattgtattaaacatcacccatgacttgcaaactcagaagaaatatgaataaagggcatctgttcaaaccttagtaaaacttcttggcttctgttaggagccttcttgactctgcaaattcccaagactttccaggctgatacgatgaaggctttttgggtgctgtatcactcttcattcccctcttcatagcccctggtaaccttgattttactgtctgtttttatgaatttgcctgttctaggtacctcatataagtggaatcatataatatttgtcctgtgtttgccttatttcacttactataacctttatatttctgattgtaaaggatggaaagtcatcctttccatttgcttgggctacatttctatattccagtcttaaagctaatgtaacctgttgcttatgtaatatgtgtgtcaacattatgtatggatttccaaaacaaccagcattatagcatctggagctttcaccaagttttcaaggggcctcttacttttccaaagaggttaagaactactgctatagattctgaagcatatataatcatataaaacagcccctgatcttaaggagcttgacattttattgatctttgtcctgtctatgacaaactaatgggttggggtgggtagtattgtatgaccaatatagaagcctacactgaagagtgaagcgcagtgacttacgcctgtaatctcagcactttgggaggccgaggcgggcggatcacgaggtcagcagatctacatcatcctggctaacacggtggaaccctgtctctactaaaaatacaaaaataaaattagccgggcatggttgcgggcacctgtagtcccagctacttgggaggctgaggcgggagaatgctgtgaacccgggaggcagagcttgcagtgagccgagaacgcgccactgcactccagcctgggcgacagagcgagaccccgcctcaaaaaataaataaataaataaataaataaatacacaaataaattagaaaatgcctataaaatacttagcagaggggtttatttgttagctgtgctggatgaaggtaatgataaaataataaccatctacgtgaccagaggtgattactaaatttcctttatatattttttacttttgttgtgctgaattatctataacataaaaatttgccattttacccatttttaggtgtacatttcagtggtactaagtacattcacaatgttgtacaaccatccccactctgtatttccagtactttttcatcttctcaaacagaaactctgtactcattaaacaataacttttcattcccctcttcatatcccctagtaacctcgattttactttctgtttctatgaatttgcctattctaggtgcctcatataagtggaatcatgtaagatttgtccttctgtgtttggcttatttcacttagtgtaatcctttacatttttatttatccattaagcacaatgacatttgtcttttctatttcattgaattactgtttaaagtcaaatgaaatagttaaatcctaataggtactatataaatttaagacggtatgtataaaaactggtaaatattacctgaaagtaataaactcatttgctgtctccctgtgattgtaagtgggttactttatttataatttaaaaaattattcctatgttacatagaaatgctaggcttattctaaaattcaaagttagattttaatgtcataagagagaagtttgcttgaactgaccatttgtggaatgtttgttaattttaaatttggattcaatattttatataccttatttgacttgaactttattgtatttctttctctttttaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggtgaggatgacttttgagctgagacttcctttattaatttataacatttctactttattatgccttggaaccaaaaggaatagcaagattaatcttttctttactcttttgaaataagacttatttggggccgggcacggtggctcacacatgtaatcccagcacttcaggaggctgaggcaggtggatcatttgaggtttggagttcgaggccagcttgggccaacatggtgaaaccctgtctttactaataaaacaaaaattagcagggcatggtggcacatgcctgtaaacccagctactcaggagactgaggcaaaagcattgcaggagacaggttgtagtgaaccaagaaatgccactgtattccagcctgggtgacagagcaagactctttaaaaaaaaaaaagacttattatatgcttggatttaaacttttaatcttcaactgtaatttaaaaccaataataaatatttgggaatgggcttctgtattggtcttaactagaggtagtaggtgatctaggcaatgggagtggctgttaaagaaggcagcctaggtagaaacatatagtatctgctctaattctagtaaatgtcataaaatccaggtagagtgtgcttattaaaaagtgtgtaagtagtattagctataatttatggcagccttatatatgtgccaggcatcatattaagtcttaaatgccttatcttaatagtcccaaagtcctgtggttcttactgctatcctgattttagatatgaggaaactgagatatggagagttttagtaacttgcctaaggtcagtcttgtaattattaaatggccaaacgggatttatttatttatttatttttgagacagggtcttgctctgttgcccaggctggagtgcagtggtgtgatcttgactcactgcaacctctgcttcctgggttcaaatgattcttatgcctcagcctcctgagtagctaggattacaggcacaccaccatgcccagctaatatttatatttttagtagagatggggtttcaccatgctggccaagctggtctcgaactcctggcctcaagtgattctcctgccttggcctttcaaagtgctgggattacaagcatgaaccactgcacccggctcaaacagggatttaaacccaggctatttgacttttagtacaattatattctgctgctctaggttcctttatttctttgttttgttttggtttggtttttgagatggagtctcgctctgtcgctcaggcttgagtgcagtggtgtgatcacagctcactgcagcctcaacttactgggttcagatgattctcctgccttactctcccaagtagctgggattacaggtgtgtgccaccatgccaagttaattttttgtattttcagtagagatgggatttcaccatgttgcccaagtaagtcttgaactcctggcctcaagcaatctgcctgcctaggcctcccgtagtgctgggattataggaatgagccaccacgccgagacaagttcctttatttctatatgtctctttatctttaaacaatttaaagcatcataaaattccttaatgtgatcatctttcgtctttaggaccctttaaattctggagatgatgttagtgaacaggatgtgccagacctgtttgacacggataatgttattgtctgtcagtatgataaggtactgtatttaccttttggactttgggtttattaactgcatttatagtagaaaggtatgtaaaatgatgggaaataagatgaagagttacacttcacaattaatcaaaacagcagtttaattctggaaattctgagtgtgtattttgggtctagcgctgtgctatgtgatctcagtgataccagaaaaagtgacagtccttaaggaagtaatgatcttattgaaacaagatgtttcttttggaaaactagaaagacatacaatgagatggtaggtaaatcaacagctaaaatatgtgacaggtaaatcaaatgctaaaatatgtggaatgtaatcaaatgctaagatgagtggcaggtaaatcaaatgctaagatatgcagcacagatagtaagccctagaagtggctaggaaatgtaagaaatcatttgtagttggagttccccataaatccatgggtgatgtggggttttgaaatgggtcttgaatgacttgtaggatacaggtaaatatggagaataagcatcagatagaatagcccaataaaaagcagagaaatgaatggatgtagtatgtacaagggacactgaagagatagctctggcttgaacaaagtgtcttttattggatgtatagtactaggaagtgaagctgggtgggagacagaataggaagcagattagaatatcctgaatgctagtaggaaaaatctgaacttggtctgagggacactagccttctgagaaggttattgagaaaattgtaattgggtttaaaagccagatgtgtttgatttggaaaaagcaaatggtaaaagtgggtagggcagacgtgaagtgcccagaacccagacagaggatggcagtgtaagaacatggagaagtcagaggttatgatggaaaaatcggtgggacttggtcattagttgaaggtgtctctcaggtttccagcctagagattatgttagtagcagtctaactctagcaactaaaaataatactgctttttaaaaaacactacagctgtgattatgtagtcaaatgggagtttttgtccttaattcatgaatatttatattcttaaagtggctttgagatataatgaacatagtatacaattcgcctatttaaagtatacaattcaatggtttatttagtgtattcatagatatgtataacaattatcacagtcaattttagaaccattttatcacctcaaaaagaaaccccatactttttgtttcttagtgcagtattctccccattttccctactccaagcctgtaggcctaagaaaccactgatctactctctatttctatggattttcctattctggaatttcatatgaaagaaattatataatatgtggtcttttgttactggcttctttcacttagcacagtgttttcaagagtcatccatgttgtaacatatatcacgtcttcgttttttaaaaaaattgctgaataatagtctattgaatggatataccacattttctttttccgtttgtcttttgagggacatttgggttgtttccactgtaggggagaaaaaagtaataccttttccttacccattgctatttccctggttgaggcacctataaaaaagacagattaacaagagaaaatcattcaaatttattttaacgtacattttactgacacaggaaactttttttttttttttttttttgagatggagtctggctctgtcgcccaggctggagtgtagtggcgtgatcttggctcactgcaagctccgcctcccgggttcaaaggatcttcctgcctcagcctcccaagtagctgggactacaggcgcctgccaccacgcccggataattttttgtatttttagtagagatggggtttcaccgtgttagccaggatggtctggatctgacttcgtgatctacccacctgggaagtgctgggattataggtgtgagccactgcacccagccgacacaggaatatttagaaatgaagacccaaagaaacagggaaaactatttttctggacagtcataccgaagtatgataggaggaaaaaaggatatgatctaatgacaataaactggaggaaacgtagtaaggcctgtttgttcagatttttgtgtctctgtgtcttcagagataaggacacttattttcctttgtgtatagggtagggacctctgtaataaaggttttatgacttactttaaaggaaggtcagataatccttttatggcctggttcaggggagaagggtgagggcaaggtcagaaagactttcctgcttctgccattttttcaaatgtcaggatgccagaacacatatggggtaatgtgttctgaaccccatagatacctttttgctgctatgaataatgcctctatgaacatttgggtacaggtttttgcgtggacatatgttttcatctgtcttggcatatactcaggagttgaattcctgggtcatgtggtaacagcttaaggaactattagactattttccaaagtggctgtactattttacattcttattagcagtgttcgagggtttcaatttctccacatcctggccagcactggccataatccgactttctaattctaaccattctaatgagtgtgaaatggtatatcattgcggttttgatttgtgtttccctgataactaatgcgtatttacatatttagccttttttttttccagtcacaatttgaatatatttagggggaaacaaagaataatgttttgaattgctgtaaaaagaaatctttttctctgaaaataaggtcactttctccactataacattttatacaaatagaaaaccgcaatttagatgctgaatacaaatataaacataagaaggaataggggatagaaaaggaacagttcttagtttgaaacttgttttagtttcttataaacaatatattgccttctataaaaaaacattataaggtacttaattatatatacattccataaagtctcatgcagaattttctagaccattatggatgtggtatcctttgtttgccgcaatgtgggagataccttgtaattaattatgtagtactttgtatttttgcggtgttttatcatatattatcttttgtttcttataataaccttatggaatagatagaggtgatattaaatatacactgctaacaaatctagtatctgagaacccttctacttagtgaatattttaagaacagtggtaaaaaattaatggaaagcagggcattggggaaccattgaaacattttaaaaggggagtgatgtagtcagaagatagccaaaagaatgtatctaaaggtcaaagtggggtgaggaacactgttatagtgaatctttatgaaagaaaaactttccagtgctggtcactggttgatttgtttcaaatagtattgaatgtaacccaactcaagtgaattgaaagaactttcagtagtctcttttagagctttactaattcagtgtgttttatgggcttagcacgcttttgttatgccactctgctaacttactcagcttattttaaaggcaggtagtatcagttcctctgggaaactattacaaatgcagaatcctgagtcccacgccagagtactggataagaatgtacattttaacaagactccaaaatgatttgtatggccgttaaattttgagaagcagtgtttggtttctttagtatattttatttggatttgattaacagatggaatttatctttaaaatttagagattaacaattggggggaaaactttgaaaatataaacatgtacagtgcaaaagggctaaatgaaggccactggtttacatactgggtgagaattagttaaatggtatagatattttgtttcagaggcctagagaatgtctaaaattaatataaggatttaaataataaagatattatagcgaaaattaatggtgaaatgaaaccttttactacagatggaggtgttctgtgctacaaataggacactatttatagtggaatgtgaaaccatttgaatatcctatatcttcgtttgacagtttagcagacttgcttatagctgactttatcccttagatgctatacaatgattaatttctaggtgtgtagcatggtttctttatatatacagagagagatatgtatatatgtgtatatatagtctctttatatgtatctatatatctctctatataatagtctatatatatgtacatttcctttgaatagatagtgcatacacatggttaaaaaatcaaaatactgtaaaaaggtatacaatgaaaagtctggttcacattccttcatcatttttgctttctattagtagctccttttcctgttttgaatgcaaataagtagttatattagttttcatcgaatttctttattcaaatacaaatacaaaagatagcataaataacactatattctgtaccttgctttttttctttaaacaacgtatctgtcagatcttcccatatgaggaggctttctttgtgatgatattttaatggctgtataatatcctattgtaggattactaaaattcatttaaccaatcctctactgatggatatttgtgatttttcagtcttttgatttgaaccactatgtatataagacattttcataatgtgtgcagatatatctattaaatccccagaaatgggattctgggtcaaagggcaaatgtacgtggttaggtattcccaaaatgctctctaagagcattttgccattgtgaaagatgaaaagtgataccttgttggaatttttaactttccatatgttaaagggccttttgtatttacattttgtgaactgtttgttcataatctttgtctatttaaaaaattggattatttggtcttatatttagtgatctctaagagctcaatattattttggagaaaatgagctttttgttatacacagaagtactttttactcagttattttcattgctttttcttttcaatatgtagattttggatctgtcaatctttaattttatgtcttctgcattttgagccatgaataaaaagttctttcttacctcagagttttaaagggaagctcatgttttcttcaagtatttcatatatatctatatatctatatctatatctatatcatctatatctatatctatatctatatactcaagtcttgattcatttggtgtttgtcttggtgtataatgtaacatatggtttcaactttttatttttttttttccaggtggctactcaatcttcctaacattttttaagaaatctatttcgtccctaatgttaagacatgatttatcatctgctactgcatttctaaatgtatttgggtctacttattgattttctgttttgttccattggtttgtctgtccataggcctatgctactctgatttaattattaagatttttaatgtctggtaaggttagtaattctttactaatttttttgcagagttttcctggatattcttgttcatttttcatattaactccagaatcaacttgtctggttcaaaataaaaccctgttggtattttcattgagatcacattaaattaataaaatttgttattttaatgatgctggggaggaatagattgcaattttagatggagtgtctaggggggccttattgagaatgtaatagggtaaagatcagaaggaagtaagggaatgaactgtgaggatattagagtgtaagcattttgaacagaaagaacaagaaatacaaaagtcctgaggtaggagtatgcccgtgtgttcagggaacagtgcagaggccagagcagtaagtgaggaaaaataaaggattttgtagtccattgtaaggactttagtttttggatgggaagtcattggagagtttcgacaagagaaatgacatctgatttatgtttttagcagacactctgggtatcctgtttatagtagactgaagtgggtgttgtcagggaacaagggtaaaaacaggaactagttatgaggctattgtattgacctgggcaagagaagatgatggctgagataagagtaacagtagtggaagtggtagaagtttttggaatatgaatatgttttgtaggtagaactaacacttactgatggatctggatatgggatgtaagtagcaagcataaagaatacctctaagatttttgacttgagctcttagaagaataagtggtcatttcccagtgagatggggaagattgtgaggtttggggaagacagtataagtgtcatagttgtaaactctgagatgggtgtgtgtgtgtgtgtgtgtgtgtgtgtgtgtaatacacagtctttaatattttttctggagttttaaaaaatctaatatgcaatagttttattaaatactttttcaacacaattagaggtgattatatgatttgtcagtaactgaagtaatatgatttttatattaataagttcctaacattgaactattgttgtatatctagaaaaaatatagtcactagataaaggtaccacaattagttgttgcttctgttgttctcctaatgctgcttatattttattacctgtgctgagtttgggatgtttgttgtcaccgttgtattcccgagagatttttaagacacgtgcaagtgactgtgcaagacaatttgggaataaaactcagaaaaaatttattaggactttaaaacccccccacaaaaataggggtttatcctgtgtgttttcttatgcttcacaaaatgcatctgaataccagtcacagcctttgttcttggatttgactatttgtagtcaacaactaggtttaaattttactcttgatctcagatcatatattcctagggcttttaaatagtcacttgcagtttacttagaggtagcaatgattttatggcttgttacctcttgaagtattaaaatttcttattttttattgtgtctgtgtctaggctgatttatggaatctagaaaacagccagcagagtcttacagattataagctgtatattctgaccttgttcagtgctttattgggactttcttcctcatgatgaagtatcactttttcatttctgataatattggctacatcttccctgtttattcctttgcagacatactggactctgtgctgttcttgaacaatccaggcatgcccctctttaggactgttcacttctattccttttatctggaatgctcctgagtaaatatctgccttgctttactccttaccttcttcaagtttttgctcaagtgtcacctcaaatgacagcttaatattctacataatttacttatgtattaggtttctgtccttccctattaaaatgtaaactcttaaaaggcagggattttttttggttttacatatacaggatgtgtgtttttatatataatatatacagtatagaaatatatgtatcttaaactaatatatttccagtgcctaaaacagtgtctaacacataggaactcaaatgtttatggaataaacaaactatcttgaggagattttaattttaaggcactcacatttcgggtgagaataatcccatttactgtagcagagaaatgcaggtgatcctttaacttgtaaaattaattaatgtaaactacttttctccctccagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaattacacaa

SEQ ID NO: 1780 - DNA, 167013 bp, Homo sapiens
gaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggtatcgaggagtctcgcagtccccctttccccaccacagcggggccgggacccgtggggaggcgcgcctttctccctctgccttgggacctaccccgcccagcgacgctccctggcagatgcacaccctgcttcgctcgcggccgggggctggagggacgcggctgcgcccggctccccaaacccgggcccctgcccctttccgaactgcggccagacaggcttcgcctccgcgcccgggtttggttttggtcacttggatactcgcagtcgcatcctctccgcttcccccccaagcccaagttcttggtggtgacggtagctgatacctgccgggggcccaggagtgacatgcagtccactagttgaaatgaacaggaaagtgtaaacacttcggttagagtaaaatccatcgatgaaggagcctgtttttaaaatttcaaacccacacttggctttgtttttacccagtcaaacttaagttgtaaacacagacgagtaacgtttagaaagtctcagagccgggaacttaacaatagatgatgcttggtacttgtttattaaccagctatggtaattccgcggtccttgagtgagaaatcacattttcatgtgatcttgccagtgaaaaacatttgctaaatcaattgcattaaaattactttcctgtttgtagagtttttgtaaggatggacttgactatactcatgttcaaagagattgaattttcctttagttttgcatccttaccatcatctcttttgattttaccagaacctttagatagggttgggagattggatgtgggaaactcactgaacagtagatctttaagtcactctgtcttcaacttagaaaccaattaggagctgctgaacatcaaagtaactttgtgaacagtatcatcagtttaataaaacagttcatgaaattcattctctgtcgcccaggctggagtgcagtggtgcagtctcagctcactgcaagctccgcctcccgggttcacgccattctccagcctcagcctcccgaatagctgggactacaggtgtccgccaccacgcctggctaattttttgtatttttagtagagatggggtttcaccgtgttagccaggacagtctcgatctcctgacctcgtggtccgccagccttggccttccaaagtgctgggattacagaaattcattctctcatagtttgttctgttggattcttttgcccattttataggtccttgctgactgagtgaagggtgtaaaaatgggaccatcttcaaattgaatgtgcctttggttaaacaaggttgggacatttaatatggtgccctcttttcgttttaccatttttctgttcttcgttggataaggagcaaagggataaataaatgacaacaatgaattgaagcatttgtcatctgcagacctcaccctttggggagttttaagatgtgaacccatgataaaggcctttgatactctgagtcctaatctaagacactctttggcatattttccgcactctttcctcccacttctgcctccccacatagttaggcctttagctggctaaagagctaagatacttttttatgaccgacttggttaaggaagtcagtctattggaaacagcctgatgaacctcttcccacaaatacttacattctttaaaaatgtggctccaaacatggtgttggcttttgtgacctcggacatatatagactaggaaaatgattgacatactcttggcaaatgtaagaatacagagatggtcataatagtctagaatgatgatctcttagattttgtaatattaatactcttatataattgtaggcagtatcccgcaccataaaaatcttagtcaaatcagactcctgctcttcgggaatcttggggaaaaatagtaattgaactcccaattgttttgtaaaaagcatttaggtgattaaatattcacttttatatcttttaaagtatactctcccgcttatttattcagctagagatcacagtacccaagaatacatagcattaaaactgctgaaaattacaactcgaagtaaaattttgtatctcaatctagtaagtacacacatatacaaacatatattttcagaaagaatacatgccctaatactgtgtgggctgatattttttcagttctattcctttaaaaaatgctgtccagatctaaattaatttcagaacccaacaaggcttgaaacatacagtttaggaaaaagaacactgctaattagtccatggtcataagtagtagcttcatttaatttgttttgctttcacattcaacttatgggaattcagtgatgtgtgcttggtgaagtttgagtaattccccataccattctacatcattggaatgcctcagaataagcatgtaatagaaagcaatcaaatgtttctcttaatatcagcatctcatcccactctaagtgattgtattatctaattaaactttaaaaaaatatggccccctgattagcaactgaactataaataatgcttatatgaagaaaaagtgattaatttcaatgagggaagaaaagctatctgtattggacttactgagggtagtaggtaagcttccaaatgtagctttttcctaaggaatttttcaagggtgttccaaagggtaattttgcatccatggcatttaatgccctatttcactaatttagaacctaactccactacacttttaattttgattatatatttcaagaatgtgttctgtttgtgataaaggatgctggggcatgtgtatttgtacatttatcaccatttatagagtgagatgagaaaaaagtgttatgtttacatagaaagagtaatatgtttatatagcatttataaagcttattttttggtatcaggcaaaaatattgactaaacctataagccagttttaggaaaaaaattagggtatttaaatgaaatatgaaattagtttcatcattaaagctcatccactttaatgatgaaaccaacttttgaagcaggcgatgttggaattgtatgtgatcagagaagtcagccagttatattttatgttagaaatttagatgtgttaaaacttcatttattcacaaagaaaaacaaatttgagaacttactgtgtaattccaccagttgtttgtagctgtattctacttggcgagtctttttgtgaaattatttttcatgctaataatttactaagtggctacctggtgccatattttgtaagtaaactcttgacatcctttgccctgagctctgatgaccaaatatttgtttagatttaggaaacagtttcaagtgtttgttgagttcattcctccagtagaggtcaattgagggcttaatatattgccaacactaaattattttttgtgggactaggtacccagtgaaaaatggcaatttggggtgtctgtgtttgtatagatggtatctatttccaggtcagttgatgaaagacaaaaccaatccacctccagggaaatttagacctagtatttagtatttagtcaactgtttcatagcccaagtttaataaactttgtgaaaatgattaggaatttttatttttaatttttaaaaattattatttgattctgtttggaagttctatagtgagaaaaaagaattattattttatttttattttttatttttagatgcagtctcgctctgtcgcccaggctggggtgcagtggtgcaatatgggctcactgtaacctctgcctccctggttcaagctattgtcctgcctcagcctcctgagtagctgggattacaggttcatgccaccacgcctggctgatttttgtatttttagtagagacggggtttcaccgtgttggtcaggctggtctcaaactcctgaccttgtgatctgcccgccttggcctcccaaagtgctgggattacagatgtgagccactgcacctggcctgagaataaagaattttataatgacagtagtttgggaggctgagatgggcggatcacttgaggttgggagtttgagaccagcctggccaacatggcgaaacccagtctctactaaaatacaaaaattagcggagtgtggcagcatgcaccattaatcccagctacatgggaagctgaggcaggagaattgcttgaacttgggaggcgaaggttgcagtgcactgaggttgcgccactgcactccagcctgggcaacagagtgagactttgtctcaaaaaaaaaaaaggaattttatagtgagtaatgttaggtttttattttttgttttcattttatttgtgacagtctccctctgtcacccacgctggagtacagtggtgcaatcatggctcattgcagcgttgacctcctgggctcaaaggatccacccacctcagcctccagagtagctaggactacaggtgtgtgccaccacactaggctaagttttgcattttttgtagagatggggtctctgtctccctgtgttgcccaggttggtctcgaacgtctggacttaagccatttgtccatctcagccttataggggtgagctaccgcacctggccaaggtttttatttttgttatttaaaaagaacatctttaagtgcctgaaggaagggaaaatataaagagaatatgagtgattgataatagtttccttgtattaatgtctggaacagtttggaaactagttctgtgttttttcggggggggactttattttttgtatatgaaagtttttttagtaattctaggtgtaatccaaattgaccatagtatagcatttaaataactgaaaaactcacaaaattcatatataacatagttccacaatccatttgtaacattttattgttcacaaaagaatttactgtttttcatatcaccagacttactgtacagcatggtgttatagttaataacaatagattgtgcacttgaaaattactaagagaatagattttaagtgctctcatcacaaaaaaatggtgggtgtatgaggtaatggttatgtttttttctttgttttttgagatagggtcttggtctattgcccaggctgtatggtttcatgatcatggctcattctagccttgacctcccgggctcagcaatcgtcccaccctcagtctcctgagtagctggaactacaggcgtattccactatggctagctaatttttaagttttttgtggcgatgggggtctcactatgttgcccaggccagtctcaaactcctgggctcagatgatcccctcccatcttggcctcccaaagtgattacagatgtgacccactgtgctcgccctaatggttatgttaattagcttgatttaaccattctaaaatgtatacataaaacattatgttgtatgccataaatatatgcaatttttatttgttgattaaaaaatattaaaaaacaaaaattccagaagaagaaatgggtaaatatatttctaatcttggaatagagaaggcttttctaactggtacataaaatccataagccataattgaaaagatggatacatttgagtatgtaaaattaataacttgctttttcaaaaaaatcatcataaataagcagcaacagactgggaagaatatttctaacaatgggtagacacaagtctaattttaagatttcctttaagtttccaacagcacttatatttcattgacagaacttagtcatataacccataaggcaagggaggttggtctgttacttgggcagaattgtttctgtaactaaaaagagagaatggatgacggagacagaaattgagatatctgccacacaagtaaaaccaaatcactaaacatacaggattattaaatgaaatgtgctgtgaaaaaaaattgtaactggaaaaggggttgctagagacttggggttttggtggctgtgatagtagtcaggggagaattcacttgagatattatttaagaaaaggcttgaatgaagtgagggaatactctatgtgaaagtgtgatggatgatgcagtatgtgcattggccctggttcaagtagagcaagtagagtaagaaagtctgtgtgaacaaggaggaaagtgacagatgaggttggggaggtgtatatgggccaggccatatggagtcttgtagccttgacacagagtttggattagtttcctaatttaatggaaactcactggagagttttgagttgtaaggctatgagaccatgatacatagctgggcaagagacggaattgacttggactagggcgatagtggtagaagtggtgagagtggtcagaatttgcctatcatgtagataaggacagtagggtttattgatgatttggatatgaagtatgaggagaaaagaataaccaagattggctgggcacggtggctcatgcctgtaatcccagcactttgggaggccgaggcaggtagatcatgaggtcaggagttcgagaccagcctggccaatatggtgaaaccctgtctctactaaaaatacaaaaattagctgggtgtggtggtgcgtgcctgtagttccagctactcaggaggctgaggcagaagaatcacttgaacctgggaggcagaggttgcagtgagccgagattgcgccactgcactccagcctgggcgacagagcaagactctgtctcagaaaaaaaaaaaaaaaaaaaagaagaataaacaagattgactcctaagttttagatcaacctaaccctaacacccggctcataggtgggccgcatgcagcccaggatggctttgaatgcggcctaacacaaattcttaaactttcttaaaacattatgagatttattttgcaattttttttagctcattaactattgttagtgttagtgtattttatatatggcctaagataataattcttcttccactgtggcccagggaagccaaaagattggacaccactgttttagatctttgaataaatgaatagatggcagtatcaatttctgggagggagaggggcagatttgtgagagggtaaggaaccaataatttttttttgaacaagttaaatttaagatatctattagattttcaagtggaattattgaatatgcagttggagatgtaagtctggacctaagagtagaggaaatggctctagatagaaatgtgcgagtctcagtgtagagttggtacttaaaatcatgggcctgatatgaggtcacctagggcagtggttctcaacccagagtgcacagattcactcgaggcacttttaaaacatactgatgcttggctctaacctaaggccaattaatcagaatctctaattcatccctattttttaaaagctcctcaaaagagatacctgtcagccaaggttaataacaactaacctaggtaataaggactgaaactacccattgtcctttggatttggcaatatagaggaccttgaataatgattttagcataatggtggttaggaaaatcttactaggaagcattatagagtgaatgggagataggaaacagacatagtaattacaggcaactctttcaaggagttttgataaaagcggagctgaaaatggggcagcagggagggaagtttccttttagagcaagtttaactagatatttagcatttcaacagttgcatcccaaaatataggtgatagaaatagtaaaagtgaatatggattatctgtgtaataactttttaaaataaagttttaccccattcctttaaagagaatcagttgatgtagttatacaactagggatcaagtaattgttttttcattttaaaatttaatgtagtatcttatttcactaccactacaaagcaatgcatctaaattctcttttatttctttaaggctgataaagaatttgtatggtctttgtggaaacgtctccaggttacaaacccagatctcacacaagtggtcagtttggttgtggaaaggtgagctctcaaattattttttcatgagtatttggtgtgttgagtttgtttctcttcattattaaagttagtacttatcattaatctcctaaagagattcatttaatttctgaataaatgtggagctaaaaattaaattgttggatttattatgaagggtgccagttcaccaagtacaggtatgccctgttcctgttcatattctgacatatttggagagtgtgtagctaagagataaaactatgtcttaaatactgtgtgtgtgtgtgtcttgagctgttacagttcaaccttaaaagttggcgaagtccctgttgtttgactttttactccatggactgcctctatagggaacttactagacgtgactcagttttccccttagataattgcagtgtgtaattgaaagccggggatgaccttgccagtgtagagtaagtgttctggaataggttaaaggattttacttagcactccatattatcctgtaggaactgcccagtcatttaactgtagattgttgggcctctccttggttattagaaacagtggaatgatgctgggttctctctatcaaacatttggtatacagtattcccatgacacttagcacagcaatgaaaacacttgctttcttagtaaatggatttcattatactttttaaatgagaagctaagcatatggataccttttccttttttaaaaattggaatcatgatcctaaaatctgaatatcattttttattacttgaattatattcacccttgtagtctctagtcctgggatcattccagcgttgtctgagatttgacttgttaaaaatctgtgatacatgcctgagtatgtctaattttaccatctttggttattatgaacacttaaaatagtataatcagtttcttctcatgttgcttgtacgtctaattcatcaatcatttttttccttctgatgatcagaattaagtcttttgttgaagtacccttgttacttcctcaatcatttttgagatgaaatgtgatcactctcagactccctctgtttttttagtagaataagccttctagagaagccttgggacttcaattgtcatttccgtgattctttattctcctctccttttatttgttattttttaaaactttctaaacctatccataatttttacttttctcttggttaaacagaagcagatattaaattattgttaggtcattttcctcattctttacaatgtctgtttttcatatttataatatacagagtatatattcatataacataaaatttataaataaatgtacgtatgtatattagacgtaggtgttcaaaagtcttttgttgataaggtgtaatgagaaattttggagattactgctttataactatgactgtcaaaatttagtgtgcacaagttatacttggagaatttatttatttattttattttattttttttattttatttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccggcctggagaatttattaaaatgaagatctctgggccttttacctgatctactgaatctctagggggtgggacctagatttaaaataaagtttaaaataacatttccaggtaattctgatgtctgtagattacactgtgagatactttggattttgagtctatttttgaaattggaaacgataagtggcatttataattttatgactatgtaaatacttcctagagaaccatgtagtatgttcacatccattgagaagtgaaaatgatatgctgaatattcaacctatgtctgttaaaaagaatattctaaatatcaaggtcaaatagatgatctttctgtatagtccattagttatccaaattatgatccatttaggtctgtttaatttttaaaccgtggacttcctggacagcatttcccccctggaatttctcattgcccttctctttactttttcttataaagaatgtctacgtcctttgtcagacatttgtataacaggctgagaacatttttccttttcctctttggcttatggtatggatttggacgaattaatttctaaacctactcacgtttgtcatcataggttttcttttcgttgtacagctgaacttattacacagtttctaggatgccagattatccgtttcttttttgtcggattattttcaagtattttttttctcagaaaggatggacaggtggtacgttttctgactccttaaatgaccgaaaatgtctttcttttgcccttaagcttagttggcacttcagctgaacataatattttatgtccatgtatttttgccttggatttttgaaagcatagttctgttatctaaattgagcatacagtaatgctaccaaggagcccatcagtgtgattcttgtttcttcctagataacttgcttgaagcttgtaggattttctctttaggtgcactattgtaaaatctcaacatcatctgtttatttgggtcctttgaaaatttatccttcttagcctttggtgggcctttccatttcaaaacctaagattttcttttcattgataaaatgttctcatattttttcttcattgtattctttgttttagcactctgttagaggttggatcttatggatttgaccttcttctctcttttctctcttatctcatgttttccatctttttatcttttgttgtatctcctcagtggcctttgtactttttgttccatcaataagtggaattcttctgtttgctctatgctatgatctgaatgttggtgtccccccaaaattcgtatgttgaaccctaatacccaatgtgataatattgatgaggccttttggaagtgattacatcatgagggctcggccctcataaatgggattagtgcccttataaaggggtttaaggagcctcccttctcttctgccatgtgaggatacagaaggtgtcatttacatggaacagacccttaccagacactgaatctgctggtgccttgatcttggacttttcagcctccagagctgtgagcaatacatttctgttgtttataaattacccaatctaaggtattttgttatagcagcccaaatggatgaagattctctttgattatttgaattttaaaattttagaaatcaaattattacttctaaaaattacttattttttaattttttcctttttcaaagtagctttctttaatagaataattttttaatctttctgattataatttttgaattcttttctgtttcttgcattatctttgttttctgttgggtaacttctgtttgttcttcctagtctttctctgttttaaattaaaaaaaatttccttgtctttctctttgatgctgttgattttcttcaagtgtataatgaaccttcactgccttgctttatataggtatgttgctcatatgggtttgctttgtgttttttgtatatctgtttaccagaaggtttctcctttgaatgtaaggtttgcctatgggctttttgtaaggcttggggaagggcctatccacaggctttcctgaaaggtgtgtagtagatagacttcattgtagtgaatgagagttaggtcctttaagtcaggcccttttctaattctgttgcttgcccaacactctgagtagggatcttttctggacaaatgattttgaatgcagtttttggccatttgatgtaggcaaatgctgcaggtagctgttctgaacatggatgagtgggaggctcagctttttttggtgaatggtttcttaattaattgttttgattcctgtgggcttctgctctctatacttactaattgggtacttataagcctttctggggcctcttctatgaaaagcagcatcctcttctgtagacttctatttaggttttggattatagtttttctccctcggtttatttgtctctatgagtctatgcttctgtttttaagatatttgtcaaatttatagttcatttatggctgctgctgttgtttcccatgctgataaggatttatttaatgtggtgtgacttgggattgtcagtgttgtgttgttagctcatcccctcagaaagaagtataatatcatttttagggttatagtatattctattatttagatatagcatatttgtatttaaccactgtaattttgttgtacattagggctatttttaaaaatagtataataatgccgtgatgaatggctttttggataaagtttgccctgtattattggtttcaaccggttgtgctaccgacctagtgaatagaggctgagattgctaaacatcttgaaatgaaaagaataatcctgcccaattaaagaattatactactatacttcatatgccagtagtacccatttggactgtctgtgtagatgtgttgtgtgtatatgctttactttttattatggagaaattttaattagatgcaaagacagagagaatacattattgaacactcgtgtacccatcactcaccttgaacagttatcaacacacggacaatcttgtttcatctataaacctctattctctctctccttctaccactaatggattttgaagcaaatcctagatatcatgctattttacctacagttactttagtgtttacagacaattctagttattaacagtaatgttctgtaaagtcactacaaatacttaattagctaacactgaactattactcctagaggaagtaaggggttaggttcctgtaagcctctggtcacaacaattttgtcaactgatcaatacatagcctcattttatgtgtgtttctgtttaaagatacttcatttattgttgattcattgacgtcgaactcttggccaaaagcactgttaactcatgcctgaacaaagcttatctaacccattgttttctccctatggcatgtcacaaccttcttaggaacactagccagcacttcagcactgtgcttgatgatcatttgaaggactgaagtcatcaaaaacaagcaccaaaatgtgacaaatgtggtactaaataaaccgtgaaaaggaaacttgtgtttatagtataagagctgaagcagagtgtcactttatttgacatcagttggaaacatgtgggttgtgtgactcaaattttttgccactttgtgtgtacctgcaaatgactacaatagtgccacaataatttttttatttttatttttatgattatactttaagttctgggttacatgggcagaacgtgcagtttgttatgtaggtatacatgtgccctagtggtttgctgcacccatcaacctgtcacctacattacgtatttctcctaatgttatccctcctgtagcccccacctccgacaggacccagtgtgtgatgctcccctccctgtgtccatgtgttctcattgttcaactcccactaatgagtgagaacatgcagtgtttggttttctgatcttgtgatagtttgctgggaatgatggtttccagcttcatccatgtccctgcaaaggacataaactcatccttttttatgtctgcatagtattccatggtgtatatgtgccacattttctttatccagtctatcattgatggacatttgggttggttccaactctttgctattgtgaatactgccacagtgaacatatgtgtgcatgagtctttattgtagaatgatttataatcctttgggtacatgcctagtaatgggattgctgggccaaatggtatttctagttctagatccttgaggaatcgccacactatcttccacaatggttgaactaatttacacccccaccaacagtgtaaaagtgtttctatttctccagattctctccagcatctgttgtttcctgactttttttattttctttctttcttttttttttttttttttttttagagactgggtctcgctctgtcgcccaggctggagtgcagtggctcgatctcagctcactgcaagctctgcctcccgggttcatgccattctcctgcctcagccccccaagtagctgggactataggcgcccgccaccatgcctggctaattttttgtatttttagtagagacggggtttcaccatgttagccaggatggtctcgatctcctgatcttgtgatctgcccgccttggcctcccaaagcgctgggattacaggcatgagccactgcacctggcctgtttcctgactttttaatgatcacaattctaactggcgtgagatggtatctcgttgtggttttgatttgcatttctctaatgaccagtgatgatgagcattttttcatatgtctgttggctgcataaatgttttcttgtgagaagtgtctgttcatatcctttgccaattttttgatggaactttttttttctggtagatttgtttaagttctttgtagattctggatattagccctctgtcagatggatagattgcaaaaattttctcccattctataggttgcctgttcactctgatgatagtttcttttgctgtgcagaagctctttagtttaattagatcccatttgtctcttttggcttttgttgccattgcttttggtgttttggacatgaagtctttgcccatgcatatgtcctgaatggtattgcccaggttttcttctaagatttttatggtcctaggtcttacgtttaagtctttgatccatcttgagtttatttttgtaaaaggtgtaagtgaggggtccagtttcagttgtctgcatatggctagccagttttcccaacaccatttattaaatagggaatcttttccccattgcttgtgtgtgtcaggtttgtcaaagatcagatggttgtagctgtgtggtgttatttctgaggcctccattctgttccattggtctatatatctgttttggtaccagtacatgctgttttggttactgtagccttgaagtgtagtttgaagtcaggtagcatgatgcctccagctttgtccttcttgcccaggagtgtcttggctatgcgggctcttttttggttccatatgaactttaaagtagttttttccaattctgtgaagaaagtcagtggtagcttgatggggacagcattgaatctataaattactttgggcagtatggccattttcacgatattgattcttcctatccgtgagcatggaatttttttccatttgtttgtgtcctctcttacttccttgagcagtggtttgtagttctccttgaacaggtccttcacatcctttgtaagttgtattcctaggtattttattctcttagtagcagttgtgaatgggagttcactcatggtttggctgtttgtctgttattggtgtataggaatgcttgtgattttcgcacattgattttgtatcctgagactttgctgaagttgcttatcagcttaaggaggatttgggctgagaccatggggttttctaaatgtacaatcatgtcatctgcaaacagagacaaattgacttcctctcttcctatttggataccctttattgctttctcttgcctgattgccctggccagaacttccaatattatgttgaataggagtggtgagagagggcatccttgtcttatgctggttttcgaagggaatgctttgagtttttgccctatcagtatggtattggctatggatttctcataaatagctcttattattttgaaatatgtcccattgatacctagtttattgagagtttttggcatgaataggtgttgaattttattgaaggccttttctgcatctattgagataatcgtgtggtttttgtcattggttctgtttatgtgatggttctgtttatgtgattacatttattgatttgcatatgttgaaccagccttgcatcccagggatgaagccaacttcatcatggtggataagctttttgatgtgctgctggatttggtttgccactattttattgaggattttcgcattgatgttcatcagggatattggcctgaaattttctttttttgttgtgtctctgccaggttttggtatcaggatgatgctggcctcataaaatgagttagggaggagtccctctttttctgttgtttggaatagtttcagaaggaatggtaccagctcctctttgtacctctggtagaattcggctgtgaatccatctagtccttgactttttttggttggtaggctgttaattactgtctcaatttcagaacttgttattggtctattccaggattcgatttcttcctgtcttggaattgggagggtgtatgtgtccaggaatttatccattttttctagattttctagtttatttgcgtagaggtgtttatagtattctctgatggtagtctgtatttctttgggatcagtggtgatatcccctatatcattttttatggcatctatttgattcttcttgcttttctcctttattagtctggctagcagtctatctgttttgttgatgttttcaaaaaaccagctcctgcattcactgagtttttgaagggttttttgtgtctctatttccttcagttttgctctgatcttagttatttcttgtcttctgctagcttttgaatttgtttgctgttgcttctctagtccttttaattgtgatgttagggtgtcaattttagatctttcctgctttgtcttgtgggcatttagtactataaattccccctaaacactgctttagctgtgtcccagagattcgggtatgttgtctctttgttctcattggtgtcaaagaatatctttatttctgccttcatttcgttatttacccagtagtcattcaggagcaggttgttcggtttccatgtatttgtgcagtgttgagtgagtttcttaatcctgagttctaatttggttgcactgtggtctgagagactgtttattttgatttctgttcttttgcatttgctgagtagtgttttacttgcaattatatggtcaattttagaataaatgtgatgtggtgctgagaagaatgtatattctgttgatttggggtagagagttctgtagatgtctattaggtccccctggtccagagctgagttcaactcctgaatatccttgttaattttctgtttcattgatctgtctgatattgacagtggggtgtcaaactcacccactattattgtgtgggagtctaattctctttgtaggtgtctaagaacttgttttatgaatctgggtgttcccatattgggtgcatatatatttaggatagttcactcttgctgcattgatccctttaccatcatgtaatacccttctttgtctcttttgatctttgttggtttaagatctgttttatcagagattaggattgcaactcctgcttttttttgctttccatttgcttggtaaatattcttccatccctgtattttgagcctatgtgtgtctttgcacatgagatggttctcctgaatacagcacactgatgggtcttgactctttatccaatttggcagtctgtgtcttttaattggggcacttagcccgtttacatttaaggttaatatttttatatgtgaatttgatcctgtcatgatgttagctggttgttttgcccattagttaatgcagtttcttcatagtgtcaatgttctttacaatttggtatgtttttgcagtggccgataccagttgttcctttccatgtgtagtgcttctttcagaagctcttgtaaggcaggtctggtggtgacaaaaatccctcagcatttgcttgtctgtaaaggactttatttctcattcgcttatgaagcttattttggatggatatgaaattctggtttgaaaattgttttctttaagaacattgaatattggccttaactctcttctggcttgtagggtttctccagagagagatctgctgttagtctgatgggcttccctttgcgggtaacccaatctttcttactgcccttaacattttttctttcatttcaaccttggtgaatctgatgattatgtgtcttggggttgctcttctcaaggagtatctttgtggcattctctctatttcctgaatttgaatgttgtcctgtcttgctaggttggagaagttctcctggataatatcctgaagagtgttttccaactcggttccattctctccgtcactttcaggtacaccaatcaaatgtagacttggtcttttcacatagtcccatatttcttggaggctttgtttttcctttttattcttttttctctaatcttgtcttctctgtttatttcattaagtggatcttcaatcaatgatatcttttcttccgcttgatcgattcggctattgatacttgtgtagtcttcgcaaagttctcatgctgtgtttttcagctctgtcaggtcttttatgttcttctctacattggttattctagttagccatttgactgactctttttcaaggttcttagcttccttgcattagtttagaacatggtcctttagctcagagttgtttgttattacccaccttctgaagcctacttctgtcagttcgtcaaactcattctctgtccagctttgttcccttgctggcgaggagttgtcatcctttggaagaggagaggtattgtggtttttagaattttcagcctttttgcactgttttttccccatctttgtggatttatctttctttgatctttgatgttggtaacctttggatggggtctttgagtggatgtgctaatcctttctgtttgtttcttttccttctgacagtcaggcccctcttctgcaggtgtgttggagtttgctggaggtccactcctgaccctgtttgcttgggtatcagcagtagaggctgcagagcagcaaagattgctgcctgttctttcctctggaagcttcgacccagtggggcacctgccagatgccagccagaactctcctgtatgaggtgtctgttggccccaactgggagatattgacaggtgaagccagctgggcttctgggttgggtggggacttggagaacttctctgtctagctaaaggattgtaaacacaccaatcagtgctctgtgtctagctaaaggtttgtaaatgcaccaatcagcactctgtaaaaacggaccagtcagcactctgtaaaatggaccaatcagcgctctgtaaaatggactaattatcaggacgtgggcggggccaaataagggaataaaagctggccatctgagccagcaggggcaacctgctcaggtccctttccatactgtggaagctgtgttcttttgctcttcacaataaatcttgctgctgctcactctttgggtccgcactacctttgtgagctgtaacactcactgcgaaggtctacggcttcactcctgaagtcagcaagaccacgaaccactgggaggaacagacgactctggatgcgccacctttaagagctgtaatactcactgcaaaggtctgcggcttcactcctgaagtcagcaagaccacgaacccactggaaggaagaaactctggacacatctgaacatctgaaggaacaaactctggacacaccatctttaagaactgtaacactcaccgcgagggtccgcagcttcattcgtgaagtcagcgagaccaagaacccactagaaggaaccaattccggacacagtatctcctagtcagtatacatgggagtcagggacccatttgaggaggcagactgacccttagcagacctggaatgctgtgctgggaggtccgctgctctctttagagctgtcagacagggatgtttaagtctgctataagcccctgactggggctgctgccttttttatagagatgccctttccagagaggagcaatctggcagtctggccacagcagttttgctgagctgcagtgggctctgcccagttcgaacttcccagcagctttgtttacactgtggccgtgaaactgcctactcaagcctcagcaatggcggacgcccttcccccaccaaccttgactgtcccaggtggatctcagattgctgctgtgctggcagccagaatttaaagccagtagatcttggtttcttgggctcagtgggggtgggacctgctgagccagaccacttggcttcatggcttctctctggcttgtgttctgggcgccagtagggtatggaaaaaaaaaaagctcctgcagctagttcggtgtctgcccaattggctgcccagttttgtgcttgaaacccagggccctggtggggtaggcactggagggaatctcctggtttgcgggatgtaaagaccgtgggacaagcacagtatctgtgctggagttcctcagactcagtccttcatggcttcccttaggtaggggagaaaattcccccaccccttgtgcttccaggtgaggcggtgccccaccctgcttcggctagccctctgtgggctgcacccactgttcagcgagtcccaatgagatgaaccgggtacttcagttggaaatgcagaaatcactcaccttctctgttgatcttgctgagctgcagaccagtgctgttccctttcggccatcttgaatctcagtagtgccacaattattgagtttcgtgttaacaaataaattgtattgagtaggccagtttacaaattctgaatccatgaataaggactatctctaaaagataaggggtgttttaacagaaccatcgtatcatcatcatgctttgaattctataattattctctattataattaaatatctagtccgttttcacatttctcggattgtctaataccttttttaaaaaaggttggtttgttcctaggaggatcaaacatggatagtctacctgctgaatatataggttcatttttttcctcttccatctttctcttactctttttttccttgcaatttatttttggaataaattgggttatttattctgtagagtttccccaaatctgacttattgtagtactctgtaccctatagttgccataaataggatcttattcagattcatttttgatattttggcaaaaataatctttttagatgttactatttacaaggcttactgtggagattttacaggttcagttccagaccactgcaataaagcaaatattgcaataaagcaaatattacaataaagcaagtcacacaaattttttagtttcccattgcatataaaagttatattcagaatgatttataattgaaataataaaatagaattgaaagcactctatattagctagcctatggacttaatcctttgggaagcaatgtaattgtgtaaagtagcaattaatgttgctaggtacaaagttgtatttaaatttgtaattatgtagaattgatatcacactatgtagaaagatactggaggctgaagtggacgccacaacaaataatgttagtgataacactgtctactgtctcctcgatagaaaataaagaacggaaggagaatgcagcaaaacacattggggtcttggttgagtgttagtgttgttcattgagcaacttcagccagcatgttttgagaagactctttttctgataccatttggcctgaatccccattcttcagtcatagtgtcatgacttaccatgtttcaaaaccatagcataatatatttgctgataacaatcaatacgtaccaaatattagtaatgatttatctttttccattagagaggtttcaggattatcctttgctaataccattactttttactaaaatttcttgtgctttcctgagtgagaagatgtctgaagaatgagaaggttgaagcaaggtgaaggtagagaaagggggtggggtaagaggaagaaagaagagaaaagagcatttcctcaatgtgaaagttaattttaattatcaatttgactgggccatcagatgcccagatatttggattaacgttagttttggatgtgtttgtgacagtgcttctggaagagattagcgtttgaattgatgaactgagtaaagcagactgccctctccaatgttggtggccatcatccggtcatttgaggcctgaatagaacatgaaggctgaggaaagttgaatttgctctctgctatgataatatgtctttgccaagcatgccagacatgtatgtcatattttttacttagtacttatttgtgaataagtataagaaaatgatcgcttatcagtagtgcataaatttagattcaggaaggatagtgatgcaaagcaaccacaggttgtccacatgggtagctgagatagtgacacctttgctttctgagggatcagtgttcacaaacattgttttaagcacaaaatcattaaaaaatattaattaaaactaccttcaggctatgtatgtaagatatatgttaaacagaaatcaattttgtgtttaggcttggttcccattgccaagatagctcatttatgtatatgaaaatattctgaaatccaaaatttgaaacacttctgatcccaaccatgtcagataagggatacccaacctgtatcttttctgtctattgagatgatcatgtgatttttgttttgtattctattgatgtgatgtagtacataaattgattttcatatgttaactcaaccttgcatctgtaggataaattcttggtcatggtatataatttttttatatgttcccgaatttggcttgctggtatgttgctgaggacttttacatacctatttataagaggtactatagttttcttttcttgtaatgtctttgctttttatatgaggataatagccttgtaaaatgatttgggaagtgtttccttaaattttatgaagaatttttgaagaattggtattaattcttttttaaatatttggtagaattcagtagtaaatccattcaggtctaggcttttctttgtgggtaattttatagttatgagttcattttctttgcttgttataggttgattcagattttctattttttcttgagtcagttttggtagtttgtgtctaagaattttcacatttcttctaggttatctaatttgctgggtatagttgttcatagtattccttacatttttatagttttttaaagattggtaatatcccccccttttatttctgattctcgtaattttaggcttctctttatcatgatcagtctagctaaaggtttgtcaattttgttgatctttttgaagaaccagcttttggctgtattgttctttctcttctgtttttcttttctctattgtattaatttctccactaatttttattatttccttcattctgcttgctttaggtttagtttgcttttatttttattgacttgagacttttccacttccttgatataggcatttatagttatatccttccatcttagcactgctttagctgcatttcgtaagttgttatattttgtttttattttcgctaatctcagagtgatgtcctctttgacctgttgcttatttagaagtgtgttgtttaatttccacttatttgtgagcttctcagttttccaattttgattctgatttccaattttgttccattgcattaaaattttttgacatttgttttatggccaagcatatggtctatcctgactagaacttctaagcttgaacttctctacactgtgttgcaaataaagtcagtttctttggaaagagattaggccttgttttacatactgcttttcctttcaagcaaagtctctgagtcaggcctctggagctgaggatgtgaacaatattatgcttctctttgagtgaccccccaactctaggagctgattgcttagtggaagggaggcagcagcctaaggttctcttggcttgcctctcctggcatgacacccgtgcatcacaagctggggtctcaatatgctgcacccaaagtagagcctatattccataatttggagctggacagaagaaaggagtacccactgctcaattgcacttgcgttggacttagcctcagcagcagttagctggggacaggatgagaattgctgatatcctgttcttcccgggaagaaaaccctccaactgggaacaggaggaagagggagccctgtgttcttggctgcagctgtctggaatggagactacaccgtgttgagctggaaaggtggaaggaggcagtggttttggtttagataccacaaacattgcctttcatactgattgatagattttcttggatagatgtttcttcatttgctgtttgatcttaggaccatttttagaggctttaggtgattgttaataattttcaccagtttcactggagagtgggtcaggagagctcttcaatcatcatctctcaatgtttgttgttttaaaactgctcaattttggggtaatttgttatacttcaatagataaatactggatcaaaagatacaatggcaattgtgatagagattgtgaattcactgactttagaagttgtaccaacttacacttccaccagaaaatataagaaggtgcttattttttctacattcctggccatcatattgtttttaaactttttaatttttttatctgaaatgtaaaaaatgatatcctgaagtagttttcacttgcatttctcttattatttgtaagtgaactctaagggccattttatatcgttttctatgggatttttcttttatatatctttgtatatccattgtcgtgccatgtctaattcatgtcctatggtgcccttcaaactcactatattatgtaaagaacttattggcttcttcttttagttattttactacctaactttctcactatcacaggcatgacattttcttccctttctttaaatttcacatcttgagggtaatctttgataccttttggactctttgaacagaaaatcaatgcccaagttcagtcacttcctcttttgcagtgtcactcaaatttagtaattcctctgtgtccttaactttcaaatcctctatcttggttctcagtagctcagctctgaacatcttattgatttcttttccaaatatcagttctgttttacatctttactttgagacaaaggaagatataagccaccaaagaaaataatttgtaaaattcaagttaaaggtagccaatgaaaattctaggactttcttaatgaatatctggaggaaaaatgtaacctttaagcttggatgcctagaggatacctcatgttgcaaagtaacctgactgtgagatttagacatgcatggccatcattaaaacagatatttccaccacatttacccattcatcaggtatcaattgaatgtcatttgattgtcagaccctctgaaaaagttagagaaagagatagctctgcatttagctattaaagaatactctctaataggaaagacatttgtagaaagagacaatttataataagaatttgataaatactataatgatattcatattaatgtaattatttgatctctggaaaaagttaaaaaagttctcactctcactaattctaagtaattagaagtttatgttgttgaaagtcaaattttgatttccttagtagaataatatcatactagaaaatatttttatagtatgattttattcttataaatttgtagaaaatattattttctatgatatgtagatatttaagtttacctgtcactttatgagtttgttataaattactactggaaaaaggacattttgaatatatcatttgtttattagctctacaaatctaatttccttgctattatatataaactctcactttagattattggtatcataagagtacaaccactgtattttgtctttaaatgcataaggaaacataatctcaggaagcaggagtaataaacattgaagaaacagtaacatggagtttcatagaaatataaatacattaggagccataagagcttgaattgttcaacttttctttgaataactacaaatgtgtgccaaactccagtatctttgccttagacacaaatttcatcctggctttaaaaattagtattagtaatacgttattttttccataaagaactttgagtttggagtaaagcaagaacaactgctattatttgcctgctaaaattatattgtgaataattttgtagacttatccaacaatgtgctgtcctgcattttgtgtaactctaggtactgcagcttgtaatccacctactgttacaaataatctcaggaagtgaattactgtgtttctttgctgctgcagatccatccagagttgagctattaatctgtttcctccagtcctttttttttcattacatttgcttctatggttaatcttttttgtgttactttctgttttttcttttccatcaatagttatttgacatctatttgtcttagggcagtgatctcagtatggtctgtctgaagacctgtgctagtaaggagaatgtgccagaatgtatagcaacctcgtgccctcttcactgagaaagctttgatacttgtctttctttatttcttttttcttttttttttgagacagagtctcgctctgtcactgaggctggagtgcagtggcgcgatctcagctcactgcaagctccacctgccgtgttcacgccattctcctgcctcagcctcctgagtaactgggactacagacacccaccaccgtgcccagctaattttttgtatttttagtagagacagggtctcactgtgttaggcagggtggtctccatctcctgacctcatgatctgcccgcctcggcctcccaaagtgctgggattacaggcgtgagccaccgcacccagcctcgtcttgctttcttttatggccaactagtaacaaccaattcacagtcctgcattttgaatagcattgccttaagttcctatactttgttacacactaccttcactagagatacactaagctttgttggtagaagagaatacagtatgaagagaactggaatagtggtcttcagggaatcaccaaatgctcttgaggacctcattaaacatataggtggtataattaattatttttccatctggatgtttccttgagttgttgcatttgctttacttttattgcacctgaggatggagggagggaagtggtttggtgggcaggagagtgcacagactatggggcgtagaacagttaccataaagtcagtcaatagaaacatttctaactgggcagggtgaagctctttttcattttggtttcaatggatggagtgacttctcacattaattactgatttggaattagattggaggatgttaactgtatttttaggcagacttctggttttgatgaggtattagtctgttctcacactgctaataaagatgtacctgagactgggtaatttataaaggaaaagaggtgtaattgattcacaattccacatggcttgggagacctcacagtcatggcagaaggtgaacgaggagcaaagtcacatcttacattgtggtagacaaaagagcatgtacagtggaactcgcttttataaaaccatcaggtcttgtgagacttgttcactatcataagaatggggttgaggggctaagattcctccctgtgattgagttaccccccagctgggtccctcccaccacatgtggggattatgggagctgcaattcaagatgagatttgggtggggacacagccaaaccatattagatgatatatgaatctactaatgcattgttttattgttatgataattatgctcttccccccatttttagaaatttttctagaaataagagtataacaaagtacaagttgatactgtgtttttgtgattcattagatatcattggcaaatcatgcatagatagattctgcttattcagtaatctcttgaatattgatttaacagcatttatatttcattgtaattatttctgtgtgtcagtttgttgccttttccattgaacagtgggaggaccatattgtgcatattttccacagtgcttattacagtcgctggcacaaaggcactgaataaatgaatgaataactgaacaagcaaatgcatgatattataatacaaggtagtggaaactagtatcttgaagataagaataaataagtgtatttgcatattgaaaaacattgatctggctgggcacagtgactcatgcctgtaatcccagcactttgggcggctgaggcatgtggattgcttgagctcaggagttcaagaccagcctggccaacacagtgaaaccctgtctctacaaaaattagttgggtgtggtggtgcacatctatagtttcagctacttgggaggctgaggtgggaggatagcttgagcccaggaagtgtaggttgcagtgagctgaattcatgccactgcactccagcctgggcaacagagcaagactctgcctgaaaaaaaaaatggccagaagcagtggctcacccctgtaatcccagaactttggaaggctgaggccggcggatcacttgaggccaggagttcaagaccagcctgtccaacatggcgaaaacccatctctactaaaaatacaaaaattaaactggcatggtgtcgcgtgcctgtaatcctagctcctcaggaggctgaggcaggagaatcacttgaacccgaaaggcagaggttgcagtgagccaagattgcctgactgcactccagcctgggcagcagagtgagactctgtctcaaaaaaaaaaaaaaaaaaagttgatctattgaaatgatctttcattctttcaaaaaaaaaaaaaaaccatttgttagctttaatcgaatatgtataagaccaagtccggatttaacatcaaatctatagaactccttatttttatgtttttttttttttttttttttttttgaggtggagtctagctttgttgcccaggctggagtggagtgacgctacctcggctcactgtgacctctgcctccctggttcggcctcccgagtagctgggattacaggcgtgctccacaacagccagctaatttttgtattttttgtagagacagggtttcactatgttggccaggctcgtctcgaattcctgacctcaggtgatctgcctgccttagcctcccaaagtgctgggattactggtgtgagccactgtgcccagccaagaactccttatttttatgtaagactttaacctctctactagaataaaagtccagattcttagaacatttttctttttttttctttctttctttttttttttttttgagacagagtctcactctgtcgcccaggctcaagtgcagtggtgcaatcttggctcactgcgacctctgccacccgagttcaagtgattctcctgcctcagcctcccaagtagctggtattacaggtgcctgccatgatgcccggctaatttttttttgtatttttagtagagatggggtttcaccatgttggccaggctggtcttgaactcctgacctcgtgatccatcctccttggcctcccaaagtgctgggattacaggcgtgacccattgcgcccggcctcttagaacattttcctaagtgacttttcttaaaataattaatttcaacctttgatcccatgtattgagagaataccacattttttttcatgtgaagtgaaaatttgaaactatgacagtaggaatttaggttaaatgtgatgggttaagcataagtatttatctttacctcctccccaaatcccactaaaatgactagtagagttttaaaagtgtagaagcacctaaagagaagtagagaaaaggtgacagtggatgacagatgttagtaaattctagaatgatgtaaggtgaattgataagtggtaactgacttagcagaatggggaaagttgaaatacatagaatgtagaaatttctagtaataggttacatcagtaatctgtgatggttggagtgaaggatgaggctacaaaatgggaaaattgaattaaagtctatataaggagcatgtagactctctggtcctcctctcattaaggcaggaggcaggaagtttatttccttgaaaaattgaaataagtatcttctggacttagggacctcaggcatatcaaggtacaggattagctattatgaaaactgggggaataagtgaatgcctattctactgaacagtgggacactaactgaattattcagcctcagagttgctggaagcagagtcctgatctatccagtcataagacaaaataattcttctctggagaaactaagcatccctagagaaacaacagagacacactgacaggtcctaacaaaatgacacttcccccacactgttaactatagagacctttgggcaagccctccacccccatcctaggtcaagtaaaactatccaacatcatttttagttcctcattcttaaatatgaatgtgaaacaaatgatcataagacatttgagtaaaacttttaatatgaaggataagaaaccagaagtaacagaaaaatggagttcagagaagacagagatatgctgaataaaacaaaggaaaaaactcctatgattaatattgtaagacatgtaagggaaaatttggtggatgtgaaacatgaacaggtgacaaaaaaagagaaagagtacttggaaattaaataaatataacaataaatgattgtcaaaataaaaaattaactagaggggctagaagacgaggttgaataaatattccaaagattataacagagacaaaggagtagtaaataggagcaaaaggaaaagaataagaatcaatataggtgctataacagtcattaataggaatttcagtagcagagaacagagaaaaatggacattttaaaggaagtaattcaagaaaattttcaaattcaggctcaggagtttaggattgaaagcatccattgattgtccagcacaaagaactattgcaaggcacattattatgcaattttagaatgttggagatagtgagatcatgaaacctcttagaggggaaaaaatacagccacatacatagagttaataattagaataacagtgattgtctcaattgctagaagctggaagacatggagcaatgcttttgtaattctgggagataaattgttttcaacctaaaattctataaccagccagatattaatcaagtttaaagtaataataaagacgttttctgtaacacatggtctcacatctcccattacatattcttaggaggccaccggaagatgtgtaccaccaaaacgaagaatataccaaaaaagataaaaagttgggattgagaaaatgtgagatccaacacatgaataatataaagatattccaaggtgaagatgaaagaagattgagaagacttggtagcagtagttctcaatgaagcaggactacagcagttctttaagaaggatgactctgaaaaaattagcagtgatagattgtaatgtttttgagaaagatatttcatactttttgagaattttagaaaggattagtgataagtaaacagaaaactgcacaaataaaagtgacataatttttgttttttaaaaaaggtaaaagagctttattaacatttctctccattacattaattaacacaactactaaatcatcacttacttgcaggattccaaatgtgatgccatattgattgtaaggggtatgtgtaagtttcttgagagttcctactctagatgagttcactttaaaaaaattcttttcaatatcctgttctttctcatctctcagttttgcctcttatctttcacatgaggaatgagaaaagctgtctatactgattttcttttgagatccacacacaattcaaggaccaaaaggtcagcataaatttatgcttctcttagcaagcatgtgtttaatgtcagaaggaagggaaggtgcataggctgttaaggcctgatagaacctaaaaggcagaatataccaaaggtatttgtaggggcactagaatgcaagcaagacattttctgctctgatgttaacagttgtcagtaagtgaaaaattctacaatgaggtatagcatgtgtatcttcacggtgagattaatgcagtcagctaaacagtgaggttgttaataacagagtgatgcaatttttaactgttcagaaaaaacaaaaagttatatatgaaaggaagtgtcatcatagtacaccgtgttgcttagctgtgaaccatacataataagtattatgttaaaaaactagactaaaaatcaggatttacacctgccatgtaaacactggtcagacggcacagcccccagaagtgctggggtagtgtaccctgaggaaaactcacagagaggggctccctggcaagtgtgtaggtactccattgtcctcttccttctggggcagtataaagcagtctgacaagattacacatgtcagactctgggaaaattaccccgtcacttctggtatgatgagagactgggagacacattataaaatgtatataatagtttttgctattcaaatatgtttatttcctgagtgtgactagtaaaaagttagataataaggcatgttgagttattggaatcctcttttgattctatgtgttggttagcagatagcaaatattataatagcaagggatactagccctctcaaacacacaaaagaaaatctgtctaaatgtgtttagatccaagcgctatcaatgttgggaggaaatgggtaagaaggaaaaagattatgttcctgtctttcttgatgttagttagcaaagaaagtaaaaaaagaaaaaagttatatccccaaatttaagaaataagtaatatatgacctaatgaatacatttatggatggtacttgggactgcttttttggtggtggtggttgttttttggttatgtcttaataactgtgtttaagttgaaaaaataacatgtaacttggatgatattaagaattaaataaaaatatgtgactgttcatgctgattctgtatgtgatcttcgattaatttgacagttgcatataagttagcatagcagatttttaggctatttattattttgaaactcttaagtttacttgttgaataaatgtcctgtatagcaacatttattaaccacaggtatctatttattttgttatactttatataccatttatgataaagaccttttttttcagttttggtttatttgaaaccatagatggctctattgaataaggattatgaataagagtgggttatagtagagtaggtgatgaattgtgaagttttgtgttggatctagtgaaggtgatagttttaccgaaagaccaggtcagcaacaaattacaggggcaggagttatggaaagtttgttcactgccgtagtctggcatccattttttaccttttatttgaatagatttagagtctttttattttttaagtgaccgcatcttgctttgtcacccaggatagagtatagtggtgtgatcatagctcactgcagcctcgaatctctgggctcaactgattctcctgcctcagcctcccaagtagctaggactacaggtgtgcacccaacatgtttgtctaattttttaaaaattttgtacacatggggtcttgctgttttgccaggctgttcttgaactcctgggttcaagcatcctcttgcctcagccttagaaagtgctggggttacaggtctgagccaccacacttggccttagaatcttgagtaatcctaaacctgatagaacataatgacagccttgtgaatattaggggtctcttttgattgctccagatatccttggtacattcctttgaattgttgaatatggttctcactctagttctatgaattgaaatcaaatattaaactggagattataaaatctttgacaagaccgatgtcaaggagcttttccctattgttttttctagttttgtgatttcaagtcttaggattaagcctttaatccattttgagttgatttttgtgtatggcataagataagggtccaattttattcttccacatgtagctatctagttttctcggtaccatttattgaagagactttcctttgcacattgtgtattcttggcacctttgttgaaagctagttgaccatttgtgtatggatttttttcagattctctattctgttcaattggtctgtttatctgtgtttatgccagtaccgtgctgttttgattactatagctttgtaatctgatttgaaatcaggaagtgtgatgcttcagctttgttcttattgctgaagattgctttagctagtcatgatcttttgcagttccatatgaattttatgactttttttcacttgtatgaaaaatgccattggaattttgatagggtttacattgaatctgtagattgttttgggtaatatgtatattttagcaataaccatccttcgaatccatgagctatttttccagttatttgtgtctttaatttctttcatcaatgttttatagttttcagttatagatctttcatgtagttggttagatgtatttctaagtatttatttttgattctgttgttaatgggattgttttattaatttctttttcagagagtatgttttagtgttatagaaacacaactgattttcatatgctgattttgtattctgaaacttaactaaatttgtttactagtttctaacagttttttgttttggaaggagtctttaattttctttatataagattgtgttgtataaagacagtggcagttttacttcttcctttctaatttggatggcctttctttctttttcttgcttaattgctttgggtaggacttccagtagtatattgaataaaagtggcaagagtgggttctcctgatggtgttccctaagtactgtagtctttctttacttttacattcctttttacattctttctgttcctctaactgggtaatttcaaattatctgtttttcagttcacagattcttctgcttgattaaatctgatgttgacactatttcattttgcatttcattgttatattcctcagcttcggaatttgtttctttttaatgatttttatctgtctgttttcattcttttgttcatgtattgttttctttatatatcatttaatcatccatctgtgttctcttgtagctcggtgggcttccttgaaacaattagactcattttcctcattacaatgttttggtcaatgatggactatatatctgatggtagtcccataagattataataccgtatttttactgtactttttctatgtttagatatgtttacatgcacaaatacttaccattgtgttacagttgcctatagtattcagtacagtaacatgctgtacaggtttgtagcttgagagttatagactgtaccatatagcctaggtgtgtagtagtctatatcatttaggtttatgtgagtacactctgtgacgtttgcacaaggacagaatcacctaatgatgcatttcttggaatgaatccttgttgttaagttacacgtgactgtattttgaatgctttgacaattcaaatatctgcacatctttgggattggttactggaaaattgtcattttgttttttggtggcattttgttttttggtggcatcttgtttttggtttttttgtgtttgttgccttgcattgatatctgtgcatttattggagcagtcacttctagactttacacattgatttcagtggccaaagactttcacctacagatgggtacaagagtgctggctggatgaggtgccatggttccaagctttggtgaggatacagtggtatagtctccatgcagttttgtcagctgaagtcagtatctgctaagattgtaggagtcctcagcagccaaggctgcgtgtgttacaaggtgtctgcagggggagcgagggcttttgggttctttgatggccagggctgctgaggtcttcctgatctctttttctcttgtgcaggaagttgtggttgagggtatccctcttggtgctgggtctagcttagcacagtgcctatggagtggccatggagctgatgtttggagctcaggcatgtgtggagggagggatggtgactccagggtctggggtagcagtggttctagtatccagggcacaggcacccccaccggtttggtaatggtatgtacagtatgggtgctcgtggaatagctagggagccagggtccaaagtgtggttatgtgcaaagttataggtagctccagggtccaggacattgttactctccctgtggtggtggcttcagtgtcctaggtgcaagcacattagagtagccatggagccagggtccatagtgcagttgtgtgcagagtgaacagtggctttaagatctgggcacaggctagcctgctgtgttggtggcttcaatgtttgaggcatggatactcatggatcggccattgagctggggtttggagtgcaggtgaatagtgcagctgtagttctgggatctgttgcatatgtgaggttgcggcgggtggcagcttcttctagggggtggttatggctactgtttatctcagtggtgaaagctgctggtgtcctctgaggagcaggttgctggagtttgtacctatgaacactaaggagacaaaatgcagagagtctgtgactgcttttgggactgttaagctccttagcagtaatggctgcaagagtaatctgcagagtaggctgttggggaccatggtagcacctgctgtgtagctgatactgattttcctacacttcttctttgttcctagttgtccccagacattttaggttttatggaataccccatccatcctttctgtgcagttattcaccaatttttcctccatttttcttgtgtagattcttatttagactcttgagacctctttgggctattttgcttatggataactttctagttatttttaggggaggaagacgaaggctggtatttcttactctgtcatcttgctgtatactgcctttaaataatatatttttcataattgtaaaaagttttaatgcctaacatttttctattttcatttttatttcctggatattattctaaaattgcctaatttaaaaaaagggaaattttacttagaaaaggctgaacttagtaaaatacataataggtcaaatataaacttctaggtttcagtgcactttattgctaagtctacttataagtgtgtacacattccttcataaactatttgatctgactagcctttacatcaaggcctccaacatgattaatatcatatttatttatgctgatgtttcatctttgatatcatatactataagggaatcactcagggaaacctgagggaaaagctttttgaattttggaaaaaataatggttatatcctgttggaagatttctacaaattttttgtggagaaaaggaaagttaatggcttcagcatcagtgaagaccagcatattaatttcaaagaagtcactgtcaaaaagaacgaatagtacatcttttatcatttattggaaagccagaaatgttgagtactacctaaacattatgagtatgaagttatagctataatgctgaataataatatctaatatttgtatattactttaattttaatgtaaaatatctcattggaaatttcatgtcttctaacctgatagatgaatagtaaacaaattagggtatacattttcttaatcaccagtgttatgaagacagatttgtcctttaacataataactttatgaaatacatgtgcgtatgcatatttaattttaaaaatagtttctaccatttgataccctgatgcgtcttattttaaggaaacaatttatgtaaaacttgttttcttgtttctgccatagtcttaaaataggggtattgtagaagcgtggacagatgcttatcactcttgagctcataagggttaatccgtggctgaaattatggtattaaaagttttcaacattcttattcctgatttttttttcttaaattggaattgtaacggtgattcacagtaattaagtcagaaatttgctttcttctcatcaaaacaaagaaacattgttggagaagactagtggaagacttaaagggtgttttcaattgattttagggtcagcgattttttaaggaaatagtaggtagccattttttaaaaattaaacttttcattttgagataattgtagattcacatgcagttacaggaaataatacagagatttggcatatgcttgaaccatttctttccaataataacatcttgcaaaactatagtacagtatgaagacaggatattgacatttatacagtcaatgcagaacaattctgtcaccataaggaccccttttataaccccactcacttcactctttatgctccacaccctagcctgtttgtaaatcctggcagctgcttatttgttctccatttttgtaattttatcatttctaaaatgttgtataaatggaatcagacagcatgtaactttttagtataggcttttcattcagcataattctctggtgattctttcaaatttttgtatatatcagtagttcatttatttttattgctgaagagtgtcccatagtatggatgtaccacagtttagccattcacttgttgaaggacatctgggttgtttccagtttttgactattatgaattagttgctatgaatatttgtgtacatacttttttgttgtaaacctaagtttttatttatctgggataaatggccaggagtgtaattgctgggccatgtgattgttatagccttagtttgttaagaaattgccagctgggtgcagcggcttatgcctgtaatcttagcactttgggaggccgaggtgggtggatcacctgaagtcaggagtttgaaaccagcctggccaatatggtgaaaccccatctctaccaaaaatataaaaattagccggacgtggtggtgggtgcctgtagtcccagctactcgggaggctgagacaggagaattgcttcaacccgggaggcggaggttgcagtgagccgagattgtgccactgcactccagcctgggcaacagcacgagactccgtctcaggaaaaaaaaaaaaaaaagaaagaaattgccaaaccgtttgtcagagtgtctataccattttacattttatccagcaatgtgtgagagtgatttggtttatctgcttcttcaccagtatttggtgtcactatgttttcttttagccattctgctgatgtatagttatacctcattgaagttttaatttgcatttctcatggttaatgatgttgaacatcttttcctgtattcatttgccatctgaatgtcctcttcgatgaggacatgtcttttgcccatttcctatttggatttcaaaaaattactgttgagttttcaaagttcttttcatatcccagatactggtcttttgtcaactatgtggtttgcaaatattgtctcccagtctatagcttgtgtttcatcctcttaacaaggtcttttgtagaacaaaatttaaaattttgatgaagtccaattttaattttttcttcaatgggtatgtttttggcgtcaaattgagattttgtttttgcctagctctagagaccaaagattttctcttattttttttcctaaaagttttatagttttatgttttgtacttaagttcacaatccattttgagttactatttgtttaagaagagatttaaggaggtcaagtttcttttctttttttgcctgtggatgtctaattcttctagcacaatttgttaaaagtatcgtcctcttcccattgaactattttgcatctttgtctaaaatcacttgggtatatttgcatggttgtatttcttggttcttcattctgttctattgatctataggtctgttttctgtcaataccataccatcttgattactatagctatataatgcatcttaaaatctgctagaatgatttctcctgctttttcttccttttcaaaattgttttagatatttcagtcctgtgcttttccatgaagtttagaagactcttgtctctattttttaaaaatcttgttcaggttttgagttgaacctagatatcaatttgggggagaattgttgactcctaatccatggacataagatgtctctccatttatttagatcttctttgattgctttcactaccattttgtagttttcagcatgcaagtcctatatattgttagatttacacctatgtatttaaactttttggtatgatggtaaatgatactgtatttttatgtttagtgtccgtgtttgcattactaatatatagaataaggatttccgtgtgcacttattatttctaagattttatttttttaatgatcccttgatttttctacataatcatgttaattatctattgtaattatctattgtaattgtaagcaagtggagttttatttcttcctttctgatatgtgtgccttttattttattttattttcccttattgtgttggctatattttccagtactatgttgagtaagagtggtgagagtggccatcattgccctgctcctattttagagagaaatcagtctttcactaaatggtccctgcaagttttttgtaaattttttttttatcaagttgaggaaattttctgttcctagattgctgataattttttttttatcatgaatgggcatttgattccatgaaatgcttgtactgcatcacttgatatgaccaggagatttttcttcttcagactgttgatatggtggaatacatggatttatttttgaatactgaaccagctttgcctactggaataaatttcacttggtcgtggagtacaattatacattgctaaatactatttgctaatgttttgttaaggattgattgcatctctaatcatgagggatattggtgtatagctttcttttattgtactatctttggtttttatatcagagataagtagcttcataaaatgaatcaggaagtggtgctttctcttctgttttctggaacaaattgtgtagagttgatgttattcttcttcaaatatttggtggaattctttagtaaattatctgaacctggagggttcttttctgggagtttccaaattgccaattcgctttccttaatagttataggattgttcagttatctatttcatgttggtgaagtgtggtagtttgtgcatcttgaggaactggtttttctaagttgtcaaatttatgtgtatagcgttgttcacagttttttcttgttatggttttatgtctgcagtgtctgttgataatcctgtttcttgatattgataacagatgtgtcttttccctatttttttcccttgtcagtctgctagaagtttttgcaaagtattgcacttccaaaaagttcttagtttcattgattttctctattatttttctgttttctattatgttgatttctgctttttattatttcctttttgttgttatctctgtcaataattttcagtttcttggctgggcgcggtggctcacgcctgtaatcccagcactttgggaggctgaggcaggcagatcacgaggtcaggagaccgagactatcttggctaacatggtgaaaccccgtctctactaaaaatacaaaaaattagcctggcgtggtggcaggcacctgtagtcccagctgctctggaggctgaggtaggagaatggcgtgaacccgggaggcggagcttgcagtgagctgagattgtgccactgcactccagcctgggcgacagaacaagactctgtctcaaaaaaaaaaaaattattttcagtttcttgaagtggaaatgtgtccggaattggtgggttcttcgtctcactgacttcaacaaagaagctgcggacccttgtggtgagtgtcacagttcttaaaggcggtgtgtccgaagtttgttccttctgatggtcggatatgttcggagtttcttccttctggtgggttcgtggtctcactggctcaggagtgaagctgcagacctttgcggtgagtgttacagctcttaaggcagcacatccggagttgttcgttcctcccagtgggtttgtggtctcgatggcttcaggactgaagctgcagaccttcgcggtgagtgttacagctcataaaggcagtgtggacccaaagagtgagcagcagcgagatttattgcaaagagcgaaagaacaaagcttccacagtatggaaggggacctgaatgggttgccactgctggctcaggcagcggtgcttttattctcttatctggccccacccacatcctgctgattggtccattttgacagggtgctgattggtgcatttacaatccctgagctagacacaaaagttctccacatccccactagattagctagatatagagtgttgattggtgcattcacaaaccctgagctacacacagggtgctgattggtgtgtttacaaaccttgagctagatacagagtgctgattggtgtatttacaatatcttagctagacataaaggttctcccagttcccaccagattaactagatacggagtgtcgattggtgcattcacaagcactgagctagacacagggtgctgattggtatgtttacaaaccttgagctagattcagagtgctgattggtatatttacaatcccttagctagacataaaggttctccaattccccaccagactcaggagcccagctggcttcacccagtggatcccgcacccgggccgcaggtggagctgcctgctagtcccgtgccctgtgcccgcactcctcagcccttgggcggtagatgggactgggcgccctggaatagggagtggtgctggttagggaggctcgggctgcccgggatcccacagcagggcgggggcggggggtgcatgggggactcaggcatggcgaattgcaggtctggagccctgccccacagggaggcagctaaggcccggtgagaaatcgagcacagcagctgctggcccaggtgctaagcccctcactgcccggggcctgccggctggccggccgctccaagtgcggggaccaccgagcccacacccacccggaattcacgctggcccacaagggttgcgggcagccccagttcctgccagcgtctctccctccacacctgccttcaagctgagggagtcagctctggccttggccagcccagcaagggctcccacagtgcagcggtgggctgaagggctcctgaagcgtggccagagtgggcgccaaggccgaggaggcgccgagagcgagggagggctgtgagagctgccagcacgctgtcacctctcagaagtgtagattattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagaagaagtgtagattattgatttgagatttttcctgttttgtaacgtacacctttaattttataaattttcctctcagctgctttaacttcatcccccatattttgatatgctgcctttttatttttattcagttctatgtatttttaactttcctgtgagactctctgtatgaccaaggattatgtagaaatgtgttatttaattttcaagtgtttggcgatttttcctttgccagatttttagtttgatttcatatggtcagagaatgtactctgtgatttaaattctttaaatttgacaaggtttgttttgtggcccaaagtatggtttatctttgtataaatctatgggcatttgaaaataatatatattttgctgatgttggtggattgttccataaatattgattagatcctataggttgattttgttgctgagctcttctgtacctttgataattcactggctagttctatacattgttgagagaggcattttgaagttgccaaacataattattgatttatctattactcttttcagttctatcagttttttttctgtatattattttgagctctaaagtctaaagttggtacgtacacatttaggatcactacgtcttcttggtagattcttttatcattgtataatgtcccttactttccctagtaattttctttgctctgaagtacactttattcaatgttaatataaccactcttctttcttttgaagaatgattacatatcttttttccttccttttactttcaacttacctatattgccatatttgaaatgagtttcttttagttactatatagttgcatcatattttaaaatctactctgttgagcacttttgatttgtatattttagattatttacattcagcttgattattgatatgttagcatttacgtgtgtcattttgcttttttttctgtttgctatctctgtttttttttttttcctgccttcctgttggctattggaacgcattttagaatttcattttgatttatctgtattggttttggtggtatctctttgtatatatctttagtggttgctctaattattatattatattatattatattatattatatatacataacttagcacagtgtactggtatcaatattttactactttaagtgacatttataatagaaacctttctctctattttccttttctttcccctatataatatagttgccatgaatattttttgacccacatttagaaccacataagatattattatactttttgtttcagccatcaaacctaatttagaaaactgaagaagacaaggaaagtctgttgtatttatgcagatttttgcctttactcttttccttcttccttcttgatgttccaggatccctccatttaaaatttcttttctatttagaaaacttactttagctatacttttttgtttggtctcatgacaaccaattcctagatttcccccctcctattttttaagaatgtcttgatttcctttaattcctaaaaattattttcactggttatattatagaattgtgcgttgattcttttcttttctttcggtatttgaaaaatgccatgccccttccttctggttttggtggtttccagcaagaaatctgctgtcatctgaatcattgtttttaggtaataatggtatttctgtgtcactatcttcaagattttttcttagtttttagattttggaagttttcgtatgatatgacttggtatagatttatttgagattattgtgttcgggtttgttcagcttcatgaatctgtatgattatgtcttttgccaaacttgataaattttgagtcactgtttctttgtatatttattgacctgccttctttctcttctacctaggctcaggtgttgtaaatattagatctttgacaggcctctgaggtggtgttcgttttgtctattttccatgttgttcatatttggtaaattctgttgttctcttttgcttttcactgattctttcctgtcctctccagttggctgttgagcccatctattgagttgggttttgtacttttcaggcataaaatttgtatttgttttttcgttgtatcttctgtctctttgcttagactttctgtttctttgctgaggcttccaatttgtttcttttaccttcataactgctcattgaagcattttcattatggctgttttgaaattgttgtcacataattctgacatctctgtcatcttggtgttggcatctgtggatttgttaacaattcaagatattcctggttcttggtataacaaatgattttctgattgaatctggatgctttgggtattacattatgaactctgtatcttatttaaaccttctattttctctggctttcactgatgacattctatcagaggaggagttagcccctcctatttactgccggaagagtttagaagtttaggttcccctctggtctctgaagacacctgaggaatatgatgctcttttttattgctggatgggtgtattctcaccctttattaggccttcactaatgccaccctaggtggaaggggcaggaatgtctcccatgtggcttccactgtcatcacgggaggaagggagccttgttattgctgggcagaggtgaaaattctgactcttccttggcctcctctgacacagttccaatggggagcaggggctggaggagtgggtaacctcattacagtatcgtgaatatgaaagtcctggctctccacttgtccttctctgaaattcttctggcagcaattagggaggctggggagcctcattatatagacttgcaaagattgaagtctaggctcctctcgtggcctttgctagcatgagtggtggtagggccacattttttttttttcctttggtacttgtcaggagtagagtggttaatgtctaaaagttttttgtttactagcctactcctttcctggtccgtagggtagagagcagactttcgttgaggcttttttctttctgtacttagtggtgtttctaggttgtcaactttttctgttccatatctgctgtgcatgaggcaaaaggaaaacccagggaacttattgctgtttaataacaaggtcccaaggtctctagtcaatctgccttttttcccccacttcagagttttctcatgtttattttatatgtagtattcagggtttttagttgtgttctgagggaggaatcaggaaaatacttctaatccattttcctgggaatggaagctgaccatgctttagaaaatttattttgtcattgtatttggtgagttaattgaagtaggtaacttgacattgttgacatttgctctttagagtaagattaaaaagtttgatagatgacgagtttaccctagagggaaggtggcaaatacctgatccttgtgccacttctcttacccttatataccatagcagtctttacttattgttctccattcttcttcctgttgagtcgtgaattaaaacagcattccagatagcacattgctagagttttggagagaagagaaaacttatttgccatacttgccatgaagctgtattcagttgggcataattagtcatgtgaattctagtgggaggggcccagttgagatagattctagtgcgtgcaaaattgatgcagttactcacgaaaacaagtgaaacaggtcattagttgttactggaggtctgtgtcttcaaagtctggtgtctgcatctgtgagtagataatagtatgatagaatctgtatttactaatgattctagtagttaagtgtatctgtgagtagataatagtgatggatagaatctgtatttactaatgattctagtagttaagtgtggaccttcaagtttggtcatcaggaattatcatttacatatttttttgaggggagataaatttataattagtaaaccaaaatgttttaaaattcatccataaatccaaaccatcttatagacatgaatgggacatatccactctgtcatttggaatatcacagaataattctcattcttttaacaaatttatcattttataaggttattcaggagaataaacctagaagaaaagagtgtccacaaaaactcattgagtagggttgcagtcttatatgtagacttttgaaaactgtcttgttgcattaaaaattaatgaacacttttttctatttgttttttttttgtaaaaaaggagaagaatataagtgtttaaatagaattgcaaacaataaaaactgtagttatggtaactttaaaatgttcacgtgaaacactaataataatctttggccattcggtaagattgataaagtcttgcctattcctttcaatgcctttggttaatttttatgttatcatcaaaaataaatgtttcaaaggcaaatgaactagatataattatatataaacaatgctgagatcaatagtatttaaagtagttgggaagtatactaaacatgaaatacacttctgcatccacttatttgaaaatacctggaggccttttcttatcccaaaggcatttctaatttgcatagtaaagatagtattatttatattttcctttaatattcagatatagttatattcaccagataagaaatgtacctaccctgtgaaagctagtatctaaatttgttcttaagaaccagtcaagtgtaaagtaagtaatttctggttgaaatggaaaatagtgagctttttgaagtttcacattgaggtcatgagataacctgatttatgatagcatatgagaagcaacgaataatctgaaatgttcatcccacactgtagattaaactgagtttttaatagacataactaattttgaggaagattttcgtgaaatagctttaaagtatttggtgatttttaccgacaaacggacttattcgaatcataaatgaatttaattatttgaaaatgatcaagcatatatatgtataaaaaattcttgctattttggaatttgaattttcaaattacgtaaacatgaatatttgttataacagagcacatttttgtagtactatttcaacaaatttcaaacatttttattttggtagttaaaatcagaagcaattgtattttaaagtgcaatacgtatgataactagctatttcaaaatcatacgttatgcataagatgttacttttcaagaatgaacattaatgtagggaagaagtactattaaaagataaaaccagacactctttcacttgagaatgtggatagatgtgaggtaggaatttgcttttagaattatgaattgtattgggggagaagtggagagttattactatgatcgtgactacagttgccattgccattgtgaattggcttcattagtgttcaatccagccactttagcagaactcatactagcataattgctattgcaggattaattcattaaaacaacaataggaatactcacacaataaccatattcagaaaattaacccctttgaaatgaacacgtctttattcaaaacctgataaggactaagaggatcacttaggcaaaaatttgaaatggtggaggaaagtatccataaattattaccgtatttttctaaaggattgtaggttagagtgaattatgataaaagcaaatctggtatttaaactcacagtgtatttttggatatcctctaattaagtctcagaactttataaaagctttagccaataacatttaatttatctactcttgaagtctgaatagaatattctagccaaatgctcctttgttagagattcttaagctggtgtgaatgttttcattatactggaaaatagaattcttttggaattctagaaatgaaattttctgttgaaacctgtcttctggtaaaacattcaaacacatttacaatttatattccaaggtgaagtgtgtattctttaatttccacggaggttatcaattttattgcaatagataatatgtctaaaacatgagtaaatcaaaagaatatcaaaagtcattcaacttctggtacgtgttcatgattttgccagaaactggatggctccaaacaaacatgacatttactttcaaagggtttatcaaaagataataatacattcctaactagcatgttggcacagcattgtttctaagataagtcactatttgtcacagcaaacgttttctttttaattgtcatttggctcagatctttctgtgattgcttttaaatatatgctaattcttttagtttacttttttttcttctagtttacttttccctgttaatatctcttggtttgtgagtttgtgaatgacgggtgggatctactataagggttccccagagcattgaagaggtttcagagaccaaggaggtgagggagatgcaaaacacatggaaagatctttcctatctatgccttgcacatttcactctgttagaaaggcttttctctcctctttgctttttgaaatgtttcccatttgtgtgtgtgtgtgtgtgtgtgtgtgtgtgtatctgtgtgtgtcagggtcctgctctgttgcccaggctagagtgcagtggtgagctcatgccttactgtagcctctacctcctgggctcaagtgattctcccacctcagcctcctgaggagctgggactataggcgcgcaccaccacacctggctaatttttaaattttttgtagaggcaggtctcactgtgttgctcaggttggtcttgaactcttgagctcaagttatcctcctgccttggcctcccagagtgccaggaccacaggtatgagccaccgtgtcagcccctcccattctttagttatcagaataagctgaggataatttatttcatcttggactttgtttataattttcttataggattttccatattctgccacatgttcatgcacactgagtagagatgaattccttgaaaagggtattcatctttgaatgactggtaatagtacatcattcatgttgtgtagtgtctgttcagtgcttttttagagttggtctcagcatgtctctttagaaactgggtagttgtcatgttaaaagaatctcagcaacaaaataggattcatgttggtaagcattaggaagtattgggagcatatggtagaattcatcttgattttctcaattgaggacatttgttaactctaaggttatcaatctgttgttcaaaaatatttattgaatatctacattgtatatgattttggattagaaattcttgccaggccaccttgcttagtgtagtttaatagtaggtgctcacttctctatctcaaggttgtagctgttattagttttttttcctggttcttgtgattcttagtttatagcacacttttagctgctaatcatgtgtatatatttaggttctgttaccatttataaggcacactaagcaaacattaccttatttaatttagatacttattgcctgaaatgtttcagaatatcatttgatcctccatatatggatagttctgataagtagtttctttttcatatttaatataaatattactatcctttctatataatgcttgagtcctacattttatgcccttccagactacctacttaattttttatatgcaaaactgaatttgatggattaggattcctatatgagacttttggatggagttgcaaattgttttagttttagagttgtgtctctgatgtctggattgtttggttcttgataatattatatacattaatactttaccttgaccagcaacatgatttctgacccctgatctacctgcattttcagaaagattttgtcataagatggaatgagcgcatacatggaattaaaaacatgtttgaattttggctttgttacttattagctttgattttgggtaagttacataacttctaattattataaatttcctaatctgcaaagacaaatatctgctttatctactttctgtgttaataggagctaatttgaaaatgtcaaactcttttgtaagttattacatactctataagtttaagtggctgccaatattccttctacctggttcatttgatggcaatcttagtttattcctgcgctttcatgtttttaaggttgagaaaatgagagtgtcagaggagggtttaattttttttataagaacaagtagtaatggggtcattatagaaaatttgagaaaataatcatagacctactatctagggataaatcacttctctaatagttcacatatattcccctagtattttttctgtgcaaataaattatttacttttgttttataaaagttggatcatgtttttgtagtgtgctaatatgactagcattttcttattttccccttgctttgaaaactttatttttcaatgcctgtgtagtatttcactttatgaatttaacataatttattgttatgttattgttttgatatttatagagtgtcatatttttactgttagaaatattgcaatgatgaatgtatttgaacataagtctttgcttgaaaatcttgagtccaatattggaactttaaaagaacctatgtaatatgtaaccagaagcagtttatgagaccttttgtggcatcctctccagctttgtgtgagttttatcatgaaatattttgagtgtgtgaaaatgtataaggaataatttaatatttatatactctctactttgctcaataattatatatacactatatatatacaccatatatatatatatatatatacacagcatatttatgtatatatataaattgtagtttcctttgaattctttcccacttcatgcttttcctccgcaaagtttcatatctgaagataaaaagaattaacaaagtgtaatgtcagttttaaataaagaacttgctagatttttaagaagaattctgaaggattatttctataaaatataaatgtctcatcaatgtttgtgagagaaggcatggaaaaaaatcacgtttagatttgttatttgtatttctgtgtgaaattctgaagattagcccagttctaccatgagggtatatatcatggagcatatttttcatattgaaggcaaagcaaagatagttttcaaaaactatgacccttacatttatattgacaacatctgtagaccataaaaaagcccattgtctttttttggcattctttgcaaatgacttattttaccgataagaattgctagtgatccaaatgaatataatattgtttaggcaatattgtttgggaaagactatgatcctcatttatgaagcagtatttcagtgaaaggatcttaggcaatgggaagcaaataattcaactctatttcgaataatttttattcagtggtttcaagttttctgatattttcttctgtactgtttaatctgctgttcatcccttctagtatatgtttcatataagattctatatttttcacatctagaggttccattaaaaatatatattcactttctctccattatgttcatgttttcttttaaattattgagtatcttttaaatgtttataaaaactgtttcaaggtttttgaattgcttaatttcattatctgagtcattgacttttttttccctccagattatggattatgtgtttctacttctttgcatacctaataatttttggtttgatacttgacattatgaattttatcttactgattgtttgatttttgttgtattcctttaaggaattatgaattttttttcttccatgcagttaagttacttgttaatcaatttgagctttttgggacttagtttttttttttttttttttttttttttgagatggagcatccctctgtcgcccaagctggagtgcagtggcgtgatctcggctcactgcaagctccgcctcccgggttcacgccattctcctgcctcagcttctggagtagctgggactacagctgcccgccactacgcccggctaattttttgtatttttagtagagacggggtttcaccatgttagccaggatggtctcaatcttctgacctcatgatctgccctcttcagcctcccaaagttctgggattacaggcctgaaccaccgtgcccggccaggacttagttttaaacttcattagtgcaggcttagagcgatagagcagctttttttctaatctagggtgaatttaatcccactattaagctttttgttgttgtttttgtttttttttttgaaacagattctcactctgtcacccaggctggagtgcagtggcgtgatcttggctcactgcaacctccgcctcccaggttcaagcgattctcctgtctcatcctcctgagtagctgggattacaggtgcccaccatcacacctgactaattttttttgtatttttagtagagacggggtttccctatgttggccaggctggtctcgaactcctaaccgcaagctggtctcctgcttcagcctcccaaagtgttgggattacagacgtgagccaccgtgcctgggctcactattaagatatgatcgttctggggactgtacttaatttcttgaatattacgaggtcttttcactctgactgatgggaacacgaactattgtaagtcctctcttacctttaggaatttttcagtctgctgctttccaatgactcctttcctttgtctggagtagcttttctctcaggcgtggactgattaatactcagaacttccggaactctctctctcaatgcagctccatcctctagtatattgcctggcaaattctacctgccttgagcttccttactccagtctgtgtctgcacaacttaatgagacccagagctgtttgggtctcttcttcctttgctgtagctggaacactgtctctatctagtaagccgggggcaatcatagaacttacttcattagttacctttcttcagggatcacagccctttgtttcctgttgtacagtgtctgataatattttgtatattttgtacagttttcaaggttttttaaggcagcaggataaatcaggttcctgttactcccttatgactagaagttaattcagctttgtatgctgaggaatggctcacaactttcagataatttaatacatatattgcattgtgaacagatagtaaatgactattaaattgtaattgtaccatgaaaggatttttttatcttgtaagtttataattttaacatggctattaaaatttttcatttaaattaccagatataaaaagtttagcacatttctgttgttgttatagtgagagtttcaaatatccgcctcctaatgaagttgattgacagatataggtagtgatctttatatctggaatttcttagtggtcaaaaatttatgcaaaaacatctctttttaaacttgaaggtatgtgacttatttctcattaaccgagttgtcatattcttatgccctttgattttagacttgaaaagtatgagtctggtgaaatgctgaaaatggtacaggaagaagtgagattaggaagagtgaggctgtaggaaaattataattatagcaattaagaactaccagggagttgaaagactttttggtaaagacctctgttaccataaatgttgcaattagtaactattcacatattataattcatagtcatttatataatggatctgttttctttaactcagggattcctaaatgttttcagttcataatgcccttactacctctcattttttcatgatgcctcaaggcaaagagaaatacctaatagttccgtggattaaatatttatgtcctaacaacttagtagccattagaagtatatgtataaattaaaagaaacaattattttcttcttaaacagccataactatttactaataggatatgtgagccttttggatactggacagcttctcatactttgaaatcagattggacactgccaccctcatttcctgttttatgttgctttttgctctgtgtttgttttttatcacagcagttgttaaatacccagcttcatgatgccatgcaaggaatgtaaggcaatctaacattgtaatcctaaacttccttttgctagtagtctgtgcagtgtccaatagatgtcaagtattgctgtttctttcaaacccttagaatatttcacagtgcccctgtgtgtctgctacagcacccctgggaaacttgacacacattctgggtactatgggattaactaattttcttctattgttcatcactgttttatatggcattctggcatgattaagatcctaactaatttctgtattttggaatagagaatctttttgatacagtttcttaagaacctgagttagtaatggtgaaattaaggaataatatatgacatttttttgatggaaaaatgcttacagcagaggcttcatggaaaattattgaataagttggttttgtgtaattttacaaataatctgaaaatatgaagagaaatagtgaataaatattgaaatatgatatttaataggataaaaatgaaggaagatgaggtgggatgaataaacagaaaagaaaaacatgaattttattgtgaggatgtgtaagggaaagttatcaaaactatctgtgctattattgggtgtcttggcatcaattattgtcttgtaatggactaaggatgttgctgattgatccttacaggtgtctgcccactgaactgtactaagctgtttttttgactcaaaaatgattttttagaatgatacattttacaaagaagtatattctgtaccttgtgggaaaatattcctatatactatcataagtatacatttgtgattctatgtgttcatagtttaacaagcataatgttaattaatggctaataatatattgagtatttattatgggccatacacagttcttagtgctttccatatattgactgaattcttgcagtagccctctgaggtaggccctattctttttttttttttttttgagatggagtctcgttctgtcacccaggccagagttcagtggcgccatctcggctcactgcaaactctgcctcccgggttcaagcgattcacctgcttcagcctcctgagtagctgggattacaggcgcctgccaccgtgcccggctaatttttgtatttttagtagagatggggtttcaccacattggccaagctggtcttgaattcccgacctcgtgatccacccacctcagcctcccaaagtgctgggattacaggcgtgagccaccacgtcccgctgaggtaggccctattcttattttcatttaacagatgaaggaactgaggtacagagaacatgagtaacttgcttaaactcacagagctaatgaatggtggagtcagaatttgaaatcttgcagtatggttccagagccccttgtttgtaatatactacctaaggggagaattagcttttacctaagtgtcaacaatgaaacactagtcaggaaaaagaagacaacaagtgaatgcaatttacatttattttaagatcctagacttattaaaatcttctattaataaattgattcaaggaaaagaagctgtagtagtttgttttcacgctgctgataaagacgtacctgagactgggaagaaaaagcagttcagttggacttacagttccacatggctggggaggcctcagaatcatggtgggaggcaaaaggcacttcttacttggtggcagcaagagaaaatgaggaagatgaaaacgtggaaacccctgataaaaccatcagatcttgtgagacattttcactactgtaagaatagtatgggggaaactgcccccatgattcagttatctcaccggctccctcctacaacctgtgggaattatgggagtacaattcaagatgagatttgggtggggacacaggccaaaccatatcattccaccccggcccctccgcatgtcatgtcctcacatttcaaaaccagtcatgccttcccaacagtcccccaaagtcttaatccatttcagcattaacccaaaagtccacagtccaaagtctcatctgagacaagacaaatcccttccacctatgagcctgtaaaatcaaaagcaagctagttacttcccagatacaatgggggtacaggtattgggtaaatatagccattccaaatgggagaaattggccaaaacaaaggggttacagggcccatgcaaactgaaatccagtggggcagtcaaatcttaaacctccaaaattatgtcctttgactccaggtctcacatccaggtcacagtgatcaaagaggtgagttcccatggtcttgggcagctctgcacctgtggctttgcagggtccagcctccctcccagctgccttcacgggctggcatcgagtgtcagcggcttttccaggcaaatggtgcaagctgttggtagattaccattctggcatttggatgatagtgcccctcttctcacagttccactaggcatcgccctagtaggtgctctgtatgggggctccgattccacatttcccttctgtgttgctctatcagaggttctccatgagcgcccgccctgcaacaaacttctgcctaggcatccaggtgtttccgtacatcttctgaaatctaggcggaagtttccaaaccccaattcttgacttctgtgcacttgcaggctcagcaccacatggaagctgccaaggcttggggcttgcactctctgaagccatggctcaaactttacgttgactcctttcagtcatggccagagcagctgggacacagggcaccaagtccctaggctgcacacagtacagggaccctgggcccggcccacaaaaccattttctcctaggcctctgggcctgtgatgggaggggctgctgtgaaaacctctgacatgccctggagacattttccccattgtcttagggattaacattcagctactagttatttttgcaaatttctgcagccagtttgaatttctcctcagaaaatgagtttttcttttgtatcacattgttaggctgcacatttttctaacttttattctctgcttcccttataaacctaaatgtctttaacagtatccaagtcacctcttgaatgctttgctgcttagaaatttctcctgccagataccctaaatcatctctctcaagttcaaagttctacaaatctctagggcagaggcaaaatgccgccagtttctttgctaaaacctaacaagggtcacctttgttctagttcccaacaagttcctcatctccatcggagaccacctcagcctagactttattatccatatcagtatcagcattttgatcaatgccattcaacaagtctctaggaagttccaaactttcccaaattttcctgtcttcttctgagccctccaaactgttccaacctttgttacccagttcaaagtcacttccacattttcaggtatcttttaagcaaccccccactctactggtaccaatatactatattatctgttttcacactgctcataaagacatatctgagactgggaagaaaaagaagtttaattggacttacagttttacatggctggggaggcctcagaatcgtgacaggaggcaaaaagcccttcttatgtggcagcgacgagaaaatgaggaagatgcaaaagcggaaacccctgataaaaccatcagatctcgtgagacttattcactaccatgagaacagtatgggggaaaccgcccccataattcaaatggtctcccaccgtgtccctcccataacgtgggaattatgggagtacaactgaagatgagatttgggtggggacacagccaaaccatatcagaagctaaacagaaaaccttgaaactttaaagataaagtaatatgttactttgtgttatttcatttatgtcatgatgaattcaagattaaattggaaggtgtttcatgatgagctcaaggaattggattataaagcaagtagttactgaaagctaagtcggtttgagaggtcatactaatgatttggggaggaagcagaaccatgcttaataataatttgacctgtaatattgctggaaatgaaaggtatttggttagtgggtcagcagtgtgatcttttccttgtatcctttgcttcttgatgaagactattgtttttttcctttttgatatactttcccatctcagaacgaataccaaaacattcaattattatctggttttattgtcttgagtcttcttggagcttgtttttatgagtttttaagttctaggtttatgtagattatagtactgtttgtatacttataggtacttaataaatacttctaaattaattcaaaattatttactgaatggctaatatgtgcccagcattctgccagtagcgtgcctggagagagaatcgggaaggaaaaaagatagccctttttgtgaaggtggttttggtaaaaaatgtaatcattaacttaagagtggtcttccctgacatcccttattgactaaagaaactctcttccctgcatttattctatctccacttcctggttttatttgtggtacttattaaattaaaaggatactttttctgtgatgaaaattttactctgcatggtaatttattatagctttacatgaaatcagaacttttggtgatctacataagattaaattttattataaggaattttgaaaatgatagtaaagatggttaggagcacagaattaaaagtcatatagatcagagttttttattattattttttacttttttgagatggagccttgctctgtcacccaggctggagtgcagtggcgccatcttagctcactgtaacctccgcctcccaggttcaagcagttctcctggctcagcctcctaattagctgggattacaggcgcctgccaccacacctggctaatttttctatctttgagaggcacggggtttcatcatcttggtcaggctagtctcgaactcttgacctcaggtgatccacctgcctcggcctcccaaaatgcagggattacaggcatgagccaccaggcccggcctagatcagagtttatatccttaaatatttctgatttccttattctttagacctcagttttcacatctttaaaaggattttataaagggatttttaaagaattatggaatatatacataaaaatttagtttaaagcttctctagtagtaggtactcaaaaatggcaatgatactttaaaagttatcttgagtggtcagaactttattaggagttatgtaaggaatgacatttatttttaaccactgaagactttaaaaaataagacttatatgaatatttccttcactgagttgtggattcacttaagatttttaaatttaaattaaattaatatttttaatgtttatatattttatatgtaataatacatttttaatattaaatatttttaatttttaatttatgtgggtacatagtaggtctgtttatctatggagtatatgagagatttggatacaggcatacaatgcataatgatcccatcagagtaaatggggtgtacattacctcaagcatttatactttgtgttacaaacaatcccattatattattttagttattttaaagtgtacaataaattattgtttagtcaccctgttgtgttatcaaatgttagatcttattcagtctatcaaagtgtatagttgtgcccattaaccccctccgttccactacatttcccagtctctggtaatcatcattctgctctctgtctccatgagttcaattgttttaatttttagctcccctaaatatgtgagcaaattacttacactcacggtacctcagttccttcatctgttaaataaaaataataatagggcctacttcaaagggctattgtataataagagttcagtcagtatatggaaaatggggtatttatagttattttcatatattgactgttctaatttacgtgttcaccaacagtatacaagagttcccttttctccacatccttgtcagcatttgtaattgtctgacttctggataaaagccatttgactggagtgagatgatatctcattgtcattttgatttgcatttctctgatgatcaatgatgttgagcatctttttatttatttatttattatactttaagttctagggtacatgtgcacagtgtgcagttttgttacatatgtatacatgtgccatgttggtggagcacctttttatatacctgtttgccgttagtatgtcttcttttgagaaatatatattcagatcttttgttcattttaaaattggattattacattttttcctatacagttgtttgagtttcttatactctggttattaatccattgtcagatgagtagtttgcagatattgtctcctattctgtggcgtgtctgctcactttattgattgcttcctttgctatgcagaagctttttgacttgatatgatcccatgtatccatttttgctttggttgcctgtgcttatcgagtattactcaagaaatctttgctcagtccagtgtcctggagagttcccccaatgttttcttttagtagcttcatagtttgaggtctgagatttaagtgtttaatccattgtgatttgatttttgagtatggtgagaaatgagggtctagtttcattcttctgcatatgtatatccagttttcccagtaccatttattgaagagactctcctttccccaatgtatattcttggtgtctttgttgacaatgagttcactgtagatgtatgcctatatttctgagttctgtattctgttccattggtctatgtgtctgtttttatgctagtgccatgttttggttactatagctttgtagtataatttgaaatcaggtaatatgatccatccagtttagttctttttgctcaggatatctttggctattttgggtctttggtggttccatataaagtttagaattgtttttttctatttttgtgaagaatatccttggtattttgatagggattgcattgaatctgtagatggctttgggtagtatggacattttaataatattgattcgtccaatccaagaacatggaatgtcttttctttctttttttttttttttttgtatttttcttcagtttctttaatcagtgttctatagttttcattgtagagatctttcacttctttggttaagtgaattcctaggtatttacttttatttgtaatcattgtacatgggattactttcttgattttttttttttttttttagattatttgctgttggcatatagaaatgctacggaattttgtatgttaatttttttttttaagttctgggatacacgtgcagaatatgcaggtttgttacataggtatacatgtctccctccccttgccccccactccccaacaggcccctgtgtgtgatgttccccttcctgtgtccacgtgttctcattgttcaactcccgcttatgagtgagaatgtgtggtgtttggttttctgtttctgttttagtttgctgaggatgatagcttccagcttcatccatgtccctgcaaaggacatgaactcattcttttttgtggcttcatagtattctatggtgtatatgtgccacattttctatatccagtgtatcattgatgtgcatttaggttggttccaagtctttgctattgtaaataatgctacaataaacatacatgtgcatgtgtctttatagtagaaggatttataatcatttgggtatatactcagtaatgggattgctgagtcaaatggtatttctggttctagatctatgaggaattgccacactgtcttccacagtggttgaactaatttatactgccaccaacagtataaaagcattccaatttcactgcagcctcgccagcatctgttgtttcttgacttttttttttttttttttttttttttgagacagagtcttgccctattgtccaggctggagtgcagtggcatagtcttggctcactgcaacctctgcctcccgggttcaagcaattctcctgcctcagcctcctgagtagctgggactacaggcatgtgccaccacacctggctaattttttgtgtttttaatagagactaggtttcactgtgttagccaggatggtctcaatctcctgacctcgtgatccaccctccttggcctcccaaagtgctgggattacaggcgtaagccaccatgcccagcttcctgactttttaataatcaccattctaactggcatgagatggtatctcattttggtttcatttgcatttctctaatgaccagagatgatgagctttttttctatgtttgttggctgcataaatatcttcttttgagaagtgtcttgtcgtatcctttgcccagtttttgatggggttgtttttttcttgtaaatctgttttgagttccttgtagatggtggatattagacttttgtcagatgactagattgcaaaaattttctcccattttgtaggttgcctgttcattctgatgatagtttcttttcctgtgcataagtttttagtttaattagatcccatttgtcaattttgacttttgttgcaattgcttttggtgtatggtcatgaagtctttgcccttgcctatgtcctgaatagtattgcttaggttttcttctagggtttttatggttttgggttttacatttaagttcttaatccatcctgagttaatttttatataaagtgtaaggaatggggccagtttctgttttctgcatgtggctagccagttttcccaacaccatttattaaatagggaatccttttcccattgcttgtttttgtcaggtttggcaaagatcagatggttgtagatgtgtgatgttacttctgaggcctccattctgttccattggtctacatatatgttttggtacccgtaccatgctgttttggttactgtagccttgtagtatagtttgaagtcaggtagcttggggcctccaactttgttctttttgcttaggattgtcttggctataagcgttcttttggtttcatgtgaaatttagggtagtttttcctaattgtgctaagaaagtcagtggtagtttgatgggaacaacattgaatctgtaaattactttggggagtatggccatttttacgatattgattcttcctatccatgagcatggaatttttttccatttgtttttgacctctcttatttcgttgagcagtggtttgtagttgtccttgaagaggtccttcatatcccttgtaacatgtattcctaggtattttattttctttgtagcaattgtgaatgggagttcagtcatgatttggctctctgcttgtctattattggcatataggaatgcttgtgatttttgcacattgatttgtatcctgagactttgctgaagttgcttaccagcataaggagttttggggctgagctgatggggttttctaaatatacaatcatatcatctgcagagacaatttgacttcctctcttcctatgtgaataccctttatttatttcttttgcctgattgccctggccagatcttccaatactatgataaattggagtggtgagagaaggcatccttgttttgtggtggttttcaaagggaatgtttccagcttttgctcattcagtaagatattggctatggatttgtcataaatagctcttgttattttgcgatacgttccatcaatacctagtttattgagagtttttaacatgaagggatgttgaattttattgaaggccttttctgcatctattgagataatcatgtgatttttgtcattggttctgtttatgtgatggattacgtttattgatttgtgtttgtagaaccagccttgcatcctatggatgaagccgtcttgatcgtggtggataagcttttttgatgtgctgctgtattcagtttgccagcattttattgaggattttcgtattgatgttcattaaggacattggcctgaaattttcctttttttgttgtgtctctgccaggttttggtatcaggatgatgctggcctcataaaatgagttagggaggagtccctctttttctattgtttggaatagtttcagaaggtatggtaccagctcctctttgtacctctggtagaattcagctgtgaatccgtctggacctgggcttttttttggttggtaggctattaattgctgcctcaattgcagaacttgttattggtctattcagggattcgacttctttctggtttagtcttgggaggatgtatgtgtgcaggaatttatccatttcctctagattttctagtttttttgcgtagaggtgtttatggtattctctgatggtagtttgtatttctgtgggatcagtggtgatatcccctttataattttttattgtctattttattcttctctcttttgttctttattattagtctagctagtgatctattttgtcaatcttttcaaaaaaccagctcctggattcattgatttttttttaagggtttttcaggtctctgtctccttcaattctgctctgatcttagttatttcttgtcttctgctaacttttgaatttgtttgctcttgattctgtagttcttttaattgacatgttagggtgtcgattttagatctttccagctttctgatgtgggcatttagtgctataaatttccttcttaacactgctttagacgtgtccagaaattctggtatgttgtctctttgttctcattgttttcacagaacttacttatttctgtcttaattttgttatttacccagtagtcattcagaaacaggttgttcaattcccatgtagctgtgaggttttgaatgagtttcttcatcctgagttctaatttgattacactgtggtctgagagactgtttattatgatttctgtttgtttgcatttgctgaggagtgttttacttccaattatgtggtcaattttagaataaatgtaatgtggtgctgagaagaatgtatattctgttgatttggggtggagggttctgtagatgtctgttagttccccttggtccagagctgagttcaaggcctgaatatccttgttaattttctgtctcattattgacagtggggtgttaaactcactcactattattgtgtgggagtctaagtctctttgtaggtatctaagaacttgttttatgaatctgggtgttcctgtattgggagcatatatatttaagataggtagctcttgttgcattgatccctttgccattatgtaatgcccttctttgtcttttttgatctttgtttgtttaaagtctgttttatcagagcctaggattgcaacctctgttttttttttttttttttttttttgttgctttccatttgcttggtaagtattccttcatccctttattttgagccaatgtgtgtatttgaccatgtgatgggtctcctgagtgcagcacacccatgggtcttgactctaaccaatttcccagtctgtgtcttttaactgaggcatttagcccatttacatttaaggttaatatttttttgtgtgaatttgatcctgtcatcatgatgctagctgtttattttgtgcattaggtgatgcagtttcttcatagtgtcgttggtctttatattttggtgtgtttttgcagtggctggtactggtttttcctttccatatttcgtgcttccttcaggagctcttgtaaggcaggcctggtggtgacagagtccctcagcatttgcctggtctggaaaggattttatttctccttcacttatgaagcttagtttggctggatatgaaattctggttgaaaattattttctttaagaatgttgaatattggtcttcactctgttctggcttgtaaggtttctgcagagagatccactgttagtctgataggctgccctttgtaggtgacctgacctttctctccggctgcacttaacattttttccttcatttcaacgttggagaatctgacggttatgtgtcttgtggttgctcttcttgaggagtatctttgtggtgttctctatttcctgaatttgaatgttggcctgtcttgctaggttggggatgttctcctggataatatcctgaagtgtgtttttcaccttggtttcattctgtcactttacggtacaccaatcattcgtaggtttggtcttgtcacatagtgccctaattcttggaggccttgtttgttccttttaattcttttttggtttgtttttgtttgtttgtttgttttttgagacagagtctcactctgtcgccaaggctggagtgcagtggcgcgatctcggctcactgcaagctccacctcccgtgttcacgccattctcctgcctcagcctcctgagtagccgggactacaggcacccgccaccacgcccggctaattttttgtattttttagtagagacggggtttcaccacgttagccaggatggtcttgatctccggacctcgtgatccacccgcctcggcctcccgaagtgctgggattacaggcttgagccaccgcacccggccaagattaattcttttttctctaatcttgtcttcacactttctttcggtaaggtgatcttcaatctctgatagtctttcttccacctgatcgatttggctattgatacttgtgtttgcttcacaaagttcttgtgctgtgtttttcagctccatcaggtcatttatgttcctctctaaacgggttattctagttagcagtttttgtaaccttttatccacgttcttagcttctttgcattgggttagaacatgttcctttagctcaaaggagtttgctattacccaccttctgaagctatttctgtcagtttgtcaatctcgttctccatccagttttgtgcctgtggagatgaggagttgtgatcatttggagaagaggcattttggtttttggaattttcagcatttctgccctgttttttcctcatctccatggatttatcttcctttgatttttgaggttgatgacctttggatgggttttttttgtttgttagtttttttgttttttttatgtgggggtcttttttgttgatgttgatgtcattgctttctgtttgttagtttttcctctaacaggcccctcttctgcagcttgctggaggtccagtccagaccctgcttggctgggtatcaccagctgaggctggagaacagcagtgattgctgcctgctctttcctctggaagcttcatcccagagggacaccggcctgatgccagcaggagctctcctgtatgaggtgtctgtcaaccatgttgggaggtttctcccagtcagaaggcatgggggttagggacccatttgagaaggcagtctttcccttctctgaactagtgcactttgctgggagaatcactattgtcaggatcagctgctctcttcagagttggcagccaggaaagattaagcccgctaaagctgagcccacagccgcccctccccccaggtgctctgttgcagggagatgagagttttatctgtaatccctagactgggactgctgcctttccttcacaaatgccctgcccagtgaggagaaatctagagtagcagtctggccacaaccgctttgctgtgctgtggtgaattccgtccgggccaaacctcccagcctccttagcactgtcagggaaaaacagcctaggaaagcctcattcattgcaggtgcccctcctatcaccaagctcgatcatcccaggtcgacttcagactgctgtgctggcagtgagaatttcaagccagtggttcttagcttgctgggctccgtgggagtgggaccagaaagctgggctctgtgggagtgagaccacttggctccctggcttcagcccccttgttctgtgtgggaaacgtgagaggggagaataaagagcacacacacttgttacctttaagggtaaacaagctttatcccatgtaaatggcaatgcagatataataaatgatataataagcaaattaacatgataagcaaattggtataataagcaaatgatataataagcaaattgcattgggaacaggagaagggaagagacatacatatatttatgcttaccagactggaagattcaccaccagactgggaagcaacagcctgggcaccagagtcggacaccgaactcaccagaccatgatgtctttatgaggcttgaaattcctgttatgacttgggtcatgagttcccctaaaacacaccagttctgatgaaggaagcggtgggagcagtcagctggctgaactagtagtggtcctctgagctattcaggaggaggccagagggatttgtcacttgtataccaactcttggtcagtagcaaatggccttactacttggatgccccaatggcaacaaaactaatggttaatcgggagtaaagaggtttggggaaaacaatactgggaagatatctgaatcctgctgcatgctaccattatcactgttttccatgttgatgctgatggatctctgctttttcttgacggactatttaatcagcaggcagatcaacaggccaaaattccaccataactgcaaacttaaatgcagatgaatggattacaacatgttcaagccttgcaatgagaggcattataatgtatgatggtataattaatgagaataacctgtctgctagtaataagtacatgggtcattatgtctgaggctgagaatgagttcatcaactgggtagccaccactgcagcaggagccaactgccgtcagtgctgggtatgcctcaagttgctagaggctgccaggaatgggctaccttggagaatcgtccctgctaacatttctggatggatatgccgataccaatgggggtggggtaataacacttgtaatccaacctggacttttttttaaccaaaccaaacagtctatttttgcctaagccctaactaaacacagcacccttgttacttaaattacacattacagcaataagctacatgtagaaaaagatcttaatgatagtatcactggacttatgttatcagatgaatttgctcagctgcgtactgttgtgttgcaaaatcggatgacattaaatacgcttaccacagcccaaggaggggtttgtgccttactgtatactgaatgttatgtgatatacctaacaaatctcacaatattactctccttgcaaagccatggtgggtgtggtttttattaattgtgcttttaattctcctgtgcttatcctgtatctgtaatctatatcaactttgccttccccatgtatctgtaagggtattttcctacaaatgagtatcaaattgagtctgaatgtggaggtaaagttaaatattaaatttgaactcaattgaccatttgaactcaattgaccacaaacagtggtcaccaagtcctggaatgggttgtatgagtgagcccctttaggcgttcatccagtgttgtttcggagaaatctctgtttcaatctattcctatatgttagtcattgaaaaacaatagacaatcacaaaaacaagttgacctttttgtgttccttgagcccagttgcaaagggccctcatgactgggcctcatgccaaacagcttgttaaaaaagagctagggtcccagactgcaccaacacttcatgagacccctccttgtctgtgcactgatgagtagtggactctggagcccaggctgttgcttcccagtctggtggtgaatccgccacagtctggtgagtgcggtgtctgactctggagcccaggctgttgcttcccagtctgatggtgaatcctccatagtctggtgagtataaatgtgtgtctctattttcccttctcctgtttccattgcaatttgcttattatatcaatttgcttattatattaattcgctttttatatcatttgcttattatatctgcattgccatttatgtgagataaagcttgtttacccttaaaggtattgtgtgtgtgccttttcttcttcccttgcgcgtttcccacacagaacaccccttgccaggggagtgaaccgttttgtctcactggggttgcaggtgccactgggtatgaaaaaaactcctgcagctagctcggtgtctgcccaaagagcagctcagctttgtgcttgagacccaggtccctggtggtgtcagcacacgagggaatcttccgttgtgcagactgcaaaaaccgtgggaaaattgtagtacctgggctgggtagcacagtcccttgtggcttcccttggctgggggagggaggtcccccagctccttgtacttcctgggtgaaacggtaccccaccctgcttctgctcaccctccgtgctttgtacctactgcttaaccagtcccaatgagatgaactgggtccctcacttggaaatgaagaaattgcccaccttctgcgttggtctcgctgggagctgcagaccagatctgttcctatttggctatcttttcccctcccttgtatgctgactttttatcatgcaactttactgaatttatcagtcctaataattttcttgtggagtctttaggtttttccaaatataagatgatattttctccaaacaaggttaatttgacctcttcctttccactttggatgctctttatttcattctcttgtctgattgctctagctaggacttccaatactatgttgaataacagaggtgaaagtggacatccttgtcatgttccagatcttagaggaaagacttacagtttttccacattcaatattaatactagcttttggtttgtcatttatggcttttattgtgttgagatatgtttcttttatactcaggtttttgagggtttttatcctgaagcaatgttcaattttatgaactgctttttcacgtgacatcaattgaaatgatcatgtggtttttgtgctttattatgttgataggatatatctcattgactgatttgcatatgttgaactattattgcttccccaggataaatcccactgtgtcatgatgaatgacctttttcatgtgttgttgaatttggtttggtagtattttgttgaggatttttgcatcaatgttcatcaggggtattggccagtggtttcctttatttgatgtgtctttgtctggttttggtatcagggtaagactagccttgttgaatgaatttggaagtgttctcttcctgtttttccaactactttaaatatgattggtattagttctttaaatgtttggtagaattcagcatttaagccattgggtgctgggctcttctgtgctggaagactttttttgttatggcttcaatcttattacttgttactggtctgttcaggttttggatttcttcatgattcaattttggtaggttgtatgtgtcaaggaatttatttgttctagattttccaatttatcggcgtatagttgctcatagtagctgctaataatcctttgaatttctgtggtattggttgtaatgtctcctttttcatctttgattttatttgtgtcttctctcttttcttattaattagtctggctaaggatttgtcaatgttatgtatcttttcaaaaaccatctttttctttcattgttctttttctgtttcaatttcattaatttatgctctgatctttattatttctcttctaattttgtgttttgtttgccctttcctagttctttaagatcaatggttaggttgtttatttgaagttttcctacttttttgatgtaggcgcttataactataaactttcctgttagtactgcttttgctataggtttgttttgttgagtttacattattatttaagaaaattttcaatttccttcttaatttcttcatcgtcattcaagagcatattgtttaattttcatgtgtttttagaggttccaaaattcctcctgttactgatttctagttttattccattgtagtcagagaagatacttgatataatttcaatttgtttgaatttttaggaattttttattgagtcacatatggtctattcttgataatgatccatgtgctgaggagaagaaaagaatgcgtattctggaccagttggatgaaatcatctgtaactacttattagatctatttgttctgcagtgcagatgaagtccagtgtttctttgttgattttctgtctggatgattctgtctaatgctggaagtgggatgttgaagcctccagctattcttgtacttgggccttgctttttagctctaataatattttctctatatgtttgggttctccagtgttaggcacctatataattataattgttatagcctcttgccaaattgacccctctcttattgtataatgagcttgtctctttttatagtttttgtcttgaaatctgttttgtctaagtatagctactcatactcatttgagagattcttgagccacaactataattcacccatgacttctataagaatgtggttcaccaaggtttaggaagagattgaggtatctgcattttaaaacatattcataggcaattttgatattcaccttagggaaaatactatgattttacagaagataatctaaacttgaaaagtaaatatttttccatctttatggatggagaaacccaagatccaatatttaacagttttaaagactactagagaaaatttgtacatctttcattgtaacttgcttaatacttaactctaacatttggacagaagttatttttattatttatttatttatttttattacactttaagttctggggtacatgtgcacaacgtgcaggtttgttacatatgtatacatgtgccatgttggtgtgctgcacccattaactcgtcatttacattaggtatatcacctaatgctattcctccccgctccccctaccccacgacaggccccggtgtgtaatgttgccgttcctgtgtccaaatgttctcattgttcaattcccacctgtgagtgagaacatgcggtgtttggttttttgtccttgcgatagtttgctgagaatgatggtttccagcttcatccatgtccctacaaaggacataaactcatccttttttatggctgcatagtagtccatggtgtatatgtgccacattttcttaatctagtctatcattgatggacattagggttggttccaagtctttgctattgtgaatattgccgcagtgaacatacgtgtgcatgtgtctttatagtagaatgatttataatcttttgggtatatacccagtaatgggatgagtcaaatggtatttctagttctagatccttgaggaatcaccacactgtcttccacaatggttaaactagtttacagtcccaccaatagtgtaaaaatgttcctgtttctccgcatccagcacctgttgtttcctgactttttaatgattgtcattctaactggtgtgagatggtatctcattgtggttttgatttgcatttctttgatggccagtgatgatgagcattttttcatgtgtctgttggctgcataaatgtcttcttttgagaagtgtctgttcatatcctttgcccactttttgatggggttgtttgtttttttcttgtaaatttgtttgagttcattgtagattctggatattacccctttgtcagatgagtaggttgcaaaaattttctcccattgtgcagtttgcctgttcgctctgatggtagtttcttttgctgtgcagaagctctttagtctaattagatcccatttgtcaattttggcttttgttgccattgcttttggtgttttagacatgaagtccttgcccatgcctatgtcctgaatggtattgcctaggttttcttctagggtttttatggttttaggtctaacgtttaagtctttaatccctcttgaattaattttagtacaaggtgtaaggaagggatccagtttcagctttctccatatggctagccagttttcgcagcaccatttattaaatagggaatcctttccccatttcttgtttttgtcaggtttgtcaaagatcagttggttgtagatgtgtggtattatttctgagggctctgttccgttccattggtgatatctctgttttggtaccagtaccatgctgttttggttactgtagctttgtagtatagtttgaagtcaggtagcgtgattcctccagctttgttcttttggcttaggattgtcttggcaatgcgggctcttttttggttccatgtgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttatgtcctcttttatttttttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgcgatttttgcacattgattttgtatcctgagactttgctcaagttgcttatcagcttaaggagattggggctgagacgatggggttttctaaatatacagtcatgtcgtctgcaaacagggacaatttgacttcctcttttcctaattgaataccctttatttctttctcctgccttattgccctggccagaatttccaagactatgttgaataggagtggtgagagagggcatccctgtcttgtgccagttttcaaagggaatgcttccagtttttgcccattcagtatgatattggctgtgggtttgtgataaatagctcttattattttgagatacgtcccaccaatacctaatttattgagagtttttagcatgaagtgttgttgaattttgtcaaaggccttttctgcatctcttgagataatcatgtggtttttgtctttggttctgtttatatgctggattacgtttattgatttgcatatgttgaaccagccttgcatcctaggggtgaagcccacttgatcatggtggataagctttttgatgtgctgctggatttggtttgccagtattttattaaggatttttctgtggatgctcatcagggatattggtctaaaattctccttttttgttgtgtctctgcccggctttggtatcaggatgatgctggcctcatagaatgagttagggaggattccctctttttctactcattggaatagtttcagaaggaatggtaccagctcctccttgtacttctggtagaattcagctgtgaatctatctgctcctggacttttttggttggtaggctattaattattgcctcaatttcagaggctgtgtttggtctattcagggattcaacttcttcctggtttagtcttcggagggtgtatgtgtccaggaatttatccatttcttctagattttctagtttatttgcatagatgtgtttatagtattctctgatggtaatttgtatttctgtgggatcggtggtgatatcccctttatcattttttattgcgtctatttgattcttctctcttttcttctttattagtcttgctagcggtctatcaattttgtggatcttttcaaaaaaccagctgctagattcattgatttttctgaagtgttttttgtgtctctatctccttcagttctgctctgatcttacttatttctcgccttctgctagcttttgaatgtgtttgctcttgcttctctagttcttttaattgtgatgctagggtgtcaattttagatctcttgtgctttctcctgtggacatttagtgctataaatttccctctacacactgctttaagtgtgtcccagagattctggtatgttgtgtgtttgttctcattggtttcaaagagcatctttatttctgctttcatttcattatgtatccagtagtcattcaggagcaggttgttcagtttccatgtagttgaccggttttgagtgagtttcttaatcctgagttctagtttgattgcactgtggtctgagagacagtttgttataatttctgttattttacatttgctgaggagttctgtacttccaactatgtggtcaattttggaataagtgcgatgtggtgctgagaagcatgtatattctgttgacttggggtgaagagttctgtagatgtctcttaggtctgcttggtgcagagctgagttcaattcctggatatttttgttaactttctgactcgttggtctgtctaatgttgacagtggggtgttatcgtctcccattattattgtgtgggagtctaagtctctttgtaggtctctaaggacttgctttatgaatctgggtgctcctgtattgggtgcatatatatttaggatagttagctcttcttgttgaattgatccctttaccattatgtagtggccttctttgtctcttgatctttgttgatttaaagtctgttttatcagacaccaggattgcaacccctgcctttttttgttttccattttcttggtagatcttcctccttccctttattttgagcgtatgtgtgtctttgcaggtgatatgggtcttctgaatacagcacactgatgggtcttgactctttatccaatttgccagtctgtgtcttttaattggagcatttagcccatttacatttaagattaatattgttatgtgtgaatttgatcctgtcattatgattttagctggttattttgcttattagttgatgcagtttcttcctagcctcgatggtctttacactttggcatgtttttgcagtgactggtaccggttgttcctttccatgtttagtgcttccttcaggaggtcttgtagggcaggcctggtggtgacaaaatctctcagcatttgcttgtctgtaaagtattttatttctccttcacttatgaagcttagtttggctggatatgaaattctgggttgaaaattattttctttaagaatgttgaatataggcacccactctcttctggcttgcagagtttctgccaggagatctgctgttattctgatgggcttccctttgtgggtaacccgacctttctctctggctgcccttaatattttttccgtcatttcaactttggtgaatctgacaattatgtgtcttggagttgctcttctcgaggagtatctttgtggcgttctctgtatttcctgaatttgaatgttggcctgcctcactaggttggggaagttcttctggataatatcctgcagagtgttttccatcttggttccattgtccccatcattttcaggtacaccaattagatgtagatttggtcttttcacatagtcatgtatttcttggaggctttgttcatttctttttacttttttctctaaacttctcttctcacttcatttcattcatttgatcttcaatcactgataccctttcttccagttgatcaaattggctactgaaacttgtgcattcattacgtagtcctcgtgccatggttttcagctccatcaggtcatttaaggacttctgtacactggttattctagttagccatttgtctaatcttttttgaaggtttttagcttctttgtgatgggttcgaacttcctcctttagctgggagaagtttgattgtctgaagccttcttttctcaactcgttaaagtgattctccatccagctttgttccgttgctggcgaggagctgcattcctttggaggaggagaggagctctgatttttagaattttcagcttttctgctctgttttttccccatctttgtagttttatctacctttggtctttgatgatggtgacgtacagatggggttttggtgtggatgtcctttctgtttgttagttctccttctaacagtcaggaccattagctgcatgtctgttggagtttattggaggtcactgcagaacctctttgcctgggtgtcagcagcggaggctgcagaacagcgaattttgctgaacagcaaatgttgctgcctgatcattcctctggaagcttcatctcagaggagtacccagacatgtgaggtgtcagtctgcccctactagggggtgcctcccagttaggctactcgggggtcagggaaccacttgaggaggcagtttgaccattctcagatctcacactccatactgggagaacgactgctctcttcaaagctgtcagacagggacatttaagtctgcagagatttctgctgccttttgtttggctatgccctgcccccaggggtggagtctgtggaggctggcaggcctccttgaactgcggtgggctccacgcagttcgagcttcttggccgctttgtttacctactcaagcctcagcaatggtgggcaccccttctccagcctcgctgccaccttgcagttcgatctcagactgctgtgctagcaatgagcgaggctccgtgggtgtgggaccctctgagccaggcgcggggtataatctcctggtgtgccgtatgctaagaccgttggaaaagcgcagtattagggtgggagtgacctgattttccaggtgctggttgtcacagcttccgtttgctaggaaagggaaatccctgaccccttacacttcccgggtgaggcagtgcctcaccctgctttggctcacattcggtgggctgcacccactgtcctgcacccactatctgacaagccccagtgagttgaacccgttacctcagttggaaatgcagaaatcacccatcttctgagttgctcactcttggagctgtagactggagctgttcctatttgaccaacttggaactgtcccccaggctatttttaataattagtggttaagaacacaagccgttgagtcaggtaactggatttgtaatcctggcttgctagttgtgtaaattttgaagatgtggtttgctttctttttaatattctgtactttttttgtagacttgttaatacttttttcttgtgctcactttcctattttcagttcttttcctcctcctgtttggtaatgaaaactcaattctggaaaattagaatggtaaaagggaataaaggcaagatgatttttagattttattgacatgtttttattggccggtttattaagattttattgatacatttatcaaggatatgtgtgctatatccttgatacacttggttcaaagatttaatttcatagtaaaggagagattgtcttatttttatttctatttcttattttatttcaatttttagagttaaagtttacatgtttgcatgtttgatagggagactatttctgtaagtttatgttatattctctcactactgggaccacctccctcctgctcctttccactctaaagcacttgggttacacagctgctatatggttgtaccctgtcccatgtgtattaagccaacataggctgcaaaggggttgcagtttggagcatgatagtagcgtggctgtttggagaccccagaactgtagctgccagaattatgccatctggtagcaatgctgccaggcagttccacccagggcataaatgtatttttgctgagcacttttcgtgttgcaagagccatgattgcctaggcagggatgtggatggatggtcatgggaactaactgaaaggtgtttaattggaaccactctaatgttcaaggtgagagtacttgcaataaacatgaagaatcacattcaaacttttacaatagatgcaggaagcttaaccaaatagtcttttaacttttatgaagatttttaaattaaataattgtgagattatagtaaggaatagttactttaaaaatttaatctttatacacatggcagaaggtggtacagaaacatagcttttgtttttaaggtaaaataattgtgatcacctttatttgttgagagtttatttctgttttcttaaaaattcccagaacattgaacgtaattcaacattccatggggaagaaagtattatgcagcttgcatgtgtgcatatctgcatatcggagcacaaaatattgacatgataattgtagtcaagcctgagtgaacagtggcctgtgggaattcagctggtgttgtaccaactggatggctgctcaggacacagtttgaaatgcaaggtgcaagttagcactttattcagcacaggcaggcatcatttaaaaatccttgggggcaaccctggtgatgtgcagatgttaaaacagtctgttctgaagtgctgattttcaaacactggaagaaacttctagattctgggtgaaaaatatttgcacaatcatgaaaggcatataatgcacaatcataaaaggcatataatacacaatcttttcctactcttttatgttgttttacataataaatgttgagtatatgcagaaatatctggacaaatagttaaaagagatgaaatataagaaaatcaggaaatagtcacttaatttctaactataaaacagaaaaaggttttgttttgagtttcagctttgtatatttagaaatggtgttgaatgagtatctgatatataaagagtatctgatcttatttaatactatatttaatataagcagatgtgttcttttgaattgttgcttctttgtttaaagggttcatctgtactccataatttacagattcagattcacatcttagcctgataatcttctgcattttagtctgattgaataaggaaaaaaatgtccatcatttgtcgtttgccaacttctccagcacaagttttggctttcaaatataattttaaacatgtattttatactggaaattaaatataatagttctaaattctggattatacaataaaaactcagttttgtataaaagcaaagtagatatattaactatacttgagcctttaaaacattttatatcaaagtttttacatgaattaagatctgttgaattatttttattccacatattaaagttttctttttttaaatatttgcttttactgtggagtaaaatgtgtttgtacaatatttttgcaacctctttttcaagttttattattgttatattgtttatagatgccattccagtaattcactatgcgtattcataagaagaaatacttataaaatagttcatgaataaatggataatttgatgatggcataactttgatttctctgaacttctgttattaagtcttactgttttagaatcttagtgtttactagaaattgggaattgtttaaattgcaaaccattgatatgtataaaatctgcattttaataggttctctactcaaatgaaagaaaacgttagtccaataaatagctttattttgtgtgttatttatgtctgtaaatcaaaaataaccaacttcagtaagttttgcttttttattttgtttataaattcagaccaatatcactgcctcatttatagttggatgtttttttagactctaatatttcattttgacatctcattaaaagtgggctcaaacccagaaaatatgatcctgttgtagtgtataatatatggcatggtctataacataataaaattttgtttcttaatgattcagaataatttctcagatttttgagcttagaaaaatgactgaaagttagcgtggtaattcatgtggctaagtacagcattgttaaaatgtttaaatgggaagtactcttgggaaaaatgattggtgcttaaaagttgtacagatttgacagcctctcttcgcttcatttttcattctaaagaagtcggcaaatattcttcgctcacatcattattgcacatcagtggttctaattagctaaacaggagtttgtctcagtcattgatcatcatcagctcctggcagtgtctttttttttctttttaaggaacctttttttttttaggtcttgtaagtacatagaagtacatgtattaattgaattgaccagattggttggtgacattataaacttgaaacaatatttaaaaattttattttttcaagtagaaaatattgtattcctgttacagcaccattttatcttgggagcattttcctgttatgaaaatgttagacatctcataccaccaggaggagctgctagacaaattgccatattttgagttttgattatctttcaatttcaaaattataacatattagtcaattttggaggtttttggttataagatataccattcaggtatatttttgaagtttttattttatatggcacttatgacccattttttcaatattatgtcactcagattaatctactgggaagtgtgttattgttattttggtgactctcacactttagtgtgcatcagaatcgcttgagatcttgtgtcttagtcagttctgactgctaaaacagaatcctgggtggcttaaataacaaacatttattctcatggttccaggaagtacaaaattaaaatgctagccaatgtggtttctggtgagggctctttgtaaatggctgcctttttgttgtatcctcatatgacaccgagagatcttctctctagtgtcccctctcattaaggtgctactcccattcatgaaggagtaatcctcatgaccctaattgcctttcataggcctacctccaaatactatgacattggttattagggcctcaatatatgaattttgaggagacacaaaccttcagtccatagcaccttgttaaacacagattgctgggcccccactcttacagttcttgattcagtgcatctggattgggctgaagaacatgcatttctaacctgggtgatgatgatgctcgtgctctggcaacctaaccactagttagactgtgagtatgtgtacatacttgtgtcataggagataattagcctagtatcaagctcatttggaagctgtaataatgcttttgtttgggtttggtgtcacataatctagtattatccgtatctcatttaaaagtactaccagaatttatttggacattagtggggatcttaagtttattatagaagaggggattataaagactaaccgtacagtttttttaaaaacatttaagtttaggggtacatgtgcaggtttgtaatgtagttaaatgttttttaggtaaactttaaaggtaaacttgtgtcatgggagttttgttatacaaattattttatcacccacttattaagcctagtacccattagttatttttcctgatcttctacctcctcccaccctgcactctctgataggacccagtgtgtgttgttcccctctgtgcagccatgggttctcatcatttagctcccgcttataggcgagaacatgttgcacatgcaatatttgattttctctacctgcattagttttctgaggataatgaccttcagctccatccctgtccctgcaaaggacatgatcttgttcttttttatagctttgtagtattccacagtgtatatgtaccacattttctttatccagtccatcattgatgggcatttatgttgattccatgtctttgctattgtaaacagtgctgcagtgaatatatgggtgcatatgtctttatatggaatgatttatattcctttgtaaccctataaattaaactaattcctggacagttaaaaatagattcatggtatatctggaaaagaacttacaaaggaactatctgactgtagttaatgctttgactttcatgatctgggtctttgtccctgggtaaatcctataatgccctaacttttgggatcctgttattttcctcctaatgtatatacctctaatagatttagtattcttttgcagtacttctgattttataatgataagctaaacattcaagtggtaatttgagataatatattagtgacaaattataggtaaagttcatatattttaacataaaatagttgtataaatcaataaaaacacactaaaatataaaatggcagatatatcgataggcaacgccaaaacataaaataaaaaggggcagaaattcatcagtttctgaaagtacattatattttattattaatataagaaacaaaagaaggcctagttgtacataatggattgcaattatgtattaaatgtactattaacgtatggtaagtagacaacaaaataataaagcaagataaagtgcaaatggtaaaaataaatcatcataatatacatgtttgcaaaatttccagtgtggtttattccaattctccgccttttgtgtgcctacatccaaagggctaaacttggcttgagaaagaccttgaaccatgatgacaatgatcttgtataaatttatgaccactaattttaagtggccctcagtactgcctgttcatcatcctattttttcctggcccgcttactatctcagtatcctagaatgttttgttttctcttttctcaacttccaacacttcttttcccattcttactttcagctgttggatacccttgctttcatataccattgagaaagtggaaactcttagaagggagcttttattccttcccataactgtatctaccaacatatctgaatctgttctcatattctctctttttatttctttggaagaactgtttatatttacctaaggccgaacaaactatatgtacgcttcaagcctcaaggattcaaagatgttggactgcagttctcttttctgtcctgcattatcagtgtctctcactgccctggatcattcctgtcagcatacacacaggctgtcttatctcccatgtttaaaaaaaacaaaaacaaaaacaaactcttgtgatctcatatttcccttgaactattttgccatttctctgctcctttctgtgcaaaatttctctgaagagtacttttcagtatttctgtgtttttctttctcacttgaactcactctaattaggctttgtaatcaccatccttctaaaatagttcttgtcaagatatcaactactgaccttaattgatatggttaggctctgcgtctccacccaaatctcatctttagttgtactcccataattcccaatgtgttatggaaaggacctagtgggtaataatttgaaccatgggggtggtttcccctgtactgttctcgtggtagtgaaatatcgtggtatatgaaagcaagggagatctgatggttttatcaggggtttccgcttttgcatcttcctcattttctcttgccgctgccatgtgtaagaagtacctttcacctcctgccatgattctgaggcctccccagccatgtcgaactgtaagtccaagtaaacctctttttcttcccagtctcgggtatgtctttatcagcagtgtgaaaacagactaatacattaatattgctaaatccaacagtcatttctcagtctttagtgtgtttgcagcatttggtatacttgatcattcctttctactaaattctattcacttagctctttctctttattctcttaaattactggcttatccttcttagtttcatgtgatgttttttccttatcttactaatctataaatgttgaaatgttccaggactgaatcctcatacttctttatgcaaaatcactccctaggtgaacttatctacccttatggtcttaaaaatatagtagtctgccttatccatgggggatacgttccaagcctcccaacgggtacttgaaaccatggatagcactgaaccctatgtacactacgttttttcctacacggtaataggcaggttgtgtttatagcatggatactttcgacaaagagatgattcatgtcctacgtgagttgggacttggacagtgcaagttttttcatgcattcagaacagcactgcaatttaaagcttatggattgtttatttctggaacttatcatttaatatttttggatcacagttggctgctggtaactgaagccatggaaagtgaaactgagggtaagggggaactacggtatttggatgactcctaaagttgtatctccagccttaacttttttactgattccagactttttaattcaactgcctactcctcttggatgttgattaggcatctcaaacttagtatgtccacatttgaaatccttgtgtccgtccaccaaacttcttctctgtgtctcagataatgtctgctccattcttccagttgtgtaggcaaaagcttgggagacattcctcacttttctatcaagaaatcctgttagctctaccttaaaaatatccaaaatttaatcacttctcaatgccactgcatctgcctatcatgtacaattcacctttcttttttacctggctgtttcatttgccttctaacttgtctttttgctttctcccttgacccttaaggtctgtcctcaacccaccagccattgatactcttagaatgttatatgttatttctctgctcattgccttcccatttcacttcagatccaaatttcacagggcctagaaggccacatattattttatccccagtgatttctctgttcttagctaccatttccttatctactttactataaatgtgtgtacttccgtgctgttctttgaatataccaattgctcttgctcttgtgtctttgctcttgctactagttccatgacttgacttggaaaactcttccctagggtcttcatgactcttccttccttcctttagatctctcctcaaatataatattacttttaaggagagttacatgttaactattctatataaaataacaacaaccttcgtttcactcccagcttctctaggactgggaattcctttcttcgttaccctaatttattgtccttattatactgatagcaatttgacatactatgtattatttatcttcattatctatgtactgaaatgttaattccatgaaggcagcaacttggtttattttgttccctccaatatctctagtccctagtccaatgactgttatataataaatgtgcaataaatacttgaatgagtgatggattaatgtattagatgtgacttttatttattctggtaggtattccttcaatctgagaactttatttaattctaaaatattcccagcagttacctcctgaaatattgctttatttttcatccccatagttattacttctggaatgttgtaggcatatgttggagtttcccaaagaaacttgtctcaactgtgttttcatgtttttaatctcactattttcctgtgtagtgttctggatgaatcccttattactatcccttatttcactaatctctttttgtgtctagttttgagcttagtccatttagttgttttttacttcagtgattataattttttatcttcaagattttaatagcttctttacatctacctgattgtgtttcatctctcagctttacttttaacattagttattcttttgtctttacggacctttaacttacttattgtagtctttttcattatatttggttatttttattttttctagaggattgcatcttttgacttgaactagtatgtcagtgtatggggattcatgtattttgaatttttttgtttggggtcatatctcaagagggaagattgctgttattgttactgtttacttcctcctctttctccaccaccacgtccttaactaatgcctatctttttttctagaaattttatagttgcctttaaattgtcaatctcaccctagtctctttcctgaaataggttttatagaggttttgctacacctagcctcagttgcagggtgttttggctcaactcttgattggggagctacatctataaacttttgcctttctagactctaatataagccttggttctaggcaaggatgggcagaagcttttttccagcttcatttcatgagttagcattcccatcccacacaatgagcctggttgtgcttctgcatactgggtaaggcacttgtattccctattaaccccagaagtcaagctcctttccacctcagcctgcatctggctctgggggacagcaaatagtagcttcatccccatttatagttttctatttttgtttaatttgtgattctcacagatatagatttgtctgtttaattatttatgtttttctatgaataccatgtattttatttgtgaccttttaaaaaatgtaaatcagtgtccaatcaatttccccttatttataatataaattgactggtgtcagcctgattatacagtctcttcagacctttgttccttcctttcccttttcctcctttgctttataaagctatatttgtttaaaagctatatttgttttagaagatagtcattctttacaagtattgtgattttctgtttcccagagaactatgctttgattgtacaactaccatttagtttagttaatagtattctcagagactagaaatgtataggaaggtgtcagaaatcaaaaaattctagttatagggtatcgactataagtaaatctctgtcactctctcttttgagactcttaaaaaatggtaaattttatccttaatataattgtgtatatgaaagcttaaattaacaagaacatgtttacttaattgtaattattttcaaagcgatgacagtatggttattgcaatcaaggttaaactatgttttatgtaatttttatcatatacctaaatctagaaatgaaactgttcttttagtatgaagttgtcttagttttcagcagttgtaagttgctgtcacttgccatgtggtcaactcaagatgatttaattttctatattttaaagtgatattaatatttgggatatgaaaatttaaagtattagctaccagttatgactaataaactctctatattttatatctagagaaaaacagaaatctgaagctaaagacagaaaagttctagaaattctgcaagtcaaggatgccaaaatacaagaatttgaacaggttggtgttataataaaaatatttaaattaactatatttgttttgggtagtagatcttcaaaattatttttatttttttgcaatagtgtttattgagaatatcagggtccttatgttaaagcattactattttgaagtcactagtaagattattcttcatcattaatacttctcttgtacccttttgttttctgaattaatagattataactcttcatctaatgttacagttttataatagtatctagctattattctttattttgttgaattttgacattattagcagttatcatttacttctgaaacttgtaaattttcagatggttttatttgtagaaaagataaaaattgagatcctattatttacacttaaaacttgtatttttgtgttagtactatattaggctgttcttccactgttacaaataaatacttgaaactgggtaattaataagaaagaggtttcattggcttatggttctgcagacagtacaggatgcatagcaacatctgcttctgggaaggcctcatgtcagaaggcaaagcatgtgacacttcatatggttatagcaggagcaagagagagagacagggcatggtgagggaggtgccacagacttttttttaatttttttaatttttatatatatatttttttatactttaagttctagggtacatgtgcacaacgtgcaggtttgttacataggtatacatgtgccatagtgtggcgattcatcggtgatctagaactagaataaccatttgacccagccatcccattactgggtgtatgccacacacttttaaacaacgagagctcatgaaaactcactccctatgcaaaatcagcaccaagccatgagggatccaccctcatgacccaaacacccctcaccagcccccactttcagctttggggattacaattcaatgtgagatttgggcagggacagatattcaaactatatcaagtacagtcctatcttttatgtataatcagtaaattatacaattacatataattatatgtatatgtaatatgtaaaattacgtgtgattatataatcagtatgtaatcactgcaaaagtgcatgtggtcatgcttcctggaacaattttcaagatacaaacatttcaaaaaagaagtgaaagaaatttaagagtggctaatatcgttatataatatttaaattcattttatactcaagctcattacggagtaaataaattataatttttcttgggaggtacctttttggcaaccatgttcttttgacttttgaatttattttcctttctaaccaattaaaggttcatgagaactttgatctaggatcagttattgttataaagttgttttatgaaaagactaaaagttccattccctacatttctatctgttctttctaaaaaggaatattgattccaataaacttagaaatttgaaatttacacgttttccaaagttgagtttttcttatagaaaatgtcataattggtactatgatgataaaatgttaagaataacattttagtaaatttgttctggaaagaaacatttgtatttaccacccaagtatcaaacaacattaaaatgtactctaaaataggtaaatgttgtcatgtgcctggtatattaattggattaggctaagctgcttgacaagtacaaccttatgagccagacatggcagacatcatttgtatttacattttactggaaaaaaatttggccaccccaagattcaggcgatttgagaaaatgtagatacaagtttagcggtcccttcctcaattacacctctattctgttagagcaggaaaatctttaatatccttaggcattaagtttgcaatgctttagtgaatgctctttggtttaccagctttggataaccatagcacacccttagaaaatgttgccttttgtaaatgaaaatatattttccccttttctttgctaaattctttgtctacttctgcatccttgagtagggattgtttcattatttatcttttgagtggaatcacatagcttatatataacatattaaactctcataatagaaattatttgctttgtagggacccaaatttcttaggattaatcatttcatttttgtgcaatgatgattataactttctacaaagtatattttcagttaggtgcaacaagataatgtattaaatgtatatattatcctgtgatggtgttgtagaatattcagagttacatttcttgcctttaacgctttttaaatctctttgatgattaggtgatgatagaagtaaggtggaaattgccatattctcctacactactttgtttctatgagggcagagtctgtttctctttcatccactctttagtctcatacagacgactgtatacccagtacgtaattattaatagttatttcatagtcaggtccactgacatggacctgaattattaggttggcaggaattaaaggtatgtaaatggaaccataaggacttgatagtaattctgaaaatgactcttaggttttcagcttagagaaaccaggagaacagtggcgttattatcaaaaataggcttattttcaggaagtataaattgttttgaaggtaaggttttgagctcctcttagaaagtttgtgtttgagatgctgataggaattccatttagagatttttagcaaactgttggaagcatgaatctgatgaaggagttttgacctggagatgtgggtatttaatagtttagttagagggaagactttaagcagtgagaattttgagaacaagatatttactgatatttttaatgaggaaggaaaaattgtagtgaaagaggtgaaaagactttatagaagtaaggagagagtacaatgcaatatctcatgaattgagaagagagagtttcaagaagcaaaatgttgtcattgtcgtaaaatgctgcaaaaaatggagtgggtttttgaaaaagacattacatttagcagtcatgaagttttaaaatgaattttagaaagcaatacaacagggatggcatatgaaattttaagagatcattgaattctgacaaagtaatggaaaggaatgaagaaatgtgacattatggggtggggagatagtgggatggattgattgattgactgatttgttttaagtaatagctcacgcagtcgtgggctggcaagtaactctgcagggcagcctggcagaatggagacctagggaacagtttatgttacattgcaaatcctaaggtagcctggaggtagaatttcttcctcctctggggatcatagtattttcttggggccttcaactgattggatgaggccagcccacattatgaagggtaatctgcttttctcaaagtccattaatttaaatgttaaccacatctaaagaatactttcacaataacatctagactggtgttagataagaacgtgtgtaccatgggtagcctagccaaactgacatataaaattaaccaaatgggtaaaaacagctggggtaaataggttttatgtttatctggctagatattaggctgtctccactgttcgctgtggtatgagttagaggcagaactctggtatccgtgccttttatttgaatttttgtagagattttataaatatccttgatatgcataattcagttttcttaaaaagaaaaaccttagacaaattaaattcaatggagtttaattgagctgaaaaaaattcacgaattgggtaacactcaggaccaaaagtggttcatagagctctgctccgcagtgtgggctgggactgtgtacagccagacaatggaagtgacacacagaaatagccagattggttacagtttggtgtttgccttatttggacatgttttggcaatttgcacttgtgattggctgaatgcttggctgctgtgattggctgagactcggctactatacaaaaatatactctcaagtagggttgtgtttacatgttgttaggttacagttagctacctacagaggcaatttaatttaatagttgctatttaaactgctttgtttggtcaaacctattaattatacaatagtcccattgatgtggtggtggggtgttgggggaggagaggaagcggtctgtagtgttatgtttgggtttttttcatggtgagctgtgcttctggactgtgaccttcaaaagtgcttcttagttttttgtttgtttgtttcccccctccccttacccccttaggagagacaggaaggctagaaggtgctagagttgggtatttcccttttccaagttggttagttaggctcaggtaaaaccccatgagtctgggctctggtaaaatagtttttcttgatggcaggccttggtaagaagaaaagaatactctgagtgtgtttaaagatggttactttctccctccacatactggaaacaggaaggaataattgtgtgatcttccctgtgacaacatgacaggggtccagtaggttaaacttatgaaaatgtgtcacctcttattgttttatggttcctctgagtactgcttgcccccttcccccaagcatgactgagccatccttgagttttaaactctcagacttgtccatattgatcttccagtaattcattaattacagaataagtttttccaccctggtgctggctcctgtggaagttttttctcctgggcatctgttccattaagttgttattctctctattttcatgtctgtctcttcaattttgggagcgttggtttgctggatagtctcaattctctgatggatctgaaaagagttgttgattttcagtttgttcagcgttttttcttattgtgtaaatgagaaagatgactgccaagttccttatatgctggactggaaaccagaagccccctccattgaattgttgttgttccactgaaaaatattaaatagctcctaatgttcaagatttatagctatgagatagagtaagaattagaatgacaaatccttcagcttatttaactcttacttctgtatctagtgaaattactagaaagttacacacacacacagtttttttttagctgtttgcagaaaaactttcctagggtgcaatctaataattattagtataaagaattgcctttttttgggtaagactatgttttagctttgtcactgttataaaacaatgttaatacatttcccttctagtattgtgctttgatagcatgacttatgataacctagtaaattgtatttaattagatgataattgctctttaacattatatttcattttttccttaccttctaggaagctcagaagttttgtttcataattgcaattacttcttttatcccttcctttttctccacttatcattgctttagttattgtggtttaattactgctttgtttgttttttgttaaaagtttcatgtccattttgaaaataggtcagtataaataataaattaactatgctcaagtattgcctaatagagtttggggtttgggccttatgccccttccctaccccccacccatttttatgcctgcttcatactcactattattctcttgttactctgtagacttctcttgaccattatttgaattattcattcatttcatggcttatctgtaataaattatttgttccagacattctctctcttgtcatcccttattgctttatggttcctctgaattctgtttgctgttttaatattaactcaagccaggctattaagaatttacctgcctctattcagaaagatttgttgaaaaatattaataaagcttaattttaaaatgaactttaactgtatatgtctgtgctttcattatttatagagggtatattttattaggaaaatatgttgatttatacaaacttttacacttttagagtttatcagtgctcttgtgttgggagagaatctttgtctaacttattttctttaatgattttgtgatataagtaactatattatgcaatttaatattaaactaattatcggaatataataattttggttaaccaattttttaaattttattatgctttttaatttacagattgagtctgtgtttgtccttttgaattactattataagttcactcaaatgccaaaatctaaattattaaataattctcatgaaaggactctctattggtatcatttatattgtcagtgcctgtttagtttactttaatgggaaaactcttttaaaacttgtcatttggttcttcctagagtttaactaatttcagaatagacaagatatgctcaaattttgtcatttctccttcaaaggataggcttatgggtattttacaaacagttttaatgcttatattattgaatttattatttagtgtcaatttcatctgtaaacacttaacagtctagtttgggagatattatgagtagatagattattagcaacactcggtagtttgttgtgtatcaaatgtataatatagataatacaaaaatttagaaatggcaagaattacaaaatactgagatagtaagggaagcttttattgaggaggtggaagtcgagtcttaaaggggcataagacttagctgagagtagaaaaattgattgtaaattgtggaggagccatttttatgcatctatttttatgttatttgattgatgtcaggcacattttgatatggcctaataattaaaatagaacagaaaagttaaaaactgagatgctatttgtacttactggatttaaaaaaatttccaaccctgagagttaagtgttggtatggaggtagaataatgaaaactcttgaaatgcaaatagtctttgacttagcaatttcacttttaagtggatataatccagagaagtgttcttcaaacttttgttagtatgatccccacgctgaagtacattttacttcatgacccattatacacacatgaagtaagtttcgtataagttatttttactacatataattaaggtaaatatatgaaaatgtttatatcaaatgtgaatttactaatatttaaatacaataaaaatcttaaacatgataaaaatttagaaaataatttatgaagcatgtctgttttataagtttattcctttaactgtagtttcattgctaagaatgtgtgcctattaccttgatattttctattgtattataatccgtttaaaaaaatgccacttattgtaactaaatcgatttaatgacccattactagattgcagtctgcagtttgaaaaacactgcttgggagaaattcttggtcatgaatatttgcagtcatgctgaagagtgttcatagcagtattgtttgtatacccctttacctcaaatgggaaacagctgaaatacacactgataaaagatggataaatatagcatagttatctgatggactaatactgtacatcaagaaattgatctagttacattcattattatgaataaatttgggaacatatgttgagcaaaaatagcaagctatgtaatatgtgtaatatgatttaagttcagaagtaagcaaaactatacagcatattaaatagggacatatatctgtctttgaactataaagaaaagcaaggcaaagataagaatcagggtttcaggataatgcttacccttggagggaataagaggtactagaggataaagggtcatttatgagatatcaaagataatggtacagttgtgtttcctagctgaatgttggttacgtacaggacctctccttttacttatttttttaaaaaattatttacacactgatcacagattatttttgtatgtattcagcgtctaaattattttttaactataagtaaaataaaatcaataattaatattacacttttaaaaattagagtattggggttgggcacggtggctcacacctgttatctcagcggggccaagctgggaagattagttgagtccaggagtttgagaaggtaacatagtgagacctcatttctacaaagaaaattaaaaattagctgggttggtggcacatacctatggtccttgctacttgggaagctgaggtgggaggatcccttgagtccaggagttcgaggctgccgtgagccatgattgtgccactgcactccagagtgggtgacatgacagagcgagacctgtctctcaaaaaaaactaactaaataaaatagaatattggatatattttcactttattcctaaaatccacttttcatcataatcctggatcttcctctcattttcagtttattcccaagtcctttggagacaatttgataaggaagaaatgtgagagtataaaataaatcgatatttagggatcagcaccagtgatagatcagaaatggaataaaggtcaactgagcatattacttaaaaaaaaaaggtgtttctatcttgatgtgtctctttcttggttgacagacagaaggtgttattgagtctgacttggaggcttccaataattgtgtgaggctagatactatgtgtttaataaatattagttgaaagaatggatggattgataaaagttgaagaagtttaggaaagagatagtatcaggatatggatttcatttttagtaagttagtttgagatagtagacaatccaaagggagaggtcttgtatagctggaaatatgagattggtgattgggaaggtgagggctggattatagattagatagtctttcagacagaggaaagatcagcagccaagagaggtgctacattttctgagagaaaagatgtacagagaaacaaggaaagctaaaaattgagtctggggtacatccacctcgtaggtgtaatttaggtatctcacaggtgagaagaatgttcggttaaaaattttggcagccttaacattctaaatattctgtctacagagcaagatattattagtactaaaataaacttgccattttaaaaattttaaagtgatttatgcttttacaaaatcatagtttatcagaaaagttccttctaaatgacattcaaataaaagaataaggaattatgttagctataaatatattttctttaattagaatggttcgtaaaatcttgtttttctcctgttacacacctaaattttgaaaatttgctttctgagtatgatttaatatttaatatccagtttttatgtgttcttcaacataaataggccctgtacttgcacattttagttaaaaattcatgggcatgttacaggagatgagaattgtggtgacagacattattatgaaagctatttaatcatcacattagcaaatcaaaatgtaaaacctttaaaataaaatactgtttttcttagaaataaaagctcaccagtaatttaaatttttttccacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggtgtgttgacttgtacatagttttgtgggactgttgctttgaagttctgctttaagctttgttagcctttgtggcacagaaagtgacagatttggaggaaaaattgccttaggccctcctgtaccatacagttttctcacatgcaaaaactctgataaagatgctttaaagccagaactccaagctttataacttttagataaatagttaatgatggaaatggagctaagaaagtaggagtgtgaatatgtggcttcttgtaattagattctgatgggactggcattattaattgataaaacccaggtctgggaggatatgtctgtatgggtctcaaaaatagctggggacagcatcaaaggcagcttgatcaattaatgggctctttgcaaatgtgtactcatcaaagctgtcatccagtgaaaaaatatgacccatccacctgcatgaaaagaggccaataaaagtacacaggtgaccttggctatcaaatatagaagaagcttctgtgagggtaaaactgcacagtttgtatttgctgattagtgctcaccattttttgggttttttgtttcgttttgttttatttatttgcccttgtggtactgttctacaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaaggtatacaataggaatggaatccatactcctcttttggatctaactttttctaggaagtttaatacatgttattttctttaacaacttatatattcatatccaccagtggggactagcattaatttatattctttcacttaagacccatagctttttaaaaattgatgttgcaaagcaggaaactgacttcaaatggttatcctaaaatgtaatcattaaaaaataaaggctattgcattttgaaagaaaatgtgttttcaaataacatatttagaatcattggttttaactttttcacttaaggcttaagcttacaaagatagctataatttgttgcagtatagtttttaagactattttctagatcctttgaaatataaagtgtaaaaaatactaaacagttaaacaatacaaatacgtggttctatggtggtgctttctttgactttaaaggtgctttctttgactttaaagggccttatttatgggaaaattttatttttatagaagataaaagttacaatcaatctttataatcttataccctttttaaaaggctaatcaagtgaggcagtggtttcttacaattttattagtatttttcaaaataatacttttttatggcattctctttgtctttagaggtttttgctaatttcttttcttattaaattacatttttttttaaactatagattttgttgaaaagggcagacacagattttagtactagtaaatatggtggtctctccatgtatatgcccctacacacacacacacacacacacacacacacacacacacacacacacacacacggttagtcaacagttacaagcagttgaccatatgtatctgcaggttctgtatcagtggatcaagctattcagaaaaaaaaaacaacacaattaaaagtaacaatacaataattaaaaaaaacaagtaaaagatacagtataacaactgtttacattgtattcagtattttaagtaatccagacatgatttaaagtatatgggaacgtgtgtagggtatttgcaaatactatgccattttatataagagacttaaagcatccatggattttggtatttggagacccctggctgggttcaatcctccaggaatactgagggacgatggtaatatgtatggatatatgtgtgtgtatatgcatgtgtgcaagaatatttaagttaggggagaaggatacatctttctcggtgtataaacctgttgcagattatttatggaaatatttaagtctattagtgcacaatcatggggtgactgagccattgagagaactgaattctggtggatttattttcttaatttttatatcagtttctgcttctgtgcagcattaaaacaaattggaagtgtgataagggtaaatcagtacttgtattaattcacagctacatgattatttggtgataatttttatttccttatttattctacttgaataatcagttctgggatttgctgtgacttgtgttacatttttttctcatggggttattgtctttttcttattgctttttgggcattcattacttattttggatactaatacttcatatcttataaataccttctgttctacagacgttgaataaagaaaactggaatttcaaaagtttgtgaattttggtagtcattttattattttcttctcaaatgtttaaaggttttatatgacaaagtttttcccaccctaaagtctttaatctattcataatttatttttggatgtgatggtccacatcatttactcaatacccacggaagcagcaagattgttcactgatcttctcccagctttctcccatgaagcatggtcataaaagaattctcatagctaccttcctggaaagtagatcttatgaccctcattcagagaggttctgtcttgtacctagagtccaagaagaatctcaacaaacaggcctttctaataagtttattttaccacagaatcatatgcctttgtcctccagtcacagttttgcacgactgtccataaaaatacacagttttccctgagtcttctggtcttcatttccaacatcttctgtgtcatgtaaaactttggttaaataaatgttatatttttctcttagtaatttatcttttattactgggatgtcagccatgaactttgccatgggtaaggaaaagatactactttttatttcctacatgtatatatattttcatttctcttgggtatatacttaggagtgagattattgggtcatatggtaactgtttttaagcttttgaggaactgctagactattttccaaagcagctgcgacagtttacattcagacactttgaggattttgatttttcgatgttcacatcaacacttgtaattgtttgccctttttgttatagccacctcaggaatgtgaagtgatatctcattatggttttttatttgttcgtttgtttgagacagagtcttgctctgttgcccaggctggaatacagtggtgtgatctcagctcactgcaacctctgccttcccgggttcaagctattctcctcccgagaagaggcaaattactacaggcgcgtgccaccacatgcagataatttgtgtatttttagtagagatggggttttgccatgttggccaggctggtctggaatcattgtggttttgatttgcattttcctgatgggaaatgacggtgagcatcttttcatgtattactatctttggagaaatgtctattcaaatcttttgtgtacatactggatccacgttctttatcaagatatatacattgaaactattttttcttaaattctttgttactttttactcttttgatggtgttcttaaaataccaggttttagtttcgataatattttatttatctactttttttggtgttacccatgcttttgatgtcatatctaagaaaccattgctaatccaaggtcatgaagattgacacctttgttttgttctaggagttttatagttttatgtcttacatttcattctttgatacattttgagttaacttttgaatatggtgtgagatacaggcctaatgtcatgcttttgtatgtgttatttagttgtttcagcaccatttgttgaagaaaattcttttttccccactgaattgtcttgataccattattgaatatcagttgactgtaaatataagggttcatttttggacctcagttctgtttatttgatctatacatctgccctcctgtctatgccacattttcttggatgttgcagatttgtagcaagttttgaaattggggtatatgtgtcctccatattttttctttttctagattagttattctgggtctgttgtattttcatatgaattttacaattatcttttttcttctggccaaaaaggccatcagagagtttaatagagattgccttgaatcagtagatcagtttggggagtattaccatctcaataatattaagaatcttctgatccatcaacatgtgatgttttccacttattttggtcttcaattttttcagttgttttgtagctttcagggtataaatttgcacttctttgggtaaatgtattcctgaatattttattatttttgatgctattgtaatcggaactgttttaaattttctcttcagatcattcattcataatgtatacatacacaattgagttttgtatactgatcttgtatcctgcaacctttctgaataggttaactaattctgattttttttttcttagtaaattccttaagactttctacgtatcatatcatgacagctgcaagtagacatagtttcacttcttcctttctaatctaagtgcttttaatttcattttatttcatacttccctgctggaaaccctggtatagtgttaaatagagaaagagtggatatccatgtcttttcaaatacctatttgccatttgtttgtcttttgagaaatgtgtattcacatcttttgtcccttttaaaatcagataattagatttttttttcacatagagttgtttgagctccttatatattctggttattagtcctttgtcaggtggatagtttgtacatattgtcccattctgttcactttattgattgccctctttgctgtgcggaagctttttaagttgatatgatcccatgtgtacatttttactttggtttcttgtccctgtggagtattactcaagaaatctttgtccagtccaatgtcctgtagagttcctgcaatgttttcttttcctttttttttatttttgaggtggagtctcgctctgtcacccaggctggagtgcagtggcaagatctctgctcactgcaagctctgcctcccgggttcatgccattctcctgcctcagcctcccgaggagctgggactacaggcgcccggcaccacacccggctaattttttgtatttttagtagagacggggtttcatcgtgttagccaggatggtctcgatctcctgacctggtgatccgcccaccttggcctcccaaagtgctgggattacaggcgtgagccaccgcagccagcctgcagtgttttcttttagtagcttcacagtttgaggtctgtgacttaagtctttaatccattgtgatttgaattttgtacatggcaacagataggggtctagtttcattcttctgcatatgtatatccatttcccagcacagttaactgaagacactgtcttcccaaaggtattttcttggcacttttgttaacagtgagttcactgtagatgtatcactatatttctgagttctctattctgctccattggtctatgtgtctgtttttatgacagtaccatgtcattttggttattatagctttgtaatatgatttgaagtcaggtgatgtgattcctccagttttgttctttttgctcaggatagctttggctactctgggtcttttgtgattccttataattttcagattaaaaaaaattctgcgaagaatgtcattagtattttgatagggattgcatagaatctgtaatggctttgggcagtatggacatcttaacaatattgattcttccaatccatgagcaaggtatttctttccatttttttttgtatcctatctttaatttctctcatcaatgttttatagtttttattgtagagatctttaactactttggttaattcctaggtatataattttatttgtagctatcataagtaggattactttcttaatttttttcagattgtttgctgttggcctatggcaatgctactgatttttgtatgttaattttgtatcctgcaactttaccgaatttatttattcattctaataggtttttggtggactcttcaggtttttccaaatataagattatatcattggcaaacaaggatgatttgactatttcctttccaacttggatgtcctttctttctcttgtctgattgctctagggcttccagtactgtgctgaacaatagtggtgaaagtggatattcttgtcatgtttcagattttagcatcaagctttcagcttttccacattcagtatcatactagcttctgggctgtcatttatggcttttattgttttgaggtatgttccttttatatccagttttttgagagtttttatcatgacacaatgttgaattttatcaaatgctttttcaccatcaattgaaatgatcatgtggtttttttttttccttttgtctttgagatggagtctcgctgtgtcacccaggcgggagtgcagtggcacgatcttggctcactgcaacctccacctcctgggttcaagtgattcttgcctcagcttcctgagtaactgggatcacaggtatgcaccaccactgggcctggctgatgtttctttttttagtagagacagggttttgccatgttggccaggctggtctcgaactcctgacctcaggtgatctgcccacttcagcctcccaaagtgctgggattacaggcgtgagccaccacacctggccaggttttgtctttcattctgttgatatgatgtatctcatgatgtatcccaatgattgatttgcatatgttaaaccatccttgcatccctaggataaattgcacttggtcatgatgaatgatctttttgatttggtgctaatattttattgaggatttttggtatcagtgttcatcaggaatattggcctgtagtttcctttttttgatgtgtctttgtctggctttagtatcagggtaatactggccttgtagaatgagtttggaagtattcccttctctattcttcagaatagtttgagcaggattggtgttagctcttatttaaaagtttggtagaaatcagcggtgaagctgggagatgtcttttctggtagactttaataaggcttcagtctcattacctgttattgatctgttcaggttttggatttattcgtggttctgtcttagtaggttgtatgtgtctatgaatttgtctattctagatttttgaatttattagcatatagttgctcatagtagccattaataatcctttgaatttctgcagtatctgttgtaatgtctactttttcatctctgattttatttatttgggtttctttttttctgagttaatctggctaatgttttgcccacttagtttatctttcaaaaaacccagtttcttttcattgttcttttgtattgtgtatttcaatttcattgatttctgctctgatctttattatttcttttcttctaattttgcattttgtttgctcttgcttttctagttctttaggatgcattgttaggttgtttatttgttaggtgcttttttgatgtagattcttacagcataaaatttgcttttagtactactttcactgtagcccatagattttggtatggtgtgtttccgttatcatttgcttctgggaatttttcagttttcttcttaatttcttcattgacctactggttattcaggagcatattgtttaatttccatgtgatgtgtcatttccaaaatttttcttgttacttatttctagttttattccactgtggtcagagaagatgcttgatataattttagttctttgaattgtttacacttgttttatggtgaacatatggcctatccttgagaacgagctacatgctgaggaaaggaatgtgtatttcgcagccattggataaaatatggtgtaaatatctattaggtacatttgttctgtagtgcagatgagtctgttgtttctttgttgatttttggtctggattacctatccaatgctgaaggtggggtgttgaagcctccagctgttattgtattggggactatctttctttagctataataatattttctttatatatcttggtgctccagtgttgggtgcatatatatttatatttgttatattcttttgctgaattgacctctttatcattatataatgatctttatttctttttatagttgttgtcttgaaatctattttgtctgatggaggtatagctactcctgctcctttttggttttcatttgcatggaatatttttttcacccttttattttcgatctgtatgtatttttataggttaggtttttgtttttgtttttttttttgacacatggtctcgctctgtcacccagactggagtgcagtggcacgatcatggctcacttcagtctccacctcctaggctcaagcaatcctcccacctcagcctcttgagtagctgaggctacaggcatataccactatatctggctaattttttgctttttaatttttgtagagatgaggtcttgctatgttgcccagactagtctcaaactcctgggctcaagtgaccctcctgcctctgccttccaaagtgctggggttataggtatgcaccaccatgcctggtcccctgaagtttcttgtaggcaacagatcattgagtcttgctttttaaaaatatatatacgtggagagtttggtctgtttaccttccgcattattagtgagtgtttgtttcatttacctgtagcattattattgataagtaaggacttactcctgccatttattatttgcttcctggttgttttgtggtcttctcttccatgttttcttccttctgtttttcttttagtaaaggtgattttctctggtggtatgatttaatttcttatttatttatttttgtatccattgtatgtgtctttatttgaggttaccatgaggcttgcatgtactgttttatcacccattattttaaactgattacatcttaacactgattgcatatacaatttaagaaacactcaaagagaaaactaatataaactctaatcttcatcctgttttgtaacattttgttctttttatttatatcttattctactgtattatgttttgaaagttgtcacagttattttggtagatttaccttttattgcttttactccagatacgagtagtttacactacaattacacttttataatactctgtatttgtctatatacttattattgccagtgagctttgttcctttgtatgacttcttattgcttattaatgttgttttttattttctttcaaattgaagaattttttttagcgttccttgtaggacagatttggtattgatgtaatccagcttttgtttgtctgggaaagtcttttgtttgaaggatatttttgatggatatactattctatgttaaaagtttttttttttccttcagcactttaaatatgtcatgacactctctcctggcctgtaaagtttccactgtgcagtctgctgccagatgtgttagaggtccattgtatgttatttgtgttttttttttttttctgctgtcagtatcctttctttatccttggactttgggattttgattattaaataccttgaggtagttttctttgggttacatctacttcatggtctataacctttttgttcttggatattgatatctttccctaggtttgggatgttctctgatattatccctttgaatatattttctagcctgacctctctctacctctctttaaggcaagtaattgttagatttgccctttcactttattttctcaatcttgtgtgtgtgcttcattctttttcctcatttttcttttgtctcctctaactgtgtattttcaaacaacccgtcttcaatctaactagttcttctgcttgatcatttctgcttttaagagactgatgcattctttaatatgtcagttacatttttcagttccagaatttctgctttattctttttaataacttcaattccttttaaaaatatatctgtaggattcttaattccttatctgtgttatcttgactgcacttcctcaaagcaactattttgaattatctgtctgaaagatcacatatctgtgtctctccacgatttgcccttggttattcatttaattcatttggtgaggtcatgttttcttgaatggtttgatgcttgtggatattcattggtatccaggcattgaagagttaggtatctattgcattctttacagtctgggattgtttgtactcatctttctcaggagggctttcctagtattcgaagggacttggatgttgtgatctatgtctttggtcattgtagccttatctgcattagagggcaccgtaagccccgtaacactgtgcctcttgtagactcatagaaatactgccttggtggtcttgtgtgatatccgggagaatttcctagattactgggcagagactcttgttctcttcccttactttccctgaaacaaatggaatctttctctatatgagctgcctggatttagtgaatgggtgacacaagcacccctgtgaccaccaacattggaaaggagctgggtcatacttgaagctagtgcagcactggttctcactaaggcccatggataccactgtgtggtttttgcctgtgtttactcagggactaaggactccacaatcagcaattcgttaatccagcaagacctgtgtccttcccttcagtacggcaagtttgccctggccatgtgtagagaagccatccgggagtcagggcctggagtcgggaaaagtaggaatctacctggtcctctattccattatggttgagctggcaaccaagcatcaatacaaagtccttcccactcttctctcccttttcttcaagccgagaagtctctccacacgtccatcacccaagggctctttagtcagcaggagatgaatcctgttgggaccaggtctctccctcagaggagtgttttttttttctggtccagggcatggttagaaatgttgttcaggagctaggtcctggaatgcgtgcctcagggcactccctggtgccttattgtaatttggctcagctggtgtctaagttgcaagactaagtcctcttaattctctactctcctttagcagaaggtacgagtctctcctggagctgtgagctgcactgcctttgcttagatgatgggtgatacaagtattccctgtgctgccctgggtggtattttattaggtcacatgcacctcacgtccactggctctgagtctagcacaccaccaagactgcctgggaattgcaatccttgtggcctagactgcctttcaagtttatttaggacctcagatcaccttagctcattgtgacagggcttgcctgaactcagattccaactgctgggttgggagatttgcttctggctagggctggtctacatgttccctccatggtgccagctgagttctgccccatattgctttctactatgacagagtagcactgagttgtagtgcaaagttccacagtccctgtgctctgcctctcccaataacacaatttctgtctctgcaccatgcagctactgttgggggatagggaaggggttgtgtgtgttacttgagactgtctgtccttccttcttcagtgcctctttctttaatacgatgttaaaaccaggtactgtgattgctcacctgagttttggttcttaagaaggtacttttttgtgtgtggatagttgttcaatatggtgttcgtgcatggagaatgattgcttgaggcttctatttagccatcttgctccacttcctctcaccaggtgtttttcattatgaagggaatattggattttgccaaatacttttacttttttttttttttttgcatctattgaaatgatcatgtggtttctctgttctttctttttttttttttttgagacagggtctcactctgtcagccaggctagagtgtggtgggatgactcagctcactgccacctctgcttcctaggctcaaacaatcctccaacctcaaccttggaagcaggtggtactacaggcatcagccatcaagccttgctaattatttgtagagacagggttttgccatgttgctttggctggtctcgaactccttagctcaaagcgattcacctacctcaacctcccaaaatgttgggattacataggcgtgagccactgcacccagcctcgtctttcactatactggtgtggtgtactctattaattgatttttttgatgttaaaccaaccttacattattgagatacctttattttacacttgctttggtataaggattatgctgtccttacagaatgagttaggatgtatttacatcctcttctagttgttataacagttttagagggtttggtattcttcttcagaagttgggtagaattcaccagtgaagctacctgtccctgaatttttcttttttgggagattttgataactgattcagtctcttcatttgttatattggttaagacttttcttgagtcagtttaggtaatccaggtgtttctagctatttgtccattttatctaaattatttaatttgatggaaaattataatttataaatatttataattataaatatatttaataatttattatataaatatagaatatatactaaataaatggaatcaaaatgtgtcactataaaaaatcaactaagaaaatcaataatagaagaaatgaaggacaaaaatgctgttttatgtatatagagaaaaaataataaaatggcagcttccttattaatacttactctaactatctaataatccattttataaggtatttagcattatgcaaacctgaacggaccagtaatgagtagcaagattgagtcagtaacaaaaagtcttcaaacaaaagcccagaataagatggattcattgtaatatatctaataattctttttattatcttataatcatttttatttctttatagttaatcatagtgttctcatgtcattttggattttagttatttgcatccttttttttctttagtaatctagctaagggtttgcaaaattgaacattcttttaaggaaataaacttctgctttgattctcaattgtttttccatcccttctccttttaaaatttcaactctaatattcattatttattttcttctatgtttgagtttagtttgctattctgtttctgggttcttaagttactaggttctcaagatacaaacttaggatattaatgagatacatctttttaaaatgtaggttcttatggctataaatttccttctgagcaactgcatttgctacatggtatagttttgtcgtgttgtgtttctttaaaattcatctctaaatattttctaattcccttgtgatttcttctttgatccattggttctttgattgttttttttgttttttttttttgagctggagtctcgctctatcacccaggctggagtgcagtggtgcaatcttggctcactgcaagctctacctcccaggttcacaccattctcctgcttcagcctcccgagtagctgggactacaggtgcctgccaccacacctggctaatttttttgtatttttagtagagacagtgtttcaccatgttagccaggatggtcttgatctcctgatctcatgatctgccttcctcggccccccaaagtgctgggattacaggcacgagctgctgcatccagctgagtgtgtttttaaatttccacatacttgtgtattttcctttttcccttctgctgtggatttctagcttcattccattttatttagagaagatcctttgtgttatattactgttttaacattttttgtcagttattttatggcttaacttatggtgtgtcctggtgaatgtttcatatgtacttgagtagcacgtttattcagctgttttgggatagagtatttcgtatatgccttctaggtgtatctagtatgtaatgttgtttaagccatctttatccttaataaccttccatgtagatgctttttcagttatttaatgtggaatattgaattttcaactattattgtaaatttttctgtttctctgtcaattctttaattgtttgctctctatattttggggctctgttgtttggtgcctacatgtttattattgttataacttctcgataagttgattattagatcttttgtctcttgtaaccatttctgccttaaagtctcttctttctgatatgattatgtctaccccagctctcttctggttactattttcatggaatatctttttccatcatgttccttttaacttgtttgtatctttggatttaaagtgagtcttttgtagataacatattgttgtagaatgttttctttatgttttatgccaatctctttttttctgactggagaatttaattcatatatatttagagaaattattaatgaggaagaactaacttctgccattttttctttttacagctttttatgtctctcatttcctctgttattgctttccttagttgattttttctagtgacacatttcgattttgtttgtttagtatatatgttattgataatttctttgtgcttaccatgtagattgcacatatctttctaaatttatagcaataaaatttgaattgatacaaagtgtttttgatagtatacaaaactgttctcctctacagctttgtccatccattttatgttattgttgtcacaagttatatcttacacatgtgtacttaatgtgtaaaaagtttatacactatttatgtagtttttatgtagtttatatagtttttatgtgtttgtttttgaaatcatataggaaataataaggataattagaagccaaataggtaatactggcttttatatttgctcacctatttacctttactagaagtctttatttcttcatatggatttgagttactgctttacatcctttcatttcaatctgaaggattccattttgcatttcttgtagtgcatctgaagtggtaatgacttctctcagtttttatttgtaaatgtcttaatttctccctttttaaggacagtttttgctggatagaaaattcaaggttaatatttgttttttccttattacgttaaatatgttatctcagtgcctctgtacttcatggtttctggcaagaaatcagcttttactctcattaaggatgccatgtatgtgatgagtcacttctttcttgctactttgaagattgtctcttttttgtaggctgaatttcaagagtttgattataatgtatctcaacatgaatctattttgttgatcttacttggagtttattgaggtttttggatttgtagattcatatctttcatcacattttggaagttttgggccatcatttattcaaatagtatttctaccattttcttggtcccttctcctgttgggattcccataatatgtgtgttggtctgcttggtggtgtcccactgatcactttttttcttttttctctctttatgctctttagactcaatgattttaattgttctatcttgtagttatctaattactttttgtgctgaaatctgctgctgaaccctctagtgaaaattttatttcagttgtatttttcagctcctgaattacttttgtgtgtgtattttgttcctttttttccctttcattgatatgtaataatctacctatttatgggctatatgtgagtgtttgttacatgcatataatttgtaatgatgaagtcagggtatttggggtctccgtcaccttgagtttttatcagttgtatgtgttggtatcatttatagtctctttcagttgcttcgaaatacatgtgacgttgttcccaagtataggaacctgagtgtgctatcaaacactagaacttatttcttccatctaactgcatattagttccaataaccaacctttatacattcccactctcccactttcccttcctagtatatggtatctatcactgtattcccaagcaccacgagataaggtttttagcttacagatgtgagtaaaaatatgcagtatttgtctttctctgcctgccttatttattgtaatgaccttcagttccatccatgctacttcaaatggtatgatttcattcttttttatgtctaagtagtattccattatttatatatacaccacattttctttatgcattactttggtttgtggatacttaggttgatgccatatctttgctattatgaataatgccacaataaatgttcaattgcagcaacctatctctttgatatactgatttcttttcctttggatagatacccagtagtgggattgtgggattgtatggtaggtctgtttgtttttttgagaaatttccatactctttttcttagttgttacactaatttacattttcaccaacagtgtataagagttctgttatatacgctgttgtatcctcacttacatctgttattttctgtccctttaataatagtcattcgaactaggatgacatgacatctcattatggttttgatttgcattttcctgatgattaatgatgctgagcatttttcatatacctgttggccatgtgtatatcttcttttgagaaatgtccatttttgtacatgttataatgtgattttttaaaaactgttgagttctttgagttccttgtcgattctagttactagtcccctgttgactgagtaatctgcaagtattttaactcattcaaaaggtttcttgctactttgaagattgtctgttttttgtaggctgaatttcaacctattttttcttttgctgtgcagaaggtttttatttaatatagttccatttctctatttttatttttgttgcctgtgcttttgagttcttaggcataaaatctttgcctagaccaatgtcttggagagttttctctatgttttcttctagtatttttctgtttccatgtattacaattaagcctttaatccatcttaagtttatttgttgtatggtgagagatgtgtccagtttcattcttttactcatggttatctagtttttctagcaccatttattgaagaggcgctatcctattctatcgccaatgtatattcttagttgctttgttgaagatcagtcagctatgaattggtggatttacttctgggttctatattttgtttcattggtctatgtgtctatatttataccaacaccatgctgtttcagttaatatatccttgtaatatgttttgaagtcagatagtctcatacctccagcttggttcttttgctcaggattgctttgggtattcaggctcttttttggttccatatcaattttagaattgttttttctatttctgtgaaaaatgatgttggtagtaatagagattgcattgaatctagattgctttgggcagtttggtcattttaacaatattaattaatctgacccatgagtgtgatatgtttttcttgtttgtgtcctcttcaatttctttcatcagtgttttgtttgtttgttttgtagagatcttaaccctccttggttaaatttaatcccagatatttatttgtgttttctgtagcttttggaagtagaattgcttttttgatttcttcttcagctatttcattactaatgtatggaaatgctacttattttgtacatgattttgtatcctgcaactttactgaatttatttatcagttctggagtttttctggtagagtcattaaaaaaagaaaaagatgtaagatcatgttgtttgcaaagagggacagtttgactttccctttttcaaactggatgtcttttctattgttttttttttttcttttgcctgattgctctgactgggacttccagtactgtgttgactagaagtggtaaaactgggcattcttgtctagtttaaattattataggaaaggtccttaatttttccccatttaataggatgttagttatatgtttgatatatatggtctttattatttggaggcatgttctttgtttgcctagtttgttgacagtttctataatgaaggtgtgttgaattttatcatgatttttctgtattaattgagatgatcagattatttttgtccttcagttcattgatgtgatgtgttacatttgttgatttgtatatattgaatcatccctgcatccctgggacaaatcccagttgaacatatttgtattatgatgttgaccatcttttcatatgcttcttggccacttgtatatcatctttggagaaatatctattgaagtccttttgttgcctttttaatctgttcattgtgtcctttgatgaacaaaagttttcaattttgaggtagtaccatctgtatgcttttggcatagtcccaattttatgtttttgcttttgttgtctatgcttttggtgtcatttgcaagaaatcattgccaaatccaaaatcatgatgtgtttctgctatgttgggaattttctagttttggcttttatattttggtctttaatccatttggaggttttttttttttcttttgtgtgtatggtgtaagggtccaaattcattcatttgtgagtagatatctagtttttctggcaacatttgttgaaaaggctgccctttagtcatcagttggtcttggtacctttgtgaaaagtgatttgagcacatatagaaatgattatttctaggctatttttcattggtctgtatatctgtatgtcagtacaatactgttttcattactgtagctttgtaatacattttgaaatgaagaaatatgagttctccaatattgttgtttttcagaattgctgtggctgtttggggttgcttaagatttcatatgaattttaggatggtattttaactttctgcaaaaagtgtcattgggatattgataaagagtgcattaaatctgtagctcacttttggcgttttttacatcttaacaacattgtcttccaatccagtgacatgagatgtctttccatttatttgtgtcctctataatttctgttaataatgttcatagtgttcagtgtacaagtctttcacccccttggctagatttatttctagtatttttttcagttgtaaatggaattgttttcttaatttccttttctggttattcattgttagtgtatagaatcttaaggttttctacatatacatgccatcagcaacaagagataattttacttctgcctttttgattaggatgccttttatttttcttgcatagttgctctggctaggacattaaataaatactatgttgaataggagtggtgagagtgggcaacctcatcttgttcctgatcttagagaaaaagcttttagtctttcactattgagtatgatgttagctataggctttttgtatttggcctttgttatgttgaagtagcttccttctattcctagttggtgggtgttcttttaatcatgaaagggtgttcaatcttgtcaaatgttttttctgtatcgagtgaaatgcttgtatgatttttgtcttttattctttcatcgtggtttatttcataaattgaattttgtatgtttcaattccccttgcattcaaggcataaattccacttggtcatgttatgtaaccttttttgctagtattttgtttatgatttgtgcatcaatattcatcagataattggtctctagttttcttctagtgttgttttctagcgttggtatcaggatgatgctctcctcatagaaggagcttgaaaatactctccgtacttcagttattggtagagtttgaggaggattggtgttaattctttaaatttttggtagaattatccagtgaaaccatctagacccatgctttgttgataggtttttgattactgattcagtcttcttacaagttactgttctgtcagattttctgttttttcatatttcagttttcataagtgtgtttctaggattgtatatacttcctttggattatccaatgtgttagaatacaattttgtatttgttagaatacagattttttagaatacagttttgtatttgttagaatacagttgttcttagtattcttagttttccatttctgcatcactttgctgaggataatggcttccagctaaatccatattgctgaaaaggatatgatttttttaactgctacatagtattccatagtgtatatgtattatattttatttatccagtctgctattgatggtcacctaggttgattccatgtctttgctattctgttgtgatgcatatacaaatacatgtgtgtttttggtagaaaaatttatttttctttggctactgagtaatcccagtaatgggattgctggatcaaatggtagttctatttttatttttagctctttgagaaatctccaaactgctttccacagtgactgaactaattttcaaacctaccaacaatgtataaacattgccttttctccacagcttctccaacatctgttatttttgactgtttagtaaaagccattatgattggtgtgagatggtatctcattgtgtttctgatttgcatttctctgatgattagtgattttgagcatttctttcatgattgttggctgtttgtatgtcttctctttttttttttagtgtaaagctcttagttgtcttttatttgcaattctagaatcatgcagcaactcattctgtaaggcagaatgtgtattcaaatgagccgatctggggaggttggttttatagacagaaaagggcagagaaaagcagaaacagaaaacaaaatgtcgtttaaaagttacttttcttgtacaactcaaagcagaggggatttggggatttctttatccagttttcactggcctgtttcgatatttgactgtttctctctcttgattttttggaaggtcaaataatttagtttctgcttggtggcctggaacttcagaatgaatgattccattttggtttggtttgttgggcctagtgcaggagctcagtccagaccaatgacctcctatacattttgtttaacattttttttttattattatactttaagttttagggtacatgtgcacattgtgcaggttagttacatatgtatacatgtgccatgctggtgcactgcacccactaactcgtcatctagcattaggtatatctcctaatgctatccctcccccctcctcccaccccacaacagtccccagagtgtgatgttccccttcctgtgtccatgtgatctcattgttcaattcccacctatgagtgagaatatgcggtgtttggtattttgttcttgcgatagtttactgagaatgatgatttccaatgtcatccatgtccctacaaaggacatgaactcatcattttttaaggctgcatagtattccatggtgtatatgtgccacattttcttaatccagtctatcattgttggacatttgggttggttccaagtctttgctattgtgaataatgccgcagtaaacataggtgtgcatgtgtctttatagcagcatgatttatagtcctttgggtatatacccagtaatgggatggctgggtcaaatggtatttctagttctagatccctgaggaatcgccacactgacttccacaatggttgaattagtttacagtcccaccaacagtgtaaaagtgttcctatttctccgcatcctctccagcacctgttgtttcctgactttttaatgatcaccattctaactggtgtgagatggtatctcattgtggttttgatttgcatttctctgatggccagtgatgatgagcattttttcatgtgtttcttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtgggttgcctgttcactctgatggtagtttcttttgctgtgcagaagctctttagtttaattagatcccatttgtcaattttgtcttttgttgccattgcttttgttgtttcagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtatcatgatgccttcagctttgttcttttggcttaggattgacttggcgatgcgggctctcttttggttccatatgaactttaaagtagttttttccaattctgtgaagaaagtcattggtagatttatggggatggcattgaatctgtaaattaccttgggcagtatggccattttcacgatattgattcttcctacccatgaacatggaatgttcttccatttgtatcctcttttatttcattgagcagtggtttgtagttctccttgaagaggtccttcacatcccttgtaatttggattcctaggtattttattctctttgaagcagttgtgaatgtgagttcactcatgatttggctctctgtttgtctgttgttggtgtataagaatgcttgtgatttttgtacattgattttgtatcctgagactttgctgaagttgcttatcagcttaaggagattttgggctgagacagtggggttttctagatatacattcatgtcatctgcaaacagggacaatttgacttcctcttttcctaattgaataccctttatttccttctgctgcctgattgcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtacaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatccgggatattggtctaaaattctctttttttgttgtatctctgcccggctttggtatcagaatgatgctggcctcataaaatgagtttgggaggattccctctttttctattgattggaatagtttcagaaggaatggtaccagttcctccttgtacctctggtagaattcggctgtgaatccatctggtcctggactcttttttgttggtaagctgttgattattgccacaatttcagatcctgttattggtctattcagagactcagcttcttcctggtttagtcttgggagagtgtatgtgtcgaggaatttatccatttcttctagattttctagtttatttgcgtagaggtgtttgtagtattctctgatggtaatttatatttctgtgggatcgctggtgatatcccctttatcattttttattgcatctatttgattcttctctctttttttctttattattcttgctagcggtctatctattttgttgatcctttcaaaaaaccagctcctggattcattaattttttgaagggttttttgtgtctctatttccttcagttcagctctgatgttagttatttcttgccttccgctagcttttgaatgtgtttggtcttgcttttctagttcttttaattgtgatgttagggtgtcaattttggatctttcctgctttctcttgtgggcatttagtgctataaatttccctctacacactgctttgaatgcgtcccagagattctggtatgttatgtctttgttctctttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagttttttataatttctgttcttttacatttgctgaggagagctttacttccaaatatgtggccaattttggaataggtgtggtgtggtgctgaaaaaaatgtatattctgtatgtcttcttttgacaagtgtctgtttatgttctttgcccactttttaatgggatcatttgtttttttgcttgttgacttaagtttcttatggtttctggatgttaaacctggatgttagaaccctgttagatgcataatttgtgaaaattttctcccattctgtatgttgactgtttactctttgatagtttctcttgctatgcagaagctctttagctatgcagaagctctttagtttaattagatcccatttgtcaatttttgttgcagttgcttttgatgtcttcatcataaaatctttgccagttcctgtgtccagaatggtattgcctaggtggtcttcaaaggtttttttagcttttgttttcatatttaagtctttaatccatcttgagtatggtgtaaggaaggggtccagtttcaatcttccgcatttggctagccagttatctcagcaccatttattgaatagggggtcttttccccatttcatgtttttgtcagctttgttaaggatcaggtaattgtaggtgtgcaactttatttctgggttctctattctgttccattggtctctgtgtctgtttttgtaccaatagtaccatgctattttggttactgtagccctgtagtatagtttgaggttggataatgtgatgcatctggctttgttcattttgcttaggattgctttgtctaattgggctttttggtttcatataaattttggaatagtttttgtaattctgtcaaaagtgacgttggtagtttggtaagaatagcatcgaatttgtagattccttcatggagtagggccatcttaatgatattgattcttccaatccatgagcatggcatatttttcaattggtttgtgtcatctatgatttctcttatcagtgttttgtacttcttcttgtaaagatctttcaccttcttgtttagatgtactcctgggtattttgttattttttgtggctattgtaaatgggattgtgtttgatttgctttgcagcttgaacattattgggatttagaaatgctgctgatttttgtgcattgatttttgtatcctgaaactttactgaaattatgtattccctaggagacttttggtggaatttgtagggttttctatgtatagaatcatatcatcagtgacaaggggtaacgtgacttcttttcctatttgtatgtcatttatttttttctcttgactgattgctctggctaggacttctagtactatgttgaataggagtggtaagagtgggcatggcttctaattaaactaaagaggttctgcacagcagaagaaactagcatcagagtgaacagtcaacctacagaatgaaagaaaatgtttgcaatctaccattctgacaaaggtatccagaatctacaaggaacttaaacaaatttacaagtaaaaaacaaccccatcaaaaagtaggcgaaggacatgaacagacacttctccttcaaaagtggacatttatgatgccaacaaacataggaaaaaagcttatcagtagtcattagagaaatgcatatcaaaaccactatgagataccatctcacgccagttagaacagcgattattaaaaagttaggaaacaacagatgctggcagtgctatggagaaatagaaacacttttacactgatggtgggagtgcaaattagttcaaccattgtggaagacagtgtggcgattcctcagggatctagaaccaggaacaccatttgacccagcaataccgttactgggtatatactcaaagggttataaatcattctactataaagacacatgcacacgtatgtttattgcagcactatgtacaatagcaaagacttggaaccaacccaaatgcccatcagtgatagactggataaagaaaatgtggtagatatacaccatggaatactatgcagccataaaagagaatgagttcacatcctttgcagggacatggatgaagatggaagctatcatcctcagcaaactaacacaggaacagaaaaccagcactgcatgttctcactcataagtgggagttgaacaatgagaacacatgaacacaggaaggggagcatcatacactgatgcctgttgtggggtagtggggaaggggagggagagcattacgacaaatacctaatgcatatttcggggttaacacctagttgatgggttgatgagtgcagcaaacatcatggcacatgtatacccatgcaacaaaccttcacgatctgcacatgtatctgagaacttaaaaaaaataaaataaagaaaagaaagattaggtatctctgtatttttccagttcttaaagggaatgcttccagcttttgccagtatgatcagtatgatgttggctgtgggtttgtcgtagatggctcgtagtattttggggtgtgttccgtcaatacctagtttgtcgagagtttttatcatgaagggttgttagattttatcaaaagcttctctgtgtctattgagatgatcatatggttttgtttttaattctattttataattgagttttaaaatctaatttatctaaaggtttatcaatttttttaattttattattattatactttaagttttagggtacatgtgcacaacgtgcaggtttgttacatatgtatacatgtgccatgttggtgtgctgcacccattaagtcgtcatttagcattaggtatatctcctaatgctatccctcccccctccccccaccccacaacagtccccggagtgtgatgttccccttcctgtgtccatgtgatctcattgttcaattcccaccagtgagtgagaacatgtggtgtttggctttttgtccttgcgatagtttgctgagattgatggtttccactttcatccatgtccctacaaaggacatgaactcatcattttttatggctgcatagtattccatggtgtatatgtgccacattttcttaatccagtctgtctttgttgggcatttggattggttccaagtctttgctattgtgaatagtaccacaataaacatatgtgtgcatgtgtctttatagcagcatgatttataatcctttgggtgtatacccagtaatgggatggctgggtcaaatggtatttctagttctagatccctgaggaattgccacactgacttccacaatggttgaactagtttacagttccaccaacagtgtaaaagtgttcctatttctgcacatcctctccagcccctgttgtttcctgactttttaatgatcaccattctaactggtgtgagatggtatctcattgtggttttgatttgcatttctctgatggccagtgatgatgagcattttttcatgtgtttcttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcgaaaattttctcccattttgtaggttgcctgttcactctgatgatagtttcttttgctgtgcagaagctctttagtttaattagatcccatttgtcaattttggctttcgttgccattgcttttgttgtttcagacatgaagtcctggcccatgcctatgtcctgaatggtattgcctaggttttcttctagggtttttatggttttaggtctaacatttaagtctttaatccatcttgaattgatttttgtataaggtgtaaggaagggatccagtttcagctttctacatatggctagccagttttcccagcaccacttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtatcatgatgccttcagctttgttcttttggcttaggattgactgggtgatgtgggctctcttttggttccatatgaactttaaagtagttttttccaattctgtgaagaaagtcattggtagcttgatggggatgacattgaatctataaattaccttgggcagtatggccattttcacgatattgattcttcctacccatgaacatggaatgttcttccatttgtatcctcttttatttcattgagcagtggtttgtagttctccttgaagaggtccttcacatcccttgtaatttggattcctaggtattttattctctttgaagcgattgtgaatgtgagttcactcatgatttggctctctgtttgtctgttgttggtgtataagaatgcttgtgatttttgtacattgattttgtatcctgagactttgccgaagttgctcatcagcttaaggagatttggggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcattgttgaattttgtcaaaggccttttctgcatcttttgagataatcatgtggtttttgtctttagttctgtttatatgctggattacacttattgatttgcgtatgttgtaacagccttgcattctagggatgaagcccacttgatcatggtggataagctttttgatgtgctgctggattcggtttgccagtattttattgaggatttttacatcaatgttcatcaaggatattggtctaaaattctcttttttttgttgtgtctctgccaggctttggtttgaggatgatgctggcctcataaaatgagggaggattccctctttttctattgattggaatagtttcagatggagtggtaccagctcctctttgtacctctggtagaattcggctgtgaatccatctggtcctggactctttttggttggtaagctattgattattgccacaatttcagagcctgttattggtctattcagagactcaacttcttcctggtttagtcttgggagagtgtatgtgtcgaggaatttatccatttcttctacattttctggtttatttgcttagaggtgtttgtagtattctttcatggttgtttgtatttctgtgggatcggtggtgatatcccctttatcattttttattgcatctatttgattcttctctctttttttctttattattcttgctagcggtctatcaattttgttgatcttttcaaaaaaccagctcctggattcattaattttttgaagggctttttgtgtttctatttccttcagttctgctctgatgttagttatttcttgccttctgctagcttttgaatgtgtttgctcttgcttctctagttcttttaattgtgaagttagggtgtcagttttggatcttcctgctttctcttttgggcatttagtgctataaatttccttctacacactgctttgaatgtgttccagagattctggtatgctgtgtctttgttatcattggtttcaaataacatctttatttctgccttcatttcattatgtacccagtagtcactcaggaccaggttgttgagtttccatgtagttgagtggttttgagtgagtttcttaatcctgagttctagtttgattgcactgtggtctgagagacagtttgttataatttctgttcttttacatttgctgaggagagctttgcttcccagtatgtggtcaattttggaataggtgtggtgtgctgctgaataaaatgtatattctgttgatttggggtggagagttctgtagatgtctattaagtctgcttggtgcagagctgagttcaattcctgggtatccttgttaactttctgtctcgttgatctgtttagtgttgacggtgggatgttatagtctcccattattattgtgtgggagtctaagtctctttgtaggttactcaggacttgctttatgaatctgggtgctcctgtattgggtgcatatatatttaggatagtgagctcttgttgttgaattgatccctttaccattatgtaatggccttctttgtctcttttgatctttgttggtttgaagtctgttttatcagagactaggattgcaacccctgcctttttttgttttccatttgcttggtagatctttctccatccctttattttgagcctatgtgtgtctctgcacatgagatgggtttcctgaatacagcacactgatgggtcttgactctttatccaatttgccagtctgtgtcttttaattggagcatgttgcccatttacatttaaagttaatgttgttatgtgtgaatttgggcctgtcattatgatgttagctggttattttgctcgttagttgatgcagtttcttcctatccttgatggtctttacattttggcatgtttttgcagtggctggtaccggttgttcctttccatgtttagtgcttccttcaggagctcttttagggcaggcctggtggtgacaaaatctctcagcatttgtttgtctgtaaagtattttatttctccttcacttatgaaggttaggttggctggatatgaaattctgggttgaaaattattttttttaagaatgttgaatataggcccccactctcttctggcttgtagagtttctgccgagagctccgctgttcgtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtgtttcctgaatctgaatgttggccaaacttgctagattggggaagttctcctggataatatcctgcagagtgttttccaacttggttccattctccccgacactttcaggtacaccaatcagacgtagatttggtcttttcacatagtcccatatttcttggaggctttgttcgtttctttttattcttttttctctaaacttctcttctcacttcatttcattcatttcatcttccatcactgataccctttcttccagttgatcgcatcggctaatgaggcttctgcagtccacgtagctcttgtgccttggttttcagctccatcaggttctttaaggacttctctgcattagttgttctagttatccattcgtctaatttttttttcaaacttttaacttctttcccattggtttgaatttcctcttgtagcttggagtagtttgactgtttgaagccttcttctctcaacttgtcaaagtcattctccatccagctttgttccgttgctggtgaggagctctgtcctttggaggaggagaggtgctctggtttttagagtttccagtttttcttctctgttttttccccatctttgtggttttatctacttttggtctttgatggtggtgacttacagatgggtttttagtgtggatgtgctttttgtttgttagttttccttctatcagacaggaccctcagctgcaggtctgttggagtttgctagaggtccactccagaccctgtttgcctgggtatcagcagcggtggctttagaatagcggatattggtgacccgcaaatgctgctgcctgatcgttcctctggaagttttgtctcagaggagtacctggccatgtgaggtgtctgtcagtctgcccctactggggggtgcctcccagttaggctgctcgggggtcagggaccctcttgaggaggcagtctgcccgttctcagatctctagccgcgtgctgcgagaaccactactctcttcaaagctgtcagacagggacatttatgtctgcagaggttactgctgtctttttgtttgtctgtgccctgcccccagaggtggagcctacagaggcaggcaggcctccttgagctgtggttgggctccacccagttccagcttcagggctgctttgtttacctaatcaagcctgggcaatggcaggcactcctcccccagcctcgctgccaccttgcagtttggtctcagactgctgtgctagcaatcagcgagactctgtgggcgtaggaccctctgagccaggtgcgggttataatctggtgtgccgttttttaatcccgtcagaaaagtgcagtattagggtgggagtgacccgattttccaggtgctgtctgtcacccctttctttgactaggaaagggaactccctgaccccttgtgcttcccgagttaggccatgcctcgccctgctctggctagcgcacggtgcgctgcacccactgtcctgcacccactgcctggcactccctagtgagatgaacccggtacctcagatggaaatgcagaaatcacctgtcttctgcatcgctcatgctgggaactgtagaccggagctgttcctattcggccatgttggctccatctgtatcaatttttaaatatctcttccaaatccaactcttatttaaaattttttttctattgttttgttatttaattaaccactactctaatctttcttatttcctttcttctgctaacttttggttcaatttgttcttcttctaattgtttccaatgtgtaaatttaggttgttgagatttttcttcctttttaatgtactacatacttaacagctataaacttgcctcttaccattcctttttctgcatcccagaagttttggttttggtatgttttctaatttttatttgtctcaaggtattttctaatttctttctttcatgatctcttgtttggtcaattggttgtttaagaatgttttgcttaatttccatgtggatgaaaaatttccagttttccttctgtaattgatttctggttttattacattgtgatcagaaaaaatactttatataattttagtattttaaaaattgttgagccttgttttatggtctgtcatggagaatgtttcatgtgccattaagatgaatgtatattctgttgttgttgagtggaatattctgtattattcttttagttccatttgttctgtagtgttgttctactcctctatttcattattttggttctagaccaccacaataaagggaatattgtaataaagtgagttacacaagtgtttttggtttttgacttcatataattatattgtacatttgttttaagatttatttctggttattttatgtttcttgttggtattgtaaatgtttagttttatagaaaatcatctgagttttgcacagtcatcttttataatcttgctcaactctagctctaagtgcttacactttgtttttgtttttttggtggaagatcatattggctgctaataagaatggtttactctttctgttaatatttatatatttaatgtctgttcttttttcccttctcttagtatattacctaaaatccccaggacaattttaatataaaaccagtttgttcttgattttttaatgaacatttcaccattaattatgatatttgctgatttttggcattcatattactaaagtaagaaaattcttctgtattcctattttgttgttagtttttgtttttaaatcgtaaggtgttggattgttttggatgatttttctgactctattggcatcttcatatttttttcctttaatctcttaatgtggtaaattatattaacagattttctaatgttaaggcatccttatatttctggaaccaaatcatctcaataaattacccaaatctttcttcaatactagtatagcttattttggatttttgcatctatatgcctaagtgatattgccctgaaatgttcctttttatgtccttccctttctaacgtggataacaggtcatttcataaaatgagttgagaacatccttttaaaattctgtgtaatgtttctcacaagatgggggttattcatttattgtaatgtttatagaccttacctttaaacctttaggaccagataaggtgtttttttgagtcagcttcatataattgattaaatgtgttgatatttgtaacattttaaattatccttttgaaattttctattttttctttttttgaatttttaaatttagaatgtgtaatatagtcgcatggctcaaaactgaacaagatatagtgggaaacaatgaaaagttttaccttaattttgtattaatatcaagggcatttccttcagagaggagttctttttttttttttttttttttgagacagagtcttgctctgtcgcccaggctggagtgcagtggctcaatcttggctcactgcaatctcagccttccgggttcacaccattctcctgcctcagcctccggagtagctgggactacaggcacccgccaccacgcccggctaattttttgtgtttttagtagagatggggtttcaccatgttagcctcgatctcctgacctcgtgatctgcccacctcagcctcccaaagtgctgggattacaggcgtgagccaccgcgcccagcactatttttgttttttaccttgggagcatgatttgtgggggcgcaccataaatcatgcaccagatttgcggttcactgaccttccaaaaatggaaacccaggctggaattctgtgtgagggctagctttaggaccacctgtactaaggggtgcattttcctccttcgttttctttctttctttgcttagtattacaaatgaagttctgttacttattctggattccattctagtaatttaggtttttcatgaaaattgttctagatttgtatacttactggaaaacttgttctagtattttctaatgattaaaatacatatattatatccaccagaagctgacatttggatttctgttttcagcctatctttcttgtagtctgctttatcatgatgaatggatccaccattcacctctttgctcccaggccatatccctacgagagatctttaattcctgtttttatcttgcaactccacagacacttatcaacaggtcctgtcatttttaccttcagaatatattttaaatttgactcttcatcacctctgttattacttatcaagccaccatcagctttggctggattattttcaataatttttgatttggttcctctatgtctactcttcacgtaaaatagtagttttttcattttagctgcctggttgttccatttttgcttcataatatttgtctattttagtatattctgtatatttatagtccttttgaattggttcccatatttgcattttgctaggatagtgtcccctccctccctcccttccttccttttttccttccttccttcctctctctttcctttctgtcctttctttccttcctttctttccctccctccctccctcccttccttcctttctttcctttggtgcgatttcagctcactgcaacctccgcctcctgggttcaagcgattcttttgcctcagcctcctgaatagctgggactacaggtgcgtgccaccatgcccaactaatttttgcatttttagtagaggcggggtttcaccacgttggctaggatagtctcgatcagttgacctcgtgatctgcccgcctcagcctcctaaagtgctgggattacaggcgtgagtcactgcgcctggccagataatgtttatttctgattgttcacttcattgactctgtttttgaaggttagattttgaagggtgtgtcttgatgggaatgttttaccatcctctatttctaccctggtgttcgtttatcgcttttaagctattttgaggttcctggtactttttggtacctcagtctggagctagatcttctttccagcctgaggcatcttgtccctccctgatatttggcagaaatcagattgaatcttgagatgagcagctttacccagatcctatctgtggtgtgttaaaaaatttcttctgtgtctccagaccatagtcataatctgtttttggtttcttttttaagagtatgagagcccttctgtagtccccagtttcattttctgagtttggattctttcccctgctaagcataaaaatacatttactcctaactgtcagtagttgaacatctgccacctctgtatatgttgggcacaaagatagagtaagtttttaaaaaggcttgctttccctccctccctccttctgcccttattttctcccctctgtcttcctctccttcctccatctagttgtttataaacctttgttatttatctatcattgtcttttctttttttacagataattaggaatttctagtgctttatctaaaacttggtgtttatgtttggaaataatgaatgtatggtgtttctgttggcatactttatttagatatatatttagttctttgcaaaagtaattaaaattaattttataatatatttaaaacacctaattttaaaatcctttcacaatgaaaaatatttagagaatgatcaggaggaaaagatcagctttcaagaactttaggtaaatttcaccacagtcaagagaattgaacacgatctgagtctcaaactctgaaaaacttttttgatgtctttgaagcactgtcctttcttcttgaaatgtatctgtgtatttgcacttcaaacagagaaaacagggaaataagtaaatgtctataatttgttgtgattaatgttgaagtaaatgagttcatttttgttcagctaatgtattactttattgtacaataatttaataactacattttttatacatatcttctagtttatttgcttcagattcttaacttttacaccaagaggccatgatgtttttaagtttttgaaagaaaaaatctgtgactggtataaaagttattgtttgtgttaaaattattttaagtaagtgaaaaaattaaaactatttttctctgtcattttgtagaataattaaatataacagatgttttgttacatgtagtatttattatgtttgattattgatataagcactctaattttagacctttgaagacaatttaattgaagcaaggaaagaagttgaagtatcacagagtaaatacaatgctctatcattacagttgagtaataaacagactgaacttatccagaaggatatggatattaccctggtcaggcaagtatattcaatttttaatttaacatcatagaaatgtcattagttattcagaatgataccatttatacttattactaacaccctaaaataataactatgttttctgtggttatatatgtttgtgcattgagaatctggagttatttacactaacttgaaaaattgcctggaagaatgagtgggtctacaggattggacgagcatggtcaaggggtaccctagtttcagtttttaacaaggatattgcaatgctttcattcattgttttcttctaacatttctagccatgtgttacatgatgctcatattgttacagtgaacaatagtaactgagaaacaaattttgactttaattttattatattctatatagtttgttttaaagcagtctttctatatcaacataattgattttgtaatactattcataaagttggattacttgaaaaaggaagcacgatactcttgtatttctgttttttaaagatgttaaaactattaatttactttgtaattaccttttccagaaaatagtatgagagagaataaattaagacagaacttttccttggttcatagatcaatatctatctatctatctatctatctatctatctatctatctatctatctatgtatctttctatctatccatccatccacatgcatgaaaggacatgcatgcatgtttgtatttattttgcatgcatgtgtttatttattttggtagcaccagagcatgggatcgaagatatgcttctagaggtatataatagagtttgattgtataatttattttaatttaaaaactaagtgataaataaatgatggatacatcactgccattctggtacacattgggtggagttctttggtaaaacttgtctgggaattttccttcatgttagtgggcattggtaagggggtcaagttagtgctgtttatgacgtagtttttatagttccattaggcaaaatacagttttgtaaatttaaatatgccattgtgaatttagtttggatgaaaactgtttaccattactgaagccaataaagttaaaatgaattaggacattaacagattccttgtatcacattttaaaaactttctcatcataagggtgaggaaaagtataaactttatagatgatagactggttaacatatcaactcatgttataattatttttaaaacaataacgaagtcagaaaagtaattctaaataggaatagaatcttagatttggatgaaatttaaaaattattatttattcttatcctcttcctagtaagattgcatagcgtttagtctttccttgaaaacttagtttaaaagtttctgatgcttttcaagactgctattttcattttatattgtttaaatttttgaacattgttttacatgtacttagttgaaatttgcctttttataattcccacccatttattgtagttttattatctggagaatctcagaaaccatctaatccctattctgtaacatagctcagtggtctcagacatttatcaatgacaacattttttcactaattgatcaactactcctatttcttacataaactctccatgtacatatttcacagatgttatcatgttttgggttacctttctgactgttttccatattgtcaatcttcttaaaatataacatctggaactgcataaaatatttcaacaaagacctttacattttagagtatgatggtgctaggctattagaacaaacatggtgttcattctaggatacagtgcagtgttaaggacatgggatataacaactatgttttcttctacattttgcgtgagtttgtatatttaaatttagtgtattgcaagagctgtaagttattataaataaagcaagaatatccttgcatgcactttttcttatacaatagtaaaagaataatagctagtgggccatgtgtaattctaagagtttgattataaggacctatagaggcatatggcctatgtgaattaatgcaggaacaaaaaaccaaatacttcatgttctcacttataagtgagagctaaacattgggtacccatcgacataaacgtaggagcagtagacactgtggactactagacggtgaagggagtgagggtgcatgggtggaaaaatctacctgttggatactatatttaccacctgggtaacaggatccataccccaaatgtcagcatcaagcaatatagccaggtaatagtactacacatataccccctgtatctaacataaaagttgaaattttgaaaataaggactcacagaggagaagaataatagcacagagttggtagtttggagcagtggactttctcttgaatcctcattatagggtagtagttgagatgtctacagtgtgtctcctaagttatcttgtatgaggattactgttggatatactgtgtgtcttgtttctttcatcattatttcactgggagagggtggttatgatataccagtcccagtttattgaatctttatgttgtaatcaagacatatgaagccataattgtggaaaaagtggtctaggcactttcttatttggatacacttttcctcactgataaatgatggagctactgtttctgtatggatttccttctttgaagttcatagtcatttatattttattgaatatttgatccatgtcacccattgtgctaaaggatatttttgtgaactctacctcaaatgatttttgcctaggttacagtataaataagtatatacagtcattccttggtatctgtgggggattggtttcaggcctcaatatggatactaaaatctacagatgctcaagcccttgatataaaatggcagtatttgcacataacttatgtgcatcctcctgtatacttcaaatctttagattgcttatattaatagtatcaaatacaatgtaaatgctatataaatagttgttatactgtattttttgtttgtattgttttgttgttatatttttaaaattactgtttttgatctattgttggttgaatttgtggaagcagaaaccacagatatggaagtccaactctatgcatatataatgatgtacatgtctgtaatctgtatagagcatatgaatatatttacctagccattgcattaaaaaggataactaattaaattgcctaaccaaaacttttacctgatggtaatgatggagctactgtttctgtatggatttccttctttgaagttcatagtcatttatattttattgaatatttgatccctgtcacccattgtgctaaaggatatttttgtgaactctacctcaaatgatttttgcctaggttacagtataaataagtatatacagtcattccttggtatctgtgggggattggtttagatggggtagatggggtagaaccattacctaatggttctacaattgagatgagaatttttgttagaaattgagtcaagacagtgcagtcataattttggttcagaaaatcttcagacagaatcctgaaattggattaatacatctggattgctggttttctcagatgcttagcagaagcaagtgagttttctttggagaatgataaaataatctggacttaaattatatctaaagttttacaaaatagggtctagcacatagtcagaaataacaagtatgtagtaaggaaagaagaataaaaagatataagacctagaaatgaaagcagaaatcctagttatttggtaaaacatgattaattcacgtagagaacccaaaataatttatatatagtttaaactaataagtttatcatgcttggtggatacatggtcagtatataaaacttaattgcatcttttataccagcgaaacatattaggaaataagaatttacaatattactggaggtatgaagtgcacatataatgaaaaatgtgtattacctctattcagagaattctacaaatgttgagaaaaatagaaggtgtaatatattcagggaaatatcaaagttcatggtttggaagactcactatcataaagataccagttctctctgaatagatattagattcagaaaatgctgaccatcgattatcaacaacaggaaaccattaccacccttagccagaagggacaagaattagtatcctgtgacggaagctgcccaataagaccaataaccttagacagaggaacacaggcactatcaaactgtggctcagcagagagtgagctgggtaaataaatatccggacctctttctcctttaccctggaatcaccagctagtgcctccaactgatgaaattcagtcacagccagagaacaaggagcagtataactagtctgtagagaggttgggctcttaggctaagcagagtagagatgatgaagactggcccattctcagttactactctttttcagaacttttctggccattattccctgttagtttttgcatatgaactttagagtaaacttgcttattttttctttggtatgttagtagcacataaaatttacaataatctaagaagaattgacatctttatgatgttcagtcttcttgtcccagagtgtggtgtgtcattccatttgtttcagtctacctctgtgtctttcctcaaacagattttgaacatttctcatcaaatttattcctagctctttcatgtttcttgttactattttaaatgtaatttttccttcccatataattttcaaatgatttttcttttactgcatatagttttactgtacagcttttttggtggataaaaataagttgttttgtttttactgtgaactgtgctatagttattttggtataaatgataaacgtgaattatgtaaaaataaatacatgcagtacagaaaagtacaaagaaggtaaaagaaaaaaacgttagactaaaaatgcatccctagagaattaacagccataaaattctgtgagcattgttctacatttttctcagtcctgatttataaattgaagattgggtagacagatgtttttaaataaaagggactatattgcacatgttcttttggtaactaataattttaggtttttttttcatataatgaaacaataaggctctctgatgtgaaattgaggagattattacatcttagataattattttttctctataaggaacactatctttctaaaactaagaacaaactgatacgaaaaaccttggcgattcatgttattatttttttttaaactacatttcatctgtagttgattttggcactctgctctgtatactctggaaataagcacataaattcaaccattttgactccccccaatttgtatcttaagaattacagcatttatcttctcttgtataaccacagtgaacacagatgtttaggcataattctatatagtacttcagtgttcatcactaaacttttttactcttgatttgttcattccatcctgtttgttttgattcatctcatgagcccatttttaccagggccttccctattgctaccatatgcttttctgcccctgttggcatccaatttagccatgtgacttattttggccagtgaaatgagaggctttgcaaatgttttaaaggagccgttgtttgatttgcctttgcttttcacctttttccaggagaacagcctatttccactatagtctgatgctccagtttggttcttagaacagagaaaagcaaatgtaatgtgaagaagccatagatctttgtttttggaaggtgtcaggtttttttttttttcctgcagaattatgtagagcagctgctcgaaaccctctgttagtgtttcctgtcaaacctggtctttaaagggatagtcctaatttaatcacatggcctactcaactcctgagacagcatcactgcaatggtttgaatatttgtcccatccaaagttcatgttgaaatttagtcctcagtgtgggacattgggctctgccttcatgaatgaattaatccaattctcatgaatgaattaatccactcaggtattaatgggttattatgggaatgcgactgttggccttataagacgaagagagacctgagctagtatgctcagcttctttgccatgtgatgtctggcactgcctcaggactctgcatagagtccccatgaggaagaaggtcctcagcagatggaacccttcaaccttggacttctgtaagaataactgtaagaaataaattcctttttctttataaattacccagttttagggattctgttataagtaacaaaaatggactaaaacaatcactagtaactgaaagattattagatttatatttcagcagtaaaatatattctacagaacttaacatccttcatgaggtgggaagaagtattgttggttctcagtatcttctctttcaactaacctagattgtccttaattccctttgatctgtatctagaggaacttctcaagtttgaacctaacaattttatgttccataactttgattttgcttataactactctcattatggatttaaagctatgatggcatttttttttctttgtatcaatccttttttattatctttttcatttcattcattcaacaactgtttttacatagcctagtaaacagggcctgagtcacggattacatactgattacttgggagattcacttccagtacagagtgggcaaaagtacaagaatctgaggcagggaaggataaaaagtaattcgaggtaatgcattgttgttctggccattgcttcatgataaaccgtgaagacatcaggtcactgacttagccacccaagaactgagaaactgtgccctagagcaagccatcagatggaagaagataatttatctctctggtttccttttgtgttttgtcttccagtttgttgttcataccatcccctgtatagtagcattgtttatcccagtctggaaatggtaaatgcagaaaaagactctaggcatgcagctggttatcctcacgtgatggagtcatttgaactgtatatatctggtaggctgatgtagcaattagtaggctgaggcagagagatggactcaaaattctagtagctagctgaggttgaatctcaaaagatgcataagacacatatttaataagagacaggaactgtcctaggtgctctgtttatagcagtgaacaaaaaaagttcctgctctcacagagatgtccttacatcttggctttctattggtatttcacagcggcataatggcttattttttgtactttttcttcacttttcttctaagttcttatgttactcctactgagaggtatactcttcctctaagtattcacaattgcatttcgtttttcttaattttattacccccattccttttagatgtcctgttattttattttattttttaaaaattaattttgtttcaagttccaggatacacgtgcaggatgtgcaggtttgttatgtaggtaaatatgtgccatggtggtttgcagcacctatcaatctatcacctaggtattaagccccacatatattagctatttatcctgatgttctccctctccccgcacaccaccctccccactgacaggccccagtgtgtattgttcccctacctgtatccgtgtgttctcattgttcagctcccactacgtgcagtgtttggttttgtgttcctgcgttagtttgctgacgataatggcttccagctccatccatgtccctgcaaaggacatcatctcgttcctttttatggctgcatcatattccatgttgtatatgtaccacattttctttatccagtctatctttgatgggcatttgggttgattcaatgtctttgctattgtgaatagtgctgcaatgaacataacacgtgtatgtatctttataatagaatgatttatattatattgggtatatatacccagtaatgggattgctgggtcaaatggtgtttctggttctaggtctttgaggaatcgccacactgtcttccacaatggttgcactaatatacattcccaccaacagtgtcaaagcgttcctgtttctccacagcctcgccagaatctgttgttccttgactttttttttgtttgttttgagacgaagtctcgctctgttgccaggctggagtgcagtggagcgatctcggctcactgcaacttatgcctccccagttcaagcaattcttctgcctcagcctcctgagtagctgggactacaggtgtgtgccaccatgcccagctagtttttgtatttttagtagagatagggtttcaccatgttggccaggatggtctcgatctgttgaccttgtgatctacccacctcagcctcccaaagtgctgggattacagagtgagacaccgtgcctggctgacttcttaataatatccattctgactggtgtgagatggtatcttattgtggttttgatttgcatttctctaatgatcagtgatgttgagctttttttgatatgtttgttggcatcataaatgtcttcttttgagaagtgtctgttcgtgtcctttgcccactttttaaatggggctgtttgtttttttcttgtaaatttaagttccttgtagattctggatattaggcctttgtcagatggatagattgcaaaaattttctcccattctgtaggttgcctgttcacttgatgatagtttcttttgttgtgcagaagctctttagtttaattagatagcatttgtccatttttgcttttgttacaattgcttttgatgtttttgtcatgaaatctttgcccgggcctatatcctgaatggtttcagtagatttccttctaggatttttgtacttttgggttttacatttaatgagtctttaacctatcttgaattgatttttgtataaggcataaggaaggggtccagtttcagttttctccttatggctagccagttttcccagcagcatttattaaatagagaatcctttccccattgcttgtttttgtcaggtttgtcaaagatcagatggttgtagatgtgcggtcttatttctgagatctctgttctgttctattggttcatgtgtctgtttttgtaccagtaccgtgttgttttggttactgttgccctgtagtatcgtttgaagtccggtagtgtaatgccactggctttgttcttttcgcttaggattgtcttggctatacgggctcttttttggttccatattaattttaacgtagttttttctaaatctgtgaagaatgttaatggtagtttaataggaatagcattgaatctataaattactttgggcagtgtggccattttcacgatgttgattctttctatccatgagcatggaatgttttttcatttgtttttgccctctcttatttctttgagcagtggtttgtagttctccttgaagaggtccttcactctttcacttctcttgttagctgtattcctaggcattttattcttttcttagcatttgtgaatgggaagttcattcatgattgggctctctgcttgtctattgttagtgtatgggaatgcttgtgatttttgcagttgattttgtatactgagactttgctgaagttgcatatcagcttggaaagcttttgggctgtgatgatggggttttctagatatagaatcatgtcatctgcaaacagagacagtttgacttcctctcttcccatttgaataccctttgtttctttgtcttccctgactgccctggccagaacttccaatactatgttgaatagaagtggtgagagacagcatccttgtcttgtgccagttttcaagggaaatgtttccagcttttgcccattcagtatgatattggctgtgggtttgtcataaatggctcattattttgaggtatgttccatcaatacctagtttattgagcatttttaacatgaagcgatgttgaattttatcgaaggccttttctgtgtctattgagatgatcatgtgtttgctgtctttagttctgtttatgtgatgaattagatttattgatttgtgtatgttgaaccagccttgcatcttgggaatgaagctgacttgatcgtggtggataagctttttgaatgtgctgctgtattcagtttgccagtattttattgaggattttgtttgtttgtttgtttttttgagacagagtttcgctcatgtttcccaggctggagtacaatggcgtgaccttggctcactgcaacctccacctcacagattcaagcacttctcctgcctcagcctcctgagtagctgggattacaggcgcttccagtatgcctcgctaatttttgaggattttgcatcaatgttcagggatattggcctgaagtttttattttctcagggtttggtatcaggatgatactgacctcataaaatgaattagggagcagaccctccttttcaattgtttggaatagtttcggaaggaatggtactagctcctgtttgcacctctgatagaattcagctgtaaatccactggtcatgggcttttttttggctggtagggtatttgttactgccccttcagaacttgttattggtctattcagggatttagcttctccctggctcagttttgggagggtgtatgtgtctaggaatttatctgtttcttctagattttctagtttatttgcatagaggtatttatagtattatctgaaggttgtttgtatttctgtggggtcagtggtgacatcccctttatctttttttgttgtatctatttgattcttttctcttttcttattagtctagcttgcagtctatccattttattaattttttcaacaaacggcttctggattcattgatttttttggaagggtttttcatgtctgtatctccttcaattctgctctgatcttggttatttcttttcttctgctagtgttgtggtttatttgctcttggttctctatttcttttagttttgatgttagggtgtcaacttgagatttttctagctttttgatgtgggcagttagtgctataaatttccctcttaacactgctttagctggatcccagagactctgtgtgttgtctctttgttatcattggtttcaaagaacttcttgatttctgccttaattttttttttttttaattatactttaagttttagggtacatgtgcacattgtgcaggttagttacatatgtatacatgtgccatgctggtgcgctgcacccactaactcgtcatctagcattaggtgtatctcccaatgctatccctcccccctccccccaccccaccacagtccccagagtgtgatattccccttcctgtgtccatgtgatctcattgttcaattcccacctatgagtgagtatatgccgtgtttggttttttgttcttgtgatagtttactgagaatgatgatttccaatttcatccatgtccctacaaaggacacgaactcatcattttttatggctgcatagtattccatggtgtatatgtgccacattttcttaatccagtctatcattgttggacatttgggttggttccaagtctttgctgttgtgaataatgccacaataaacatacgtgtgcatgtgtctttatagcagcatgatttatagttctttgggtatataccaagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttcttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattgtctcccattttgtaggttgcctgttcactctgatggtagtttcttttgctgtgcagaagctctttagtttaattagatcccatttgtcaattttgtcttttgttgccattgcttttggtgttttggacgtgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccacttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaggaaagtcattggtagctttatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcagttgtgaatgggagttcactcatgatttggctctctgtttgtctgttgttggtgtataagaatgcttgtgatttttgtacattgattttgtatcctgagactttgctgaagttgcttatcagcttaaggagattttgggctgaaacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgctgaattttgtcaaaggctttttctgcatctcttgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattcaggatttttgcatcaatgttcatcaaggatattggtctaaaattctcttttttggttgtgtctctgcccggctttggtatcagaatgatgctggcctcataaaatgagtttgggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcgctggtgatatcccctttatcattttttattgtgtctatttgattcttctctctttttttctttattagtcttgctagtggtctatcaattttgttgatcctttcaaaaaaccagctcctggattccttgattttttgaagggttttttgtgtctctgtttccttcagttctgctctgatgttagttatttcttgccttctgctagcttttgaatgtgtttggtcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttattgctgccttcatttcattatgtacccagtagtcattcaggagcaggttgttcagtttccatgtagttgagcggctttgagtgagattcttaatcctgagttctagtttgattgcactgcggtctgagagatagtttgttataatttctgttcttttacatttgctgaggagaactttacttcccagtatgtggtcaattttggaataggtgtggtgtggtgctgaaaaaaatgtatattctgttgatttggggtggagagttctgtagatgtctattacgtccacttggtgcagagctgagttcaattcctgggtatctttgttgactttctgtctcgttgatctgtctaatgttgacagtggggtgttaaagtctcccattattaatgtgtgggagtctaagtctctttgtaggtcactcaggacttgctttatgaatctgggtgtcctgtattgggtgcatatatatttaggatagttagctcttcttgttgaattgatccctttaccattatgtaatggccttctttgtctcttttgatctttgttggtttaaagtctgttttatcaagagactaggattgcaacccctgcctttttttgttttccatttgcttggtagatcttcctgcatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggttattttgctcgttagttgatgcagtttcttcctagtctccatggtctttacattttggcatgattttgcagcggctggtaccagttgttcctttccatgtttagcgcttccttcaggagctcttttagggcaggcctagtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctggaggagtgtctttgtggcgttctctgtatttcctgaatctgaacattggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaccttcccttctcacttcatttcattcatttcatcttccattgctgataccctttcttccagttgatcgcatgggctcctgaggcttctgcattgttcacctagttctcgagccttggttttcagctccatcagctcctttaagcacttctctgtattggttattctaggtatacattcttctaaatttttttcaaagttttcaacttctttgcctttggtttgaatgtcctcccgtagctcagagtaatttgatcgtctgaagccttcttctctcagctcgtcagaatcattctccatccagcttttttccgttgctggtgaggaactgcgttcctttggaggaggagaggcgctctgcatttaagagtgtctagtttttctgttctgttttttccccatctttgtggttttatctacttttggtctttgatgatggtgatgtacagatgggtttttggtgtggatgtcctttctgtttgttagttttccttctatcagacaggaccctcagctgcaggtctgttggaataccctgccatgtgaggtgtcagtctgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaaggaagcctgggcaatggcgggcgcccctcccccagcctggctgccgccttgcagtttgatctcagactgctgtgctagcaatcagcgagactccgtgggcgtaggaccctccgagccaggtgtgggatataatctcatggttcgccgctttttaagccggtctgaaaagcgcaatattcgggtgggagtgacccgattttccaggtgcgtctgtcacccctttctttgactcggaaagggaactccctgatccctcgcgcttcccaggtgaggcaatgcctcgccctgcttcggctcgcgcatggtgcgtgcacccactggcctgcgcccactgtctggcactccctagtgagagaaacccggtacctcagatggaaatgcagaaatcacccgtcttctgtgtcgctcatgctgggagctgtagaccggagctgttcctattcggccatcttggctcctcccctgatttctgccttaatttcattatatacccaggagtcattcaggagcaggttgttcagtttccatgtagttgtgtggtttgagtgggtttctttatcttgagttataatttgattgcgctgttttctgagagactgttatgatttcagttcttttgtatttgctgaggagtgttttactcccaagtacgtgactgattttagagtaagtgctatgtgctatgtgtcgccaagaagaatatatattccattgtttttgggtggagagttctgtagatatttatcaggtccacttgatccagagcttagttcatgtcctgaatatccttgttaattttgtcttggtgatctgtctaatattgacagtggggtgttaaaagtctcccactattattgtgtgggagtctaagtgtctttgtaggtctctaagaacttgttttatgaatctgggtgctcctgtgttaggtgcatatatatttaggatagttagcagttcacattgaattgaaccctttaccattatgtaatgcccctctttgtcttttttgatccctgttggtttaaagtctattttgtcagaaactaggattgcagcccctgcttttttctgctttccatttgcttggtatattttcctccattcctttattttgagcctatgtgtgtctttgcatgtgagatgggtctcttaaatccagcacgttgatgagtcttgactctttatccagcttgccattctgtgtcttttaatcggggcatttagcccatttacatttaaggttaatattgttgtctgtgaatttgatcctgttatgatggtagctggttatcagacttggtgatgtagttgctttatagtttcattggtctttgtacttcagtgtgtttttgcagtggctagtggtggtttttcctttctatatttagtgcttccttcaggagctcttgcaaggtaggcctggtggtgactaattacctcagcatttgcttctctgaaaagtattttatttttccttagcttatgaagcttagtttgactggaaatgaaattcaggattggaaatccttttctttaagaatattgaataatggcccccaatctcttctcgcttgtagggtttctgctgagaagtttgctgttagtctaatgggtttccctttgtaggtgatctcccctttctctctggctgctgttaacattttttttcccttcattttgaccttggtgaatttgatgattatgtgtgttagggctgatcatctcatggagtatcttacgagggttctttggatttcatgaatttgaatgttggcctatcttgttaggttagggaagttttcctagatgatatcctgaggtatgttttccaccttggttctgttctccccatctctttcaggtatccaagtcagtcataggttcggtctttttacataatcccaaagttcatggaggttttgtttcttttcattcttttttctctcgtcttgtctgccttgtcttatttcagcaagataggctttaagctctgaaattctttcctctgcttggtcagtttggctgttgatacttatggttgcattgtgatgttctcaggttgtgtttttcaactccattaggttatttatgttcctttcaaactaattattctggttaacagctcctgtaatgttttatcatggttcttagcttctttgtattgggttagaacatgttcctttggctcagctaagttcattgttacccaccttctgaggcctacttgtgtcagttcatccatctccacctccgcccagttctgtgctcttcctagagaggtattatgatcatatggagaagaggcactttggctttttgaattttcattgattctttctcatctttgtgagtttacctagctttgatctttcagtttgcgaggacctttttgttgatgctgttattgttgttgctttctgtttgtttttcttttgacattcaggcccctcttccggagggctgctgtggtttgctgggggtcactccagaccctattcacttgggtcccttctgcacctgcaggtatcaacagtggaagatgcagaatagcaaagatggctgcctgctacttcctctggctgggatcttcgtcccagaggggcaccaacctgatgccaacaggaatgctcctgtataagttatctggcaacccctgttggggtctcacccagtctggaggcaggggttctgggatctgcttaatgaagcattctggctgccccttggcggagcgggtgcgctgtgctgtggcgaatctcaatcatctggactgcctggattcctcagagctggcagggggaaagtctaagtctgctaatctgtgaatactgtggctgcctctcccactagaggctcagtcccagcgacatcagagttctgtccctaaacccctggctgcagttgctgaaattcctgcaggaaggtcccacccagtgaggagggatgggttagggttccgcctgaagaggcagtctggccatgatctgccatagccatagccactgtgagtgctgtggggaattccatctgggtccaaaccatctagtcttcctggcactggcaggggaaaattggcagactggagctgcagtgatggctgccaccccttgcccctactccccgggaactcaggcatcttaggcaaaaggcagggtggtgatgatgacctccccttccattaggaagttggtagtcgtaggtagtcaccagcccattggctgctgagaggccaccaagaggctgccgagaatctggacagctctgcacttgggacccaaggccctggtggcatgggctcattgggggacctcctgatctgtgggtagcacggatccgtggaaaaagcgtggtttcccaggcagggtagtagtgtgtccagaattggtgcgttcttggtctcactgacttcaagaatgaagccacggacccttgcggtgagtgttacagttcttaaaagcggcgtgtccggagtttgttccttctgatgttcagatgtgtttagagtttcttccttctggtggattcgtggtctcgctggcttcaggagtgaagctgcagaccttcgagtgttacagctcataaaggcagtgtggatccaaagagtgagcagcagcaagatttattgcaaagagtgaaagaacaaagcttccacagtgtggaaggggacccaagggggttgccactgctggctctggcagcctgcttttattgtcttatctggccccacccacatcctgctgattggtccattttacagagagccgattggttttacagagagctgattggtccattttgacagggtgctgattggtgcgtttacaatccctgagctagacacaaaagttctccaagtcccactagattctttagatacagagtgctgattggtgcatccacaaaccctgaggtagacacacggtgctgattggtgtgttcacaaaccttgagctagatacagagtgctgattggtgtgtttacaatcccttagctagacataaaggttctccaagtccccactagactcaggagcccagctggcttcacccagtgtatcccgcacaggggccacaggtggagctgcctgccagtcccgtgccctccaccagcactcctcagcccttggatgggactggctgccgtggagcagggggcagagctcgtcggggaggctgtggctgcgcaggagcccaccgcggggggagtgaggggagggagggggggagggtgggggggagtgggcgaaggggggagggcggggaggaggggggagggcggggaggagggaggagggcggagggagtggggggaggggggagtggggagtggggggagggcgggggggagtggggggagggcgggggaggctcaggcatggtgggctgcaggtccccagccctgccgcacagggaggcagctaaggcccggtgagaaattgagagcagcgccggtgggccaacactgctgggggacctggtgcactgtccgcggctgctggcctgggtgctaagcccctcactgccgggctggcggggctggctggccgctctgagtgcgggccgccaagcccacgcccacccggaactctagctggcccgcaggcgctgcacgcagccccagttcccgcccacgcctgtccctccacacctccctgcaagctgagggagccggctctggccttggccagccaagaaggggactcccaaggtgcagcggcgggctgaagggctgctcaagcgccgccagagtgggcgccgaggccaaggtggcgcggagagcgagccacgactgcgagggctgccagcacactggcacctctcagtaggtcgatcactcaccatttcccttggctggtggtaggagctcgcattactctgtgtggctcccaggtgggccgtcgcaccaccctgcttttccttgctctctgtgggttgtgccagctgcctagtcagtcccaatgagagaacttgcatacctcagttgccggtgcaggattcactcattgtttttgttcttcttggtggggggcctccgaccacagctgtttctagtcggccatcttggcccgccctgtttttctttacttattttcaaatgaggaaagatctggacaaattcagtgctttccgctggttcagatgtgtgagttgtgcgagctttgcttgctttttgtatttgcaacattggtgtacatatcatcacttgtactttcccgagggttgtgtggggcgatagaaataaacatatctacatagtataagagtatccttcaattccacttattgagagcatgcccagaaaataccatgaggtggtagagaaaaatgtgctttttcccaggttgatttttaatttgcaaagagtaataatagtatgagcatctccctactcttcagtgagagagagagagagagagagagagagagtgtgtgtgtgtgtgtgtgtgtgtgtgtgtgtgtgtgtgtgttagatggagtctggctctgtcacccaggttggagtggggtggtgcgatctcggctcaggatcaaatgattcctctgcctcagcctcctgagtagctggaactacagatgtatgctaccatgcccagccaatttttgtaatttttgtagagacggggtttcactattggtcaggctggtctcgaactcctgacctcaggtgatccatctacctcaggtgatccacctgcctcggcctccaaagtgctgggattacaggtgtgagccatcgcaccctgcctagtgtgtttcttttgactaaagatacatatattttgttgtacgttgtccttaaatgcagaccagctacggattcgggccttctcattaagaaataccaaatgtcttctaacatgggaatataaataaatttgctatgttttaacactgtattgaaagatgatatgttttatcttcatcatgtctcttttctaaatgtgacatttttttaggcctcctggctaacgtatcttaactgtgatggaattttctcctgccctgttgcgtatttcctttgataatttttgctaatgttattagtgaaaaatggcagtaatcatcatgcatgattactgtgggtcttttttcccctcctcttgtattacatttcctgaaggcattgtgccattattggttctcttctctcccctttcccgtttttgactgctattttctgcatgtttcagttttttgaattgttacaggaaaattgtgtatatccatgtatctgtatggatgcaggggttgtggttgtggtttgagaacattaatgttctaaatctctaaggagcggaactccttgctcccatactaattttcatccatgttcaacaactgtctccgtatctcttttattccttctttcttttaagacattttatgtgaatgaatgactagtttaaagttataggtaaaaataagttccattaagaaatacaatcttcaaaatattatgtaagtacaatcggcctttcatatccatggattccatatccacggattcaaccaatcatgaattgaaaatatcaggtgaagaaaaatgagtggttgcatctgtactgaacgtgtacagacttttttcttgtcattattccctaaacaatacagtataacattatttgcatagcatgtactttgtattaggtattataagtaatctagagatgacttaaagtatttggatgtgcatagattatattcaaaactacatcattttatataaggacttgagcatctgtaaattttcatattcaaagtgggtcttgaaaccattctcccatagataataagagactactgtttatagtatattttgatgtaatagtgctttataaatatttctcggttcaaattaattatacaaaagaattcccagtttgtataatctgtatcacacaggattcacaaccacagcaatctggaaacctctatctcaaaggtgtagttctcctagactcttagtgccatcattaccaccaccagttcatttgtcctcctgcttatcagtttcatcctgggtaggttcgaaggactggatttttcttgtgactttctgactcttttacctcatcagttccttcaagctgagttagaggagtcacaagtatcccagcccaggaccctgaggttacaaactagaattggcagttgtgctttaaggaactttggtttgaaaacttaagtttgccctttgggattctttttaatatatttaaagttctgtatagtaatataaaatgaaaggttgacgtaccctttgttcaaaactgtctaataactatagctgatcttaccacttgttaattcttgaaactgaagtgtttacttaaataaaaggttgtactatgtatatccatggtttttattactataaagctacaaaagaaaattaatatgtatctggctttgaaagtcatagtcgttgtatcaatactttctgtgtgtatgtgataaatattaaatatgtcattatttcttttattaataagtttgcctgcagtacaaataacagatgcaaaacaggatgccaatctgtaaccttagatgaacacaattatttaactgagatgatctttatccatacttttctctatttattgcttgctttgcacaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaagtatgcttttattctgtaataaagatgtaaatgtttatgtatgaacttatgaacatatatagaattcagattttttcaaatttcagcatttaatttttacttccttttacatgtgtttcctcaaaatttagaagtgaaggatggttcaatttgataacatttaaaattttttgaattttctttatggtaattagagctgaatcacttaaaatatagatacaaacttactctatagggtattatttttataaattggcattcagacagcttctgtgaaacatactaggagtatagtctcaaaactggaatggaattcctcggcctgctattacaagaaattattttgtcaagtatggcagactttcattgtaaaatttgtacattatttttcggcaaatcttcacaaatacaaaggggattgctgaggagggctttaggatcaatattttccaggatttttctctgtttattttgtgtgtttctgttcagtagtcttttactttacagttgttttaggagcctttcaagaaggtttacccaagtatttaggtgtgctaactgactcagcagcaataatttaatctactaattaaaaaaaatacctttattggccgggcatggtggctcatgcctgtaatcccagcactttgggaggctgaggcgggcgaatcacaaggtcaagagatcgagaccatcctggccaacatgatgaaaccctgtttctactaaaaatacaaaaagttagctgagcatggtggttcatgcctgtagtcccagctacttgggaggctgaggcaggagaatcacttgaacctgggaggcggaggtcgcagtgagccaagatcgcaccattgcactccagccaggcgacagggggagacaacgtctcaaaaaaaaaaaaaaaaaaaaaaaaaacctttactgaattcttcatatgttttgtgtagtgtgctaaattattttaataaataatgtagtttatatagtgttattctcatttaatgatagtagttgaggcaagtgaggcttagagaggttaaataatacacagttcatattatccctctagaattactggatttttacttctgatcttacttttctaaaaaatcactgtgaaaatcgaatgtctataattaacatgaaattaattaccttaaaacttaaacacatatttttaaatgatgctttgtaacagtggttttcagtgtgtgttttgtgttgcctttgtgttttcccaaggacctagatgatagcaagcaggaagatacagtcttccacttcagctagagcagtgctgcctttttgttttatggggtgacattgcccactgtgttttttgtttctaaagcacgttccattgctaaaatgatttgaaacactgtactttattaatacttgttaattgttattaatactaattaattgttttctctttttcccccattgatgactttctgttgcttggaacattttttttctgttgcttgaaacatttttttcccctcttggcttccattgtactataattgggtggctttcttccttcagtttttagctgtccctttttaatttctttgtggtcctccccagtctccatgtcctgtaaagtgtgaaaatgttccaggcctcactcttaggatctctccttttttttctgtttatcctcacaccctaggtgatttcatctaatcaccttgactttcaaagttacactgcaggttcaatatcccttatctgaagtgcttggaacctgaaacctgaagtgcttcacatttttagcttttgagattttggaatatttgcattacatttactggctgagcatcccaaatctgaaaaattgaaatctgaaatgctccaatgagcatttcctttgagcatcatactggtgctcaaaaatgttttggattttggagcatttcagattttttgatttgtatgctctacctgtgtctataggctgatgattcccaaatttgtaaatttgtttatctaccttggatctcttctgtatactctaggaaagagtatatctaattgcctacttaatatctcttcacttggattcctaatgggcatctcatactgaacgtgttcaaaacaaagctattgccttttatgttttcagtacaggtgcagaattcgactacttcccaccacccttgctgtcaccattctgtccaggccactatcacatattacctggattattgcagtaacttgccagtttctttgttctgatcttaagccttttgacataggtgccaggatattattgccaaaactttgtgagtcaaatcagatcactgctctcttcaagtccctccagtggtttcccagaccattaaaaataaaaaacctaagttcttactacaacctgtgggactctacatgttccgactctacattacctctctgatctcatctttgccttcttttcttattcactccagcaacacaaaccatgtttttattccttgaacataacaggtatttaacctttcaaggtaatactttcttccagtgcctgaaagctttcctgcccagttatctgcatagataccattttacttcctttattctacaactcttacagtttaaaattagttgatagcagacattaaatggtagaagcaagaaaagaatgatgtatgttgtaatagtagtagagggaaatatgggagcataactgggggcctgttccaagactaaggataaagaaagctctccttgatggtgtcataccagtaatactttgctgagaagataagatatcaaagagacaaattaatttctgataacttttccaaatggactctagttcaaaccagaaattccctagtgtatgtctttactaaattgggagaagtagagcttatatgcccctatttggcgaacttgccgtaacctaaattgtgatctggggtacattttgaaaccgtaaacacttttcttctaggattatgtttatcccttccaagaatcattatagaaaatgagagatgtaaatgatggggttatgttgtgtttgtgaatgatattgaggcagaataaaaataaaagagaacaaactgagatgtgctaacctaataattggcttacttttccttgtgtttagtctgttttttgtcatttctttctctagattgaatatcatttttcttttatttttgtttctcagagattaccttggggagtgtgggagtagggggcttcactgatacttaagttgattctcactttgaaattgtacctcccactgtaatattttaattttgtagttgttttagatgcttgtagttgttcatacagttttcattagtatcctcaactagactcaatttgaaaatattcttcttatttatttattctttataaattttgtctacagttagtagacattacaattgttttggtggctgtatgtagttattttaaaaaacaaagtcttttataattccatctcccagaggcaaatactgtgaacattttgaatatttcacttttaaaaatgcatcttaacatatttgttagcacactagtatttttcactttaacattatattttaaaaaatcataacatataactattttagatggtcatataatttatttttctactgttggttatatatgttatttgttttactattgtaaataaagctgcaataaacatttctttgtcagttcagacta

SEQ ID NO: 1781 - DNA, 951893 bp, Homo sapiens
gcggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtgtaagtgccggctcctgcgccgcccggggaggggaccttgccgcctgcgacccactgtgcccaagtttgggcgcctgcaggtgcggctgggcaggacccgccgcgggcgtcggcctcgccgctcgcacctgcctttcgggacccgcgtcgggcggcgaggccggggtgggatgctctggcccctgcccgcaggttgccgagtgagatctggagaggctcacctcaagtgacggcaccaactttggagcctggttaccgaatccaacttccatgggccgctgaatttcccccctctttgctctactgccgccccacttctttttttgggggggggatgggtggatttcttctgactgctatttgccaggtgatgcccagtttggggggtcgagtcctcgggcagtggttcgaatgaaactcagtggtctttttagagagcctgggagactttgcgcattcttaactccgcgacccccctcgggccccctcccgcgctgcgctttgcagttttggtgctggcagtttctaccaagccgctttttctatcttttcttcttttaaaacatgttacatcgcactgctccttcagccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatggaggcagatttagttttccaaacaaacgtgagccccgagcagcatcagttatcggaggactctctgatccccgggtttcttggcattgtactatgcagtgacttcttcctaccaaccggttatttttagatgacacttgattctaaccacaaagaaaagcaggatactcactcgcactgtcctggctggggctcggaaactgagtgtttttgcatggctctcgtctccgtgtcggtattgctgtttcagtgccagagcagatgctcctcgggccaaaaaatgctaacttcatccaaggggcagactcagtgcctattttgtgatgcctttcaccttgcgttggaggcgtggggttcagtgtatcagagaaagacgctgcactattgtttgtcatccctgcagttgtacaatcccattattccccaatcatctagacccagggctaggatgcattacatcattgcagataaggagaatgaatgtggttatctttccactcagctgcactgccgggtaataacctatgagagtagtccacaaacttaagaaatgggtctgcatccatgtaattctggagagtaatgagaatggagaattgattattaggttcttatcacaagctgcatcaattttaattcaaataggcagcattttaagcataagcttaaaattacattgtgagataaatggtccttcgttctccccttcaggaaataaagaaaaaaaaatgggtctgggaggagagattagaggggttcaaagaatttcaagttagcagatcaacaggattaatcaaagtattctcttgatgatagaaaataaaattggcctttagggaataattctctgaaaatgggtacaaacagcttaaattgttaagttaacttttaaacattttaaaatatgatttttgggccaatgtaccatatgtgttatgcatgctgcctggtaaccaagtacgtattttatttatggcattccccttcagagagtagcatttttggggacagtatatgaaacagtttgccacatgaaatccaaatatcgtaataaagcgttggcccaccatggaatgacaaaagttattatggtttaaaaatcgccaatagccttattcattgaaaccttattcattgaaagattgcttgctcaactctgttgtttgggaaggtgttcttgaattataggcagttggtaaacagttgaggctacgaaatgccctcgtggaagatgagaatttacatacctgtggcccacctcggcacttaaaggaattgcataggaattgcctctttccctagtattcttttaatctggaccaatctgtctcctgctttggcattttgcccacttgtcagatgtttgatgtgatgaattctggactgtagcattgcctttatatttttcttatgcttttaaagaagataacattttgtataactttaaagaagtatttctcatctgcacgttgtagttgtagcaactctaaaagaatcccttcagagcctgttaatattttttggttgtgctttcatatcttttatcccacattttctaggaacacattaaatatgtttttttctttctctttgaagttacacacacacacacacacacacacacacacactgcacaaaactccgtcaaccttattatttgctactctataacagcaaattggaaaaggctgaaatgcttctcttaccttctcatcagcatcctttctgatattgaattcactagctttgctttgcttttgtcatgtttgcagcttgacaattgtgtaattatttccagctgtttatggctttgttatcatttcttgctgctgcctggcattttgtaatctgatgcgagggaaaggtgaggtgttgcttggcattgcgttccagggtgggtgtccaccctagtccttggtttggaatcgtctgctctgggggtcctgaaatactcacggctttgggttacttggcagagactttcataagtggtgggggagcatgttagacaacttggggagcatttttcagctatgttttggctgttttggtccactatccccgcaaatgcttttgtatttttaaaattagcaaagaacattggtttagagagttcagagtatgaatgggagtagatctgagtgctcagagtgtaggagacataacatcatttggaaaaacaagtggataattgcttctcttttgctaattttcaagtttctgtccatttgcatgaggaattactcctctaagtcagagctctgtgcaccctgccatcatatcactgtgtccttaacaattaagatgctttcaaaatgagttagaaaatttggctggaaaatgcattaacactgtattaaggggactcaaagatgacaatactatgttgtataatagagtgtaattgctctttttaaggcatggatttttaaacttgattttcagttaagtaaggtgtgctgtataccaccatataattttatgtattttatgtagtttcactaattgacacttcatgttgtgaatcaatatagtgtgttcatttttagaatggaagtttagtcatttttgcactaaaacatacactttacaaagtagttattatgaatataagttaaataataattggccatgcatctattttaaggtgtttagtgactgggaaaactgccattttggtaacatgtttttattaggtgatataatttgaggtagcagtattgttactgacttcatcaatgtaaacacaaacatttagcaatgtaccttgttatggcttcagaaataagagtattttatcagttgtttctatgtttaataccatgggttttgccgctttagcctattataatatattaggtattcaatgccagatagcccctatatttttttcttctgtctttactgagcacaggaatagcaacctgttaggtccttagaaataggatagttttgattttataaaacgcagtaagccatcttttaggaaatttgtctgttttcagtacagaatggaagattgtgggacttgtctgtgggcgctggagttcatcttgaggggttttagatgctgtgagagaatagcaggcccctggagggatggtgctggtgcgccgctgtatgcctgtgtgctgccttgctaagctggcagatactgcaggggtttccgttcacttcaacttttaattaagtttctgatttgatatatccatgccagtcagtattcagctgcctttatcttgcttcattttccccgaagaatggactttgtttggttcttttggggaggcatagtttcattaccgctgtattttgggattcagtgagaagcattctagtaggtccgggaacctaggctgttaaactcagtctccacacctctaacaatcacaatcaaaggcattaaactggctgattctcatttcatcctcctcagggagaattggataggagctgggtttttcattctatttagacctgcattcggggaaccaatgttcacgggaatgaagggttccagttacattttccagaatcatgatgataaatacacaacggaaatacaggtaatgtgtgtctctgccagtaacgctggaacagaattgacatttaccttggacgcctcatggagcacttaccaaacacgcacatcttggaatgcacaatctgttttttacattatcaactatttattgagagggcagccttaatatataaagttgatatctctttccacaggacagagtcagcaaagtaaaaggttggtgctttaagccatttttataattatgacttttcatcaatgtgaaaatcggtggacttttaaataactgaataggtgtattcacttatcaggaattaggtagcagtgccttgctgctcgtgggaagcccagcactcttcagattgctcttgtgggggaggcgctgttttgctaacattttgtgttgaataaacacagttatttgccatcctgaatgataaatgcgttcaacctatgctgcggatgctttaattcatagcattactttaaatactggacttttccttagcaggttatttttaaaagcttgaaatctctgaagtgacagtttttaatcattcagggcagtttattggtctcattaacacaatcacccagacagtagcagagcagggcaaaccaatgagcattcagtttgtgcctcttatgcatatagctcattgcacttgtagagttactcatgaccacttgctaactttcggtctgagccttttttgctcattttttttttcttttcctttaacttgttttttttctccttaaaatttcttttctgccagatacatttctactttgccttttctcccattaggaactgctgcggcctgtgttgctcaggagaccaacagatgctactcaaaattaagggaaaatgaaaatataggcatggttttctggttggaggcaaacttcaaatttttaattcccatgtggttataattttgattgattagcatggtgatcgcatgctgattttaattaattaattctaacactactgcaatttttaggcaaacacatgaataccaaaccacctgataattctgaaatccattgggcctgagctgacacagttattatttccagtttttgatgaagacatagccatatgtcagcatgagcaaaagtaaaagaaatgcgaaaccatcacacccggcacctgtggccctcccaggtgtttcatttccctaaagtttgaagcacatattcttggaggtgcaggtttgggattctagccttcatcagccttggatttatctccacttggtgtttagggttcccacttacattgatcaatccatggtttggtgtgttgggcctacctaaagaagtgtacattttcacgaaggagcctgtatttcaggcctgtcacaaatcctgatttaccatcatagatgctatgatgccaacaaacgggctttttcttcaccccagcacatctcctctgtcagacatgagcagcagctacttcaggggtccctccatcttttgtagtcacagtgcttgttggcacagtctttgggttgagaccacagcatcttctacacaggcaatgttagcagattgtgtgttccctgggacactgtgatttgacttagaggtttgctgtggccaaaactgagaaaaaaataaaacagatgttataaaatgccaacctatgaattagcatatgtgatttttttcccctttaaatgtaatttttatacaagagacataacggcctaggtttcatctcgagtgactgcagtgaagcttttgtgtatcattcagtgaaaggaaaagttcctaatgtcaggcttctggtaaaactgacagaatccttatcagccctctttggtccattaaacaaaattttgcttctcctttacaggaagaaaatgatatgaggaagaggaggatgcttgattttttgtgattttcctaaatatttagtgaccaacagactctgtctgaagtggttgttctataatgtaaaaccagactctaagccccttcgacagcccagtactttggcctgtacttacagctcacccttggcagattaggtatttgtatagctgatgtgttttaggggatttctgtgtgcatagccagcacgtctacttttcagaagggaattattttttacaaatacatacttgaaaatagtccagttcatttctaataaatggtaaacatttcaacttccatttgctttgaacaacactcattgggtgctcattccaaggctgtttaaggcactaaatttataacatgtattaaatttatatgttgcatagcttcccagttaccccaaatcaacattatgaaaataaacaactcagaaaccaaactattggcgcacatttcaaggccatattggaaaggaaagcattatcttttcacaagaaatggatggctgttccttcactttgtgcacttcagagtatttatcttggcacctgttaatggaaaacagtaccctcccaaggttaaaaggactgttatgcatgtaaatgatctggacaggcaaggtgggtaaggctataaatgctgtgggttcacaaaacagacctcgagttttccattttaggtgaaacaactgccagttgatatttggggcctgcacatgccattaccgtaatacttattaagtgtgtgtatgtgtgcgtgcctgtgccaataaaaatggatgctgctcatcacagaacgtgccagataatgcttgctgatggggaagactgttcttgtcctcttggatgttagagaggctgacttgagagaatgaaccagggcagtaggacagaactgagtcacgccagtccaacaggcatggatttgttcagcgtctggaattttgtaggcagttgaatctgaggacttgctgagatcagaactggctatgtaatttgtggtcctcagtgcaaaatgcagaatcccttgttaaaaaattattaagaattccaggatgtggcagcagagcctcagaccaactgcggggccctggctaagcctcctgtgggacaggctgtcctcgttttggctttctctctttcctgctggatagcttaccctctcagctccattcagtctaggaggcttcctttgcccacctttgttccatctccaatgaaatcattttcttattttatgagtaacaggtcaagagcttggagcattttcaaagattcacatctttggagatgctgtgttgttaaaggaagggtcattggccttaagcagtggcatctctctttttatcttttctgtgtgcatttccaccgtggccctgggcaaattgcttaatctaatagtaaaaacaggtaacgctcaatgctgtagtttctgcattccaggtactgtgataagccctttacttatgacatcccattaaattctcccagcaacctaatgaggtagggactaccattcaccccattttacagattgcgaagctgaggctggcagaactgaagcagcctccccaaggtgactgagcagggtctacacatctggccacagtgctatattttcttgtctttgcgtgatcctttctgaccttagttcctatttgaaaagaatgtgcataatacctgaattttcgatctcacaggtgtttgggaggattaaatgagaaacatctgggatattaattcagaaacaattaaagcctgggttaacagctgagagggcatagccttggagtcagatgggcttggatttgagtcccagatctgacatttcctcttcagcgttgccttgtagtttaacatttctgaacctatacccttaaatgagaaaggagaccagtaccttctatcttataggctgtgatgaaggttaaatgaaataaaatatgcaaagcacttagcactgtgcctggcacattggctcctgccagtgagttgttgttgtcattcctagttgcaatatacaaatacaagctcttcaggtaatcttcattgagcttctgtggggcctggctgcatacatacatgtgtacttggtgaatgagcaagtgcatgaatgggtgagtgccaggcattggcatgtaggcagatgatccccagctgacccctgatgagagcacttcagagcaggaggaaggctgcagtggcggcggcctctgtcaagatatgcacccttcccctagagatcagctcccttctccctgagcatggggggagatgcccagagaagcccatcacccaaggaattggggttgccacatctgccccacagcccagagtgaggtccttatgccacaggagatcccagcatacccagccatttcccttgctgtgggagcttgttcagaagccagctgcagataacctctaatcccgatgcccccttgggcagcatttcagttgtttaggacgatatgtggcacctgggaagccttggttctcaggccatcctctcacttatactgtcccacttcattattcatgaacaagagagacttggaatttttgtcactttgatcccataattagttcataaaattaaggcagtgtatgttatgcacatttagtgtggcaggggcacaatgacaaatgcatttattatgtccctagggaggtggatttttttttttgctttctttccaaaatcctcctaatcttgtcctttgcacagcagaagtgggcagctgtaagactaaaatttgctgttgctgtaacattgtgctataatttgcgaagcaaggtgaaagttggaaatatagggcaggtgtttgactctttgtacatgtgccatccataacgccttttccattgtattgtttgaggcagaggtggaacaatattgtaaaaagaacaatagatgtgggagacagtaaatttactggattcaggtaatctacagtcgcgagtcataacatccagctttacgctcagcctcctactggttttcattattagtgaaatgtctgttagtgcaatatgactgcgtcatgtacaaacagctcaatgggcataggcttttgccccactgacataataatagtcatttgacttctggaatgctaatgctacgtttggatattctttcctcttgactttggcctaggtccctgttggaatgctattgtcatttgcttttataatacgaaattcgcacaccaactcagacaacacacttcagacaaatcattatctggcaaccaataaagggtgtttgtgtgcgggtgtatgtgttttatatacatgggttgttttcctttgttagtaaatactggtaactaatttaaaattccagagtgtgtggccaagttcgagtatttcagaacatcaggagccacctggtcgccctgaagtaagatgtaatcctctcaggagagggctcacagctcactaatcttttgaaaaagtcaacagtatacatttcctggaacgggaatttcagaattatagagccatagctggattttctacttgaacagcgaggttttcagtttttttgcttgaaacaaatgctttatgaatgataggaaaaaaatatgtatacttagaaagaaatcagaggattgacttttaaaaatctacttttaagagaggtggctggtcttgggaaggcagaactgtgtagagttgagagtctgaatctgagtgacgacaatctgggtttgaatcgagatgctactgctgactggtcatatgaccctgacaagtcagttgctgagcctcagtgttcgcacctctcaaatgggcacaatggtactaacttctagggtgagttgagaggcccaaatgagaagatgcatgcaggatgcttggcaataagtgactcatgggaagtgtatagaaaaggtagactgttgtcattgttattattattctcaaggagttgcttctacataccagcaagtgttggttgctaaagacagtagtttgtccacttgaggggttgttaatgccaagccacctggaggccttgttttgagacctccatcaaagttgcctacaactcagctctacaaggggttttcggcagtaataataataatgatgcaggcgttttttgtattttatgatgtgtgctttatttatgatatatcatttaatttctcatagcaacccctgaggtcagatctattatcatctgcatcagttttagagatgcagaaacgtctttaacatctgagacagaggatgtaactttgccccaggctacatggctccacgtggcaaaggcagactctgagtccgcatcatgtgaatcccagttcaggtgcttgagctgttgtcaggtcagaggaaaggcatttgggggatttctaggaccaaccatttatcctttgcattggtgttagtgtggtattggctcatcagagcgtttggtggaaacttctccacacccttaaaattgtccccggtggaattcttagtcttgttgcttgggcattgtcatttgctttcataatgcggaacataaaggggtaagagctggaataagaggagggctggtgagccctctagctttctatacttctccctttttgtcataataaactgatgctgcttatcttttagttgcccttgagggtcagccctcccctcatgtggtctgactcctaagatgcgtttctgagaatctaattgaatttggctaagttttcctttgtgtattccccattaaggtaatggatgatggtgtaggaaagccagtgtgggctcttaaactctgggaccagatggatctggctttgagatctggctggattcttagcgttcagggcctcaagttccttacctgtaaaatggggtcatgatagggaggattaagtacggaggcatgtgacggtcttagcacagaactgtacacccaggaagtgccgagtaaattttagcttctctgtttttgttattcctattctttgtctgtctttcctagatatttattggtgcttattttttttccttttgataaagccacagttctgtttttctgtacaatcgacagctagcttgaaagccacagccctggactcactaggatcgattttattttgcttggagtgagtcttgttgcagggccttctgtgccttcggcaggtctggggttctgggttgtgtgaaatcctgtgaaccccttatctcctttggtggtgagcggggaggggtgagcagaaggctggtaagctagaccttaaatttccccagggcgtgcttgctctttctgacctggagaggctccccctgtggcacttagcacagagcgatctatggggtgggcttcaggggttgtttgtatgtggccagcacgaaggtacagataaacaaagggaggaatagccgcccagccttttccctgtccttgcatgctagtgatggaaataagagcaccgtagagcacaggcagatcaccaggtccttcacagccctttccccatttactctccaacgccagggttttatgaatcccaacattgggcatggatgctgcaaaaagtgggggctgccttccagctacaacagtccagccccaaagccctgcaggcaggtcccttgcccacaacccttgcagtgccagcagggactgccagacagcagaacaagccggtcctcagttctcctagctggccttccccctccttgcctctgggagcatccctgcccatctgggtcagcacgctagaggcatgctagagtctcccccagaagcatccagttgggctgaggggtccaggcgcctctgcagtaccaagctgagcagctgctgcgggagcaccgcagtgcagggcgggtgcacgaggagcaccaagcgagactgatggggccctcgcagccgccaccatcaacctgggggaggcaactcagcaaaggcaattaggaagctgctgcagctaattccataaagcgcttgagtgccacattatcactgatattagggagaaatgtgaattttaatttctgttcccttcgccttcacatggggttgaggccctgccagcatcaagatgtgtgcgtggtgtttgctatgatctcaccttctcggggagctgcttctttagtttgtttatttgttgtttatatcaccggggctgaatttctgagtctgtgctttgaaggctactgggagctgcatcatcttacctctgcaacatacctgcagcatccacagaacgttccttgggtgatctcactgctgcaccctgcatggggcctgtcaggcatcttcatgcaggaggaaatctttaagagtggccatcaagtgagtttgggttgtttttatttgcatttgcatcctgcaggcacaatggtctgctctcttccccaggcgcagcctgcaccaacacacccccggacatgaggggagatagctgctgggaagtgagagttatatggatttaatggggggcagttttgccaaaagacatttcactccagcctctgcttccttcagatatcaggactgaatattgtgttgtgaggcttttggaggagtcttgcctccagcgcctccctgggatgtgactcctccttggagctatgacttctgctacgtagagcactgtgtgccctgagtgagcaggatctgatgcccaccttgcacattcctcctgagcctgacctactcatttagaaggagatgagaggactttggagagggggcaggtcttgggaaacagtccctccacctgtgagtgtgtgtgagggctcagtggcctgccgcaggtctcacagtgaatcagaaatgggccaggtcctgaatgctggagtcctgactaccaggcttgggcccgggccagtgtattgaggccacagatggaagaagggttccacgtcccaccgtgggcttcttggacgacagggggaggcagccctgagccccatgccttgtctgctccctgtcccatgcctttcaaagctacccagctgatctccactggaaatctgttctagtttatgcggaagggtgtgtttgtgaactctcctcagattcaattgcatttgagcctgaatttcacctagagaaaatgttcctccagtgcatctatttttaacagccaaaatatttggtcccagtgtgtcatcagggaacagtccccttattaacattatctgtataagtgaagctgataggagacagaacaattagtcaatcgtttattcaacactaataaactatctggaaacctgaagcctccaaccttctccttttcctcagttgaggttcagatgatcaaatgctttcttttgggtagaatatcatggtttaggggaatctttagcaatcttaacagattcccaagcatacatttgcctttgtctaaatgttggacatccttttctttcttccttctctcacttcttcctgcttcaacaaacatccattgaatactcaatgaggtgtgcagagctatgttgggcacccaaatccctttgctgctgcatccacctttcccatcctcaccctgagtgcttcagtgacagcacactgcttgagttccctgcacacatccggctgtgtcacgcctctgtgcccatgcccgtgccattgccctgtttatactgccgaccctgctgtccttgtctggcttctgagcctcaattctacaggatgtcaggctttagcctgcagaaatgttacctggggagcttgttaagatgcattatttcaggagcctactccaagagaccctggcccagtaagcttggccccgagccccagaatctgcatgtgaacagacatctcaggtgactctcatttggtggtccgtggaccacgctttgagagacactgtttacatgttgtctctgggaaggcttctggctttccctaaagagactcagtcattccctcccttccattctggcctatgcacatcttgattgctgccctgtgcacctcttctctcccggcctgtgcacatcttccctctgtgatttttttacaaatccgtgtgcgtggaggctgtgttgtcctgggccagaggctggagctgctcttcccctgagccaggtctgaagcatgggctggcacagggtatagcctttctcaatgtgggcggcatgaatggagattttccctgccatagaaatgagggctttggagcaagtcagacattttatcttttaagtccaaaggtacccacatacacgtctgcttgttgaagcagtttatttagaaatcactgagcacagttgagtggccattctccaatttgtgagatggagggaaatttgttgacctgtcaccgatggcttttcttcttaccaaataggttaccgggacctgtggttactagccctttaacagaaaattgtttagtgaacatcagtttgaaagacgccatctgcttcctataaaagcctgctcctaatctccctggtgcaagaattgctccctcaggggccttttgggcacaaaactgtgttttttttctaagtcagtgcctttcaaacttcttaaaccgtggcttacagtaaagaatacatgttacattgcaacccgttacaacctcacatgtgaaacatgtttcatgaaacatcacttagtcttattctttgcagtgcaggctggtattttgtactttattctattatagtctattcaacgcaagttgactagacgggactctgttgtactctattctacactattctactctactctgttttctattctgttcattttagaaggctgactctgacctataaattgatttcacaatataataaatgtgttttaaaaacccgtgctctaaatgttaccggggtaaattataagttagttcagttttattctgggaggtgcagcattgatctttgagacctaggctgtgttttccccagtaataacgatcagtggtgatagctaatgcttatgagccagtcacagtgctgtgctgtctgtataaatttcatttcaccactgcgacgatcccatgggacaggtgctctgatggcatcattttccagaggaagacatgagttcatggaggtgatgtgacttgcccagggcaacacagctaataagtggtggcctcgatttgtgaatccagcgctgtctgaacatgaagcctggactctcaactgcatttgcatttgcctcttcctttgccagcagccactttagttggttccaagtgttagcactgggctatgcaatgtggaaggccagagagaggaaatttggagatggcatgctggggagcagtggggaggacatgtgagagagagcggggagattggaagagggcagtctgtgaagcttggggtgagcggtggtcctcggagcatctggtattttgcctagcacctagagaacctgcagtgtttttgcatctctggttatagtgcctgcctcctccttaaagcacccactgcatccggtgtttgttattgtacttgctggacaaatacttgttttcacatctccttctctgaccaggggtcattgttttgaggccagaaatgatggcttgtacttcttgggatgccaggacctggcccaaggagatgtcaccagggtttggtgactgattgagtgtatgaggatatcgtttaagttaatcctcataactagcccatgagtcatattccatcctcattctgcatttggggaagtagagcccaagatcacgaagctagtgatggaagagccaggtgaaggaccaccatcccagatgaaaaggtgactattatatttgcatgtgtttgttttttgttttctgaagattaattttgtcttgttccacctcctccttaggatttctcctcttaccatctggatctggttttctgtatttggatcccttttctttttgttgtttgggcaggatgtggttggaccagagagacactgggctggagggggcaggagtctggcctggggtctggacgtccaggttctagttctggcctgacactgctgagcttggggatctggggcagctcgctgcttctccctgggcttgcctgcagtagagctcaaaggtcagcacagttccagaggacagcacagttccagaggacagcagatccaacctcatttcctggtgcgttccaccatgagatgggtggcacttggttctgggctttcttcttttcactttgtcccagtgtgcccccatcccacccatacctgttgccctgcagctgtctgcatcaggtgtctctgtgagtggagggaggcatgcacgggctgctgtccccacctcggggtgctgtccagcaggctcagcagactcacgcctgcccacgctctgcagacaaggcagacttagctgaatggccaagagaagactaaagtcgcattcatgtcagagcaggcagaaatgacatagcattttggcaaattcttctctgcatttttgctgacattatctcccaggagcccttgtaccgcagcctcattcttagagttgtgtatgggaatggagtcttccttgaatgtaaaaggcaaaaataaaagggactaaaatatttgacatatgatgaagttctgtgatattttagacagtgagtaaattggtatttatataacctggtatattcatttccctgatccaccctcccttgaatgttgacttaataacatgcctgactaaatgacgttaattgctttaaactgccaaataaaaaaaaagccagcattcattcaacaagtgtggtgtgttcacagcccaggctggaggcagggaggagagctgagttctctctggggatggaaggctgagatgtaacctgagaggcttaggggaaatgcacatctcaggaacactggctgcttgggccagacataagcaatggagctgaggggtgaggttcctgaaaccggaagctggccgtgggttcgaatcctggctccaccagtggcttaaagcagtttctcagcttctctacttcccattttcctcttccttaaatgatccctatttcattggactgtcatgaggattaaattggatcaggaatttaaactttatctcagtgtctggcagtcataggaattcagtgaatgggcagcaaccattattttaattcttggcatcaaaggtgagacatctccttgggccaggtcctggcatgccgtcattcctggcctcaaaaagatgatccctggtcagagaaggagatgtgaaaacaaatatttgtccagcaggcacaaaaacaaatactggatgcagtgggtgctctaaggaggaggcagccactataacagagatgcaaaaacactgtaggttctccagtgctcagcaaaataccaggcgttctgaagaccactgctctccctgggcttcacaccctgccctcttccactcgccccactttctctcacatttcctctccattgctgccaggcatgccactcccaaatttcctctatctgggcctttgacattgcatagcccagtgctaacacttgggaccaactaaggtgactgctagcagaggaagaggcaaatgcaaatgcagttgggagtccaggcttcgtgttcagacagccctgggttcacagatcagtgccaccacttattagctgtgtggccttaggcaagtcacgtcacctctctgggttgcacacccaccctctgatgtcagtggtaatgcctcatccagagaatgttggttccctagagcaagacctttgtttggttggtcctgggctctcagttgctactgccttcggatttttggctcctgtaatagtctctgtcagaaaatatctatggaataaatgaatgagtgagtgtggagaatgaatgaacactttaccagctgagaaaactggggcttggagaagtcagtgagatcaaaagagacaaaacagaggtctgcctggtcctcagccatgactataagctagtgggggctcgttggcacctctctgtggtgttgtctaaatttccaagagaaacactgtctgatctgcaggtgaaacctgtgtgtgtgtgtgtgtgtgtgtgtgcgcgcgcgcgcgtgtgtgcatgcatgcctgagatgtgtcatattagatgtagactcatggttgtttagatgatcaattctcattcttgggtgcaatggcatactggtaacccttctctatttgggggaaaaaattccctaaaagctcttatgtgctgaattaaccacagagtccccctaggaagtcgaaacagcccatacccaaggctccattcaaagtgctttttctgggacttagtaagggaaagtgtttcccattgagctccctgtgtatgtatcatctttgccttgtttattgcaatagtgacttaagcctcccaaccaacctgtccaaaaccttcattttcccgaggcaatggtctatgaaactttactgctcatctgctttctcaggtcctgttttgtgggcaagaatgctgggttaagagaggaagagaaggagaggcagaggggctgaagtgtgaagaagagcactttgtattcttttttaaaaagtcctcgaactcagcccttgaatagtgcagtataaatttgagagatgatggctattaatactatgcttcttgtgtagcagcttttaatccaggatgtcaaaatacatcaataacacattctttttccatttctccacttcatttgtagggaggaactggagagcatctccagagaaaatgttactgccttggtccccagcagaagcacaagaaaacaacctgaatttgataattttatccattcatttattcattcgtttattcaacaaacatttttgcatcttgctactctgtccaggtatcatgccggctcttggattagaagaacaagcaaaataagattgcaccctcgtggagattacaatctaatgtgagaatcaggcatatctcaaataattagactaatgcatgcaagtctccttgcagttccatgaaggaatgctgatagttcatgacctgaagacctgctctggtctgggttcggaggaggcttgccaaggcatgattctttactgagaccagagggatgaggaattactatgacagaaaggtggaagaggggtccctggaccctttgtgctgctgtgaccctttcctgtcctggtccagcgtcaccctcactgctcctccttgtgtgagttcagggacttatcctgtactttcttcttggcccttcgttctcttgtttctactgccccaaactccctcccttgccactatagcagcttgttaaattctcagtcttcctggcctgattctttagttcagcaaagagcttttcagttcctgctatgccaggggctcagtgctgggctctcagttgctactgccttcaggaagccttattccaacctcctcctctttgtacctcactttgttcattatagctgaccttgatttctaattactgttgtagtatccgtgggccctttcctcagctccacaagtgtttcgaggcccttttctcatctttgttttcctcttggctccttagggcaaagcctgatgatggtgatgatgatgatgatgatgatacactactacttgttgaacatttaatgtaagcccagacagcattcagaatacctaagacatattacctcactaaatcctcacaaccctgtgagcaagctactctattaccatccatatttaactgatgaagaagctgaggcatggaatatgttaattggctttcccaaagctatttggctaggaggcagtagagccaggattccacaatgggcattttgactccagtgcctatgtctgtaaccactatactatacttcctttctctcatggcctgcatttgtggagttgtatctgtgaaaatgattgtgctagttagggacaggtataagccatccctctccctgagtgtgtacaagtacaacaaccctgagtgataaggagtaactagctaacactggttctccaagtacagtgaaaagcaggctgtgactaggtttctttgctccagaatttgttcccatcacaggaagtaggtagcaaggctaagacacacactggttataccagcaacaactgcttggttctggccaaattcttttgtcctagttgcttttcttcccaggattgaagaagctcccagggcagttgtcatgtaagtggcttcccctcaacacaaatgctgagttcattattgcaggtgtggatgttttgtatgatggcacgggcttcagaagtgctagagacaagaatttccttgtgttcatgtataaatgctggatgactgctgggaagaaataataactatgatcaacttggagcttttaaaattataaaacattgcctgttcactatggaaaattttggaaataatggataaatcaaaaagcaagtaacaacaaactgctatcccattattctggccttgtcattgttaatttttttatttttatttttatatttttgagatggaggcttgctctgtcgcccaggctggagtgcagtggcgtaatctcagctcactgcaagctctgactcccgggttcacaccattctcctgcctcagcctcccaagtagctgggactacaggcgcccgccagcatgcctggctaattttttgtatttttagtagagacggggtttcactgtgttagacaggatggtctcgatgttctgatcttgtgatccacctgcctcggcctcccaaagtgctggaattacaggcatgagccaccgtgcctggccgattgttaatattttgatgtatttctttgagtcttttttcttttgcttacatgtatgtatatttgtgtatatgtatatgtactttacataaatgagatcatattgtatcagctatgttataatgggaagatattttaaagcagattcaggcagtactgtagggaccacaaaaaatgctgctttttcatatgatagataaaatttatcctcttctttgaaaaattggaatgtaccagatgatacaaaaagaaagaaatttctgaatcttatgatgcaagaatattcacattaaaattttgcagcatttctttcaggctgctgaaaactgaaatcagattgtcaacataaagttattttgcattttctcccaactgtatcttatgagcatatcccctattactcatcattttccgaaatgatttgtgttctggctacaaaacatttccccctggggatgttgtgtggctgtgtccccttttccccagtgtggagcatgaaggttgttgcccaggtttcccccagtgtaaacagtgctctgatgaacatcttttctgtctctgtgaatttgattactgattatgcccctcagagcatcctcataaggggattcactgtgccaagggtgtgaacttcatcagcgctctccattctcgctgccctgtgtgtgtgcattgcatgtgcatatgtgaaattctcctctttgtttctcttgtagtatccagctctgtgtctgacacaggcttgcctgggagaccagacagatttggttggaccaaatggcctttactcttccttatataggcaagataatcaacataagatgcaaagccaggctctggggccaggcatacctgggttcaaatactggctttgctgcttactagttgtgtggatttgagcaaagtactcaacttatttgagttttagtttgctaagggaaaaataatatgcacttacggagttattatgaggattaagtgaaataatacatgtcaagagtttagcagagaattgaacacacagtaagggctcagtaatgccaagtgtttttatcatttttactgtttattccaaccttcaagcttaggactataggaattcgattcatttaaaaaacttctgctgtttttaacagaatttaaagatattcagagattagttgtgtgtttgttttaactactcgctgtggtttagagagaggtctcagggtgtcaagcttcactttaaatatctctttataggatctcccaaagactttgagattttagattggctcctaccctagaagactggcattaaaaagatagaccaagatctaagtgttggctgggacagagcaaactgtctgtttaagctcccaaatgcagttgttttagcagtctaataaattaagggtaacagtaataataggaattaacaatggctaattaaaatgcggtaagttgccaattatgtaatggggtctaaaccccggagtaaatggagatatttgcagatgcgaagttgcgctgtgcacggtggtaggggaccagggtgttttgataatgaaagtaccctggatgtgtgtgtgtggaattctggagcctggttgccaaactgcaagctctttactgctagcttgaaaaatggggagctctagacactgtaaagaattgcagtttttttcttttagggaagtgtccctctcagccatttaatatcactaagatgtctaagaaagaagaaggattccaggtggtttctgaatgacaggcttgttatatgcagcagagcctagccctgcatggcatatccccacatcctgggggctctgcgatctacgtttctctgggtagggtctgccctgtgcctgtctttagcactggtcatcctcagcacccagtgcagggcgcagcatccagagactgcatgaagtcgacaagtgagatagaccaacaggcaacttttcaatagggagacccctgtctgctttcaattatggaagagtgtccacttttatctttttcagtattgcttcgtcattgcctctcttctctccgggatggctgttggagcttttcattttagccttcacgtctcttaatatcgctttcatattttctctttatctttctgcactgcattttgaggggtttcatcagtttgtctttttttcacctactttctcttcaggtgggcctaatctcactgtttttacttgcttatatattttttaaaacctgtattatatttttcacttctagaatttctattatggttgttattgttgttgttatttaaataggtcttttttcctggttctctgttcgggatggggcagccctcttccctgctatcctcattcctgcagccttgacttctgcccttgacctggtgttaaaccctagccctaagccctgtatgcagtactgctactcctgggactttcttgaaggcgctggtccctgggtgtaactgttatgaatttgttggctaacttccttccagtctgtgacctccactacactcgaggtgaccttggcctctagttcccgagcacagggactgatgctgagagtggcttggtacatccacggatagtggggacaaaggcaggccttttgggaacaatgctgctctctttcccactgccgggagagcaggaggcttagctgcagctgataagctaggtctgcccagctctgcccacacaagttcactggcaggggagcaatgtttgtgtccagtctctcactcttcctctgtagggtttggtgcatgttaccattccatgggctgacacaggaatgtggggaaggggggcgtggcctagtgtgtctctttgatgagtgagctccacagagttctccacacatccagcagggcccatggaagctacaagggagtgtggtctttctgagccgcatgtgcacagaacgtcttagggggaggccctgagggagtctgcggggtgtcaccgttagggcccctccatccccgttggctcctgggccctgtttcccgcctgcgattgccacactttgtcacagggtggcagcaagaggcagacgtggaggctgcgcagggctctgtcacagttgtggacactgccaggctgcacgcctgcccctcctggagctttggacagatgtccgggccaaggctgcggctgaaggccttctcttacctgcatgaaagtttcagcaaagagggaaaatttcccctttcagtgaatgaggctgataatatccctagatttccaatttgccttttctgcatcagaacccatacctttttcagaggaacagtgcacgcctaccaaaaaagatgaaaaataaatgtcagagtgagagctgggggtgaggggacagctgggaattccccctgcactgcctgctggctgtcacttgggtgtgtggctttgctcttctgggccttagtgtccccatctgtaaaatgaggagaccagtcacatctgagtagtgaggctgacgtgtgaagtaaggaccttgagtgtctaaggccgtcagcttggcacagaggaagcgttggctcttctgactctaaaaaccagtatttggcatatatggaattagcagacgaaaggaatcagaggagcccttgcttggagaatttcccactaatctctggtaaaggagggaccaaaacagactcctttcttctccctccctcctttccttccttcattccttctttgctattgtcagtggtatcccatggtagaaacaatgacagactttggctccaaatggcctgggccagagcctgactcttccatactctgtgtgaccttgggcaagttatgtaacctttctgtgcctctgtttcctcccctgtacaatggggatgcttgtgagattttggtgaggattacagtgttagtgtagataaagcctggaacatggtaagccctgtattactgtttgcttttattgtcctgcttgactctgagagccaaggtgggcttttccaaaggcttcagaggtagttatgatgggaagatttttctgtttgtttgtttgtttttgagacggactcttgctctgtcgcccagctggagtgcactggcaccatctcggctcaccacaacctccgcctcctgggttcaagcaattctcctgcctcagccccccgaggagttgggactataggcgtgtgccaccatgcccagctaatttttatatttttagtagagacagggtttcaccatgctggccaggctggttttgaccttgtgatccgtccgccttggcgtcccaaagtgctgggattacaggcgtgagccactgcgcccagctgatgggaaggtttttatgccactggcttccgcgatggcccaaacatgctccttgacatgcccacgggctcttagctccagatgtctccttcattcttgctacccttccatatactacatacagtgctgggatgcagagaccaagctgaggtccctcccttgaagggctcacaatgtggagggacaggtagacacagaatcagacttcagaatggtcagaaatgccttccagtacaggctgcagacccagggagaggagccacttggttaaattttgggaggcattggggtgcaggagacctcaaaaaggtgactgtggaatcagaactaggcgctggaatgggcttgccaagtgaagaacgtgttccccactggaaggcagcttggacactagcatgtggcagggggttggggtttgcagggtcagagtcagtgtggcctgagccctcatataggtgaagcgaaaaaggaggtggagttggccagcaggtcaggaaccagtggaccacaggtggctgtgttttcatgtcagataagaagctttcaccgtggactgggtggaggatctgaccagttttatgccttaagaagacagctcgggccgggtgcggtggctcacgcctgtattcccagcattctgggaggctgaggcaggcagatcacttgaggtcaggagtttgagaccagcctgaccaacatggtgaaaccccatctctactaaaaatacaaaaattagccgggtgtggtggtgggcatctgtaatcccagctactcaggaggctgaggcaggaagatcacttgaacccgggagacagaggttgcagtgagctaagatcgtgccattgtgctccaccctgggtgacagagcaaaactccatcaaaaaaaaaaaaaaaaaaaaaatagacaactcaagcaccaaccaatacagatcacagggagaagtgagggatcctgaggggagcgagacagtccagtggtgaaggttttatgccacgacagtgagaactgcagaatgtgcactggggagatgttctggaggtagaatccatacttgtccctgacatttgtggactcagggaaggagcaaaatcgcaatgtcctcaacctgtggcccgacccctttcttggccatcctcctggccctaatcactacagcaaggggtcccatgtgcacacacacacacacacacacacacacacacatatgtgtggagccctcagcttgcataaatctatgctacctccaccagccacctcttggctgccttgggcctagggttgcacacataggcagtgttgtctgccctcaggaggaccacctgggaaaggggcccacacaagtccaagaagcaagctcaaggcaaacatttggttggggactttcaggatccctgaaagtattcggagtgaggcgtagatgaggaagggtgtgggttccgggttggcatgtccccttggcccacagactcctcctctctttgagaggatgtggctgtaggaaggagacaggggaccctctgatgcctggagcccagggcagggccttcagtggctgggtggtctcatcagccaaacaaggaacacatgacgaggagcagcttgtagggtgaggacagcaagctcggtccccagtgtgatgtgttttgggtacccacagcagtgtacctccaggttctctgagatttaaagaagtttggttagggggaagacggacagtgtctggctcttgaatgagtgcttcactgtgtactattttagtaacagagagggctgtcctgaagtatctgtctctctctctctctctctctctctctctctctctctctctctctctccctccctccctccctccctccctccctcttcctccccccttccttcttccctcccctccccctctgtttctctctttatctctctgtctctgtctctctttctgtctcatatggaaacacatacaagcacacacaaggactagtaacagatttgaccttctctggggaagttcagttttggggatttgcttccctccatagaagaaaaacccccaaaacttctggtggtctctagggagacaaaacaaaataaaaaagatgaaaaacccctagaactccagttttaggatgcagtttacctgctgggaactgaatttgtcattttctagtttttccttttcagtttctactttaaatgttaaaggtctaaactttgggaaatacttaggggattttgaaggaaaaatataatgaaaatgaaaggcacaatggaatcttttcattccaggggcaagagtatggaaatgagtgaaacccaagtggctctcctcagcccccttccctctctggagaagggcagggactccacaggcctggacacctcattcctgtcttgcttcttcagcagtgtgactatgtagtctaagtttgggaacatactggtatctctgggagccattatgagggctcaccaaataacttgggacatggtaaatcctcaataaatggtaatgtcattattatttctcttattataattactacaatttaattcctttaaatggtagagccatggtcaaattaccctggaagaggcgtaagtcatacatgaaaacaaaaatactagagaggaataaacaaaatgataattataattgagccaggaggattaggatgtattctaagaggagataactcttggtgtagctgtggaattggtgcttaatacatgatggatggatggatggatggatggatggatgagtgggtgtatggagaaagggacagagaggtgagtgaatggattggatggatgggtgaatggatgggtgggtgggtggatagacgaatgaatggatgtagggttggataatggatggatgggtaaatggatggatgagtgggtggatagatgaatgaatggatgtagggatagaggatagatggatgggtgaatggatggatgtgtgggtggatagatgaatgaatggatgcagggatgcattaatgggtggatgggtgaatggatggatgagtggatggacagatagatgaatgaatagatgtagggatgggttaatgggtggatgggtgaatggatgggttggtggataagtagattaattaatggatgtagagatggattaatggatggataggtgaatggaccggtgggtgaatagatgaatgaatggatgtagggacggataatggatggatgggtgaatggatggatggagagatgagtggatagatagttgggtgaatgaatggagtggacaggtggatgagtagatggatgaataggtagagggatggatagttgggggagggaggaaggaagggatgggtgaatgaatttctgagtggagatacttcaaataactgtgtttttctgctctcaggggccttggaattattggccattctcctgggcagttgttctatctcctcacctaagtccatatatctacttgctttaccagtgctggggcagtgagcaaggtcaccaggatgcatgggggcagtgtgacccccattaagagggatgttttgttgcaacaatgctgagagaatgatgtgtccatggaccagggacatacttgccccagcagttggcatacttattcttctgtgatctgtgctatgctgcctgctccttaagcccttcctgtgtagtcaggtgtcatacacaaagctaccttcagccgccttttctggactccgtctccattcctctgcctttatctccccctgcccccagggagaaaccctgttttctcagccatcctctttcctgcctcctcattgttgcccatactgttccctgctaaatcctcgtagagctgttactatttcaagcacctttgcaggtcctgctcaaatgccacctcttctatgaagcctttgctaagctccttaaaggggttctgattagaaacatgtttatgctactatgatcccggtctacaccattcccacaggctctccagaatgctgatccaagattgacttgtgtttggttatctgtgcccttgggtctctcttgggacactgagctccttcctagagggcagagactgtctgcttcagctctgtctcccacgtagcctggcaccaacatgtagtggttaatatcccagatcattctcatctcagaagcgggggcattgtgctgtggttgagtgcgctacacgccacacctgtggatttcgatcattgggtgtgtgcctgtttctttaaaagctgcattcctattggcagatcttctgatttgataggactttaaaatgatgctcacttaaaaaaaaatccatgagcgactttgtcttctcttcaaaatctttgattcaatgcatatgagcccatcttgaacagtctagcaaatagtaggtgcctcaaatatttctaaaggaataagtggatttttctcagaagctgttcatttgtccacctcgtggcccagggagcagtggcctgggcgatggacgcactgagtggtaagtgaatcaatcaagggcccagagagggagaggcaaaggcaaaatgaaaccacagaatgcaattgtcctgtcttcccttcttaatgtttaatagtgtttatgggacagtgacacatggagaaatatttaagagacatttatagatattttaaagtataacttatgattgatctttttaataccagaagaatttgtatttaagtgtgagaaaaaaactctgtggctgtgtgactcagggcttatttttcatgagaagattgccaggggagcccctcttgcttcttgaacttctggaaagcaagagaggtcccctgggaaggagctttctctaagttggatgcatacaggtgacactcatgatgtgggcaggaatccagggcttgggagagctttatcacacttgcttcctcattgtattgtgtaaatgagccacaggcccactgagaccccagtctctttttggagaagaatgcaaacagattcttctatattgaggacccatggtgcagaatgtgcagggcacagggtatcaggtcatagagaagttggtagctctgtgaccttgggcgggtataagttgctgttctgggcctgagtgtccacgtctgcaaaaaaaatgacagtgctctcctggggaaaggtaagatcatatgtgaaagctctgaccacagcagttgatagaggaaaaagtcaatgtcagcagcctgcctgaatcctttacttgaagacagtgaaagcagacagttaggaaaggagaaatgcactcatatttattttgcagcaaaaataaatatctaagtgagaaatgggtggcccctggacttgtgggcttgtggaataactcaaaccttatttattcagtcaacatttgttgagtatctgccatgtgttaggcaccgtgctcatgttattgtttatgaaggttgaaaaagacaaatgtggcctcagggaattgagtttgggaggagaactggatggatagatgctaaagaaataataaaacaaatgtatggctgatgaagagaaaccttaaaggagctatggcccatctcatgaacttttaaacatgactcacaagaagtatatttgcatagaagactggtgtgtgtgtatgtatgtgtagcaatggtttttccttatatgggcattgcactggtatttttattttattattttttaaatggaagttccaacccactaaattaattatattgcctattattgggttgccacttgcattctaaaaacttctgaagaacaattcttaaccttttctgctgcagttcctttggtgcacttttgataaagtgaaatgcaatataaagcccttcagagcgtccattttgggtagcattcactccctgaagaattagagtctaaataagatggtagactataatcaataattgaattctagacctagtcctagctttttagctgcaaaatatgggcatttgtgttggcatgattgctaggatttatatgcatatttttaactcccgataataagtggacaaaatgactctctttagctaattttaacgctcttttacatccagatacttattttctttcattcaaactcaaacaccttttactaaggttttactatgtatcaagtttttttaaaaaagagaaaaaacatagccaatacttgtctagtatttgttatgttcaaggtactaatctcagcacttacatgtaataactcattaaatacaataacctgattagggaggttgtcttattatttccattttacaaatgagaaccaaggttcatggaggttaattaatgggcccaaggtcaagtgatggagttacatttgaatccagaggtctcgggcttaggaacctgtgtttttaaaattgtgggctttactagcacatatgttaaaacagtcttttccatgccgcaaacgccccttactctttttcccccccgaatgattattgtttccccaattatagccataatatgccagtttaagtccttcttttgcaggtagcttgtcccaaggacaggcatcagtgtctcagcacctctgctttgatccatcctctgggtggatttacccagtctgcctttgtagagtctggccaagtgaggttttgtccaaccagattgtgagataacatggtgtggtggtgtacagccacatttaaaaaatccacgatcttgttgcagatgtacgattctgttccgtcaaacaaaaaaaaacctgccagctgcgattgcctctttctccttctgtgaagccaatgtcatgtttcctacgtttcagtcatttggttttaccttcatggttttacctgatacttattgtttttctataaattgacttacttaaaaaaatttcaataaaattatttaaatgaaaaccttgaatcagtactataaataaataacaaaccattatcaccttccatggtagaaataactgctatgaaaacaaaacaagagcattaaatcctagctggttatgtttgcctgctgatggccattagctcgaggcctgtcctctctctgtaaaatggaacattggaaaagtggttatagtggtcagggtttagtggtctatggtttagtggtcagcatgctaggctatgctgtggtagtaagtacaacattgaaatcttgtgacttaccccaacaaagctttacctatgggtcacacaaagcctgctgggctcagagtactccccagggtcgtgtccatcctgaatctccactcaaggctgcagactgtattcattctggctccatcaccacatcatacagcttgtctggtggctgcagaaagggaggagagggtgaggatgcaccatctttacctgccttggctcagaagggaccacataacttctgctcacatctatcggtcagagccagttatatggcctaggtctcacgggaagggacaacactgggaaataaagaagaacaagtgagtattttgttaaaggtaaccttaaatacaacatcgagattttgttttattttgattggttttgtttgcgtttttctcttaacacaagcagaaacattgaaaacaagttataaagaggaaaactccctcatggtgtggatgtatgttatctaacgttgggcctgagaactctttgccatcagctctcatgttcagtctgcaggaatccatgctttagcaggtcccagcaccaaacctgtgaccgtggggccattgaggaaggtcattcaggagcagggcaacttcccagaacaaaacttcaacatgaacaaattttgtttgtttcggaaagggatacctcccagaactttgatttaccatagtttaaagatgcatagaatgtcacttttattgttttcatgtgatcttggccttttcaactgaggttttaccaaacacgttattctctttaggaacaggctaattttgtttttttgaggctttagcctggtttatgtgcaaatgttagatctccccagctagaagacagcttcatgagtataggaaacccttcagtcttcaaattgcccaggtgttcagtcaccagcagtagatcctgaattggtgatctgggtgcaaatagcttatttacaaggcaaacctgcgaatcaccagcaggggagcggggaaatgagacagggacaagaaggacatccataaagggtgtgctatcaagccagttattgttgtggacaactggaatgtcattttctagggaattctgggagccactggagcatatacaccacaaaattatcccacccacggaggagggagctgggccttcatacactaatgccgtcagtcactggatgagagctgctcctgggagtatgttcctcagaacttcctgcccagctggaaggtgagcggatgtgaagtggagcaccaattgcatctgctacacccgtagtgcctattggtcagtctttttgagtccctgggagccagactccacgatggcccccattccctcccggtcttcatgttcttatattgttctctgccactctgaagcagggctggcccttcctggcagaagtgatgatgtgtgacttctcagtctttgtctttgccttggtggagccagccaccatgtcatgagaggctcatgtgggtagaagctgaagcgctggacaaccgttagcactaactgctagccacgtgagggagccactttggaagtggatcctccaacgtcatttagcctttaggtgatggtgctcctagctgaggcaaccacatgagatacccaccatgagaactgctcagctgagcccttccccaattcctgacccacagaaaccatgtgagatgagaaatgatcattatttttttaagctattagtttttgaagtgacttgctatacagtaatagatagtacattaactgtattagtctgctagaactgctataacaaaatgccatagactgggtggcttaagcaactagaaatgtattctctcacagttctggaggctggaagtccaaggtcaaggtgtcctcaggattggtttctggtgagggctttctttctggcctgcagacagccacctttttgtgtcctcacatggtctttcccctgtgtgcatgtagaaagagctctctggtgtctcttcctgttcttataaagacaccagtaccagcagatagcttaaggccccaacttcatgactctttttaaacttaataaccttctcaaaggctccacctccattaccaatgggggttagggcttcagcgtatgaattttggagtgtgtgtagggggacacaatatatcccataacactcaccaaagtcttgcatgttttggaagtcagcagaggtctccagcccctgtgcttggatgacttcctctttaagtgagggataacaagtcaaacaacgatgtgactttggtgggaacataaagaagaaacgggggccaggcacggtggctcacgcctgtaatcgcagcactttgggaggcctaggtgggcagatccctgaggtcgggagttcgagaccagcctgaccaacatggagaatccctgtctctactaaaaaaatacaaaattagccgagcatggtggtgcatgcctgtaatcctcgttacttgggaggctgaggcaggaggatcgcttgaacccgggaggcgggggttgcagcgagccgagatggcgccattgcactccagcctgggcaacaagagtgaaaactccgtctaaaaaaaacaaaaaagcaaaaaaagcaaaaaaacccaaccaaacaaaaaaaaaaaaaaaaaaaagaaatggggataaattatctgtgcaaagattcttagtgagcagcttccttgtaacgattacatgcagaagttctttgggggaggtaggagaagaaagaagcaagatataattttaaaaggagctgcactatttcagaaggaaattgccacctaaggtgggaggcattgcagcttcctggtgctggaagcactgaagattgccctgtctcctgtgttgcctgtaatctctggccttggttccttcagtctggctacttagagctttgtgattctttagcaggggctgggaggtattaggagcccctggccctgtatttctgtggcattttatttggcctctctagggggtgtattttcgagcagcagctgtgaggtcaccctgggtgcagccagatccccatacctgctaatttagctccttttgtgagctattttatttcggatgccttctgtggaaattttgttccagactgacttgaaagtgttttcagcatcgattctctctttgaacagtataaccagggtttgccacttgtggggaaaaaaggagctcatcttgagctttaagaacagtatgaggtgggcttcctgtgtccagcccaccccagtgagaattatgccatgtgtcttctctccaggataaaccgacttttccattttacataaaatcgaatctcttgaataacaaagagtactgtagatactgaactggcttctcgggactagatggacacccttagtttttcagggctaataattgttttttttccatgatcaagttcccacatggacttcgcccacagtgcttgtttttctgtgttgtttgaggtagtggagagagagcacttcctcttggggaaatgattttcatttgctcacttagcaagcacttttgatcctgttttgcttgaagcttcatgtcagacctgcccatctgcatacatgcaaaagaagtaggctctctgggtccttcttctgtgatggtcattagtttacaaatatttcatttgtcctacctctgtgcacatgaaatcgaactccctgccctgctgaaattaagtattgtcgtatgacttactttggccagtggattatgagtgggggtgatctgttttatctcctggaagaagcctctaagagtcacgtgtctgttcacactgcccagcaattgtattgtttccaatgccagaagctttgcctcccctccagtttaaatcatccttttgaatcaaaccctctttaaattattcttgtttgcctggatcatttattttctgttgggattttgattgattcagtcatcataaaaacagaacatgatcattcaagatgatttagaaagtggggatgtagaaataagtttaagaaaaaaaatccatagttttatacccaaacatccctgatattaacgtggtcattttttttttccttcttgacttttccttgctcagtgcattgtgctttaatttggttgtgatcatttggtatgtacaattttaggtgctttgtcatgaacattatgttttacatggtattattacacatcataagagtcctttttaataactgtataataagtgatgcagtttaaggaaaaaaattctaaattttaatatcataagaaattatattctgcatagctgaagtatatcctgtggtagaagagggggtaaatcaagaaaaacaaattcaatgaacctttctccggtgcctcccgtgtgccaggcttgtgttgggtgcaagatatggaagcaattatgacagaatcatcaagttcccatgggcttaacactggtaaatgttgattctatgtctaatcctcttgggactaggttggatttgttacccacaaaattttttaaaaatctaatttgaccaatagaatttccctcttttgaaaaataatacacaaaatattgctcttttccctggagaggattcaagcttttgcaatttgggggagatagactttataaaaaaaagagacaaaatcatgaataggaaagaaatcacaacacattatttaatctgaaagataaaagtatcgtttatatagcaaacatactacaaacatccagaagataacatacaattattattattttataaattgttttaattaactgcctggcaagctctgtaatcttgtttctttcttctagtttttggctgagtgcttgttgatctactcttcatatgatgatgattttgtaatattgttttctatggagagaataggaagatgattcattctcttctggcagtggttttccacatggtctgcacaggagaatattttgggaacttttaagaatcctaatgttcagatgctccctaggtccattaaatcagtattgctggggccgggtgcagtggctcatgcctgtaatcccggcactttgggaggccaaggtgggtggatcacctgagggcaggagttcgagaccagcctggccaacatggcaaaaccctatctctactaaaaatacaaaaatttagctgggtgtggtggcgggcgcctgtaattccagctactcaggatgctgaggcaggagaactgcttgaacctgggaggcagaggttgcagtgagccaagattgcgccactgtactccagcctgggcaacagagggtgactctgtctcaaaaaaaataaaataaaataaaataaaggaattgctgagaccctggcatcagtcagagccccagctctagaatgggtgatggaagtttgatttttactattgatcatttagaaaagtttcctttagcttcactgcttgttactggcattgtcatatatgtttttaggcttgttgtcaaatctgggaagacctctctccaatttctttcagaagtaagctgtgagacttcacgttgtttcaagttttctgtgcggtaactgatcttaaatgttctttgaatggaagacactcattaaccaatttgtaatgtgtcctcattttctgtgtattttatgagttttatgttatttttcattgagatcagtatttttatgtcaaaggagtaagaaattaaattgcctgaagaaatgggattggatgagaccattttgccgaaagaaaaacatgagcaaaggcgaagtccagcaggcgagtccagtgtggggaggcagccaggtgccaggtttgcagctgtgtggatgccattgaaaggggagcctgtgtgcaggtgggaaagggctgtgtgctggcagttgtttagtaagggagcaatatgttcatgaaagacagtgtcatgccatgttgaaattattcccttcacacacgtaaaagcggtgtgaatcccagctctgccaatattactaaccagcaatgaccatacagggaaataaaacatacagatagccctctgcacccaaacccaacccatctccactgaactcccccttcaccagatccttacactgccgtggccataccattgccacctgctcagaagagaagcatgacgggcaagttggggtaaaggagacagcagtcttagccaattgagattaaaatatcctacttttgttaattttcaaaaacataggcctgtgaacacatgttagttccccttggaggggcacctaccagggaggatccctgaattgtgagtgtctttagcgtcacagttagcccacctttgcttctgcatatgaattagtaactgaatggcatatatgctgacaaagctcaggcttaagtggcaacagaagagttgttgatgacaaagttctaagccaaggaccttaaaaagcagtgcaaacttgtgtgcccttcccagcatgttcattgtatttgaaatgactgttgcttttttaggtagcagcttcacaaacctgttcaatatcatgatatgaaaagcatcattcttaggttgccatcctctttccattgtgtaccttgacaagagagtcctttaggaaatacagcagaagctgaacagaagccagcctagttaggggttctgagtctcctcattttctgacacaaaacagcgatgattgctccttggggagtcaccactgtgtgcatttacaccttcccagctgtaggtgccaaggtttagcagctcataatctggtttcacattcctggtctttgccatttctgagatgtatggagcctggtgaatcctggaggggctcgggtcatgggcagtgctcttccccagaacttgtttgagacaaggcaagagatggaatttagcctcggtctgaaggcgaggacactgggccagaggctgtctttcactcaaggatatttattgagtgcctgctttgtcccaggtttgggttgtgtgctggggatagagatgtttcagctactcttgctgagtaacgacacaccgcaaaacttcattgcgaaaaataaccattttggtgtgctcatggattctggggtcaggaatttggacacgggaggggtggcctgtgtctgctgggacctcatctgggatgacgaagactgaggatgacttgatggctggggattggaatcatctagagacagctttgctcacatgcatgtactggaacctcagctgggctgtcggctggaaccctatgtggggcctctccatatagtctctgtctaggatggtttgggcttcctcataatgtgacaggtgggatccaagagcaagcatccctagagaacaaggaagaagagctcgcttcaaaaatcctttggcatcacttatgccatcctggttgagtctgtaaaattccacccaacttcaaggtagggaagtggtatgagtttaaaactaacatgtagaatgggaaatattgtgcccatttaggaaaaatggaatctcaaagcacccatattctgcccttatggaactaataacctagtagggaagacagtgctgccccagatcactcaacaggtatctattgagcacctgtaatgtgccagattctgtcctaaggattcagagatacgtaagacagatggaatccctgcctgctggtgcagaaatggatgaggaacaatgaaattaatatataatgtaatttcaggtagtaagtggtatgaagaacaataaatagggtaaggggatagagaatagtgggaggtgctgcctcagatagggcagttagagaagcctcactgattggttacattctaggcaaagggaaaaacaagtgcaaggtccagaaacagaaatactcttgacatatttgagaaatggtcagaagaccagtgtggctggaacacagccagtgaggaggagtggttgcaaatgaggttggagaagcatcaaggggtcagatgatgtagggctatgcaggttgtggtgatgactttggatttgacactaagtgcttataagagccaacttttgctgagttatactgcagtaacaaccaaatctcagtgtcctacaacagctaattgtggtaagtactgtgaaggaaaatctcaagggaaaccttaaggaatggctacctacagtccaccttttaactgagacccacacggttgcatgaccttcatgagttggccatggctcttttccacgttcctttcatcccaggactccggctgaaggacctgccattctctgggagactgctatccttgtagcagaaggaaagggcgatggtggaatccataatggcttctaaagctgctgttttgaagtgcatgtttcacttcctgctcgcgtttcattagtgaaaataagtcacatggccaagcctgatagcagcggagtgggggtgattaattctctcacagggaggggtagaaatcagttaggtgcaagcaacaccctctaactgcgagccattggaggcttttgagtgggtaatgacataatctagtttgcatttgcggaagatcccatgcagaaacaaatgtcacactgcagctgcaaggacagtgaggagggagatggccatggtgccttggtccccagagtgacggcatgcggaggcgtcaatgcatctacctccagcacaccaggcatgatgtcaggtgcagcaggaggtacctggccctttgctacacagaccacatggtcttgctggggacaagacctagggaacagctcattttggtacagtgtggttggttcctggagagggagagggaatagcccacgggctaagcagcccactgcaggtacctaatgcaaccaggaaggtcagggaaggagatggccagccacgcggtggagtttgaacatcatgtagcagttagccaggtgaagaggagatgctggggagacagggagaggccactcctggctgagggacctgtacctgcaaagactctcaggggaggaggacggctttctgtcactgtttctgtgtgtgagggaaatcagagggtaggcccggctgtcccctgcctttcctgtggggcctgactgcacgtaccccctctccccaaaccctccaggagttctgagtctctacctggatcttgattccactggcatgaaatctgtgaatctcacctcgagaatcctccctctgctgccgcaggatgggaccaacagttccctgcagtggcaagggagctgttcacacactgagcgagcagtcacagctgccctgagctccacattctcctcctcgggggactcccctggaattacctttgtcattttactttctcaacccctgtgtttcctctgatatcttacttatctctggtctttttgtccagacagctcttaagccttgggaggaaccttttcctctgatccctttttaggccattatcaagttcagggtgggagggtagagtcactgtctttccaggccttgctgcatcccttagagaccttcggagggggcactttgtgaccagtggggatgggggaaggatggcttggtgtgtctgtcctcacccactaccctctgcccacttctgcctgcccttcctctgtgtggcatatacagtactgcacccctgagcaggacattccccagtgagagccccaggcccgacacttccaggctgtgtggccttgatcaagttagtttccctttcgtgattcagattcctctcaggctgcttgtgcaaactcaacataagaaagtctgcgaagctcttaacccagggcctgggccatgctagggggatcagtaagcagtttctgccacctctgttactgccgctttcacctttccttgtggaaaagagaagcagccagaaaagctgggttttagccccagctctgcctcttaactagctaagtaaatgtgggcagaatgcttgacttctctgaatctcattttttttttttttttttttgtcaaacaagatgaatgaacaagatcggtcttttttgatggggacttgaatggtgtgtggggggacagttctttgtgtgggacggtccacactaaatgccagttatccccacccattgttacaacccaaatgtcaccccccaccaagtatttctccatgtccctatgggttggtggtggaactgtccctgactgaggaccactgaactagcttaccctaaacttcactcctgctctggtgtcctgtgtgggtggaaaagtgaggacccagtggagcaggtagacaaagatcagttcaacagggccctctgctcctttgatattgggacagcttcacttcctctgaattagaagcttcttgacctccatatattgaggaaggaaggggtttctaacaaatgaagaaacaggctgggcacagtggctcatgcctgtaattcccctttgggaagcccagttccatctctaaaaaaaaaaaaaaaaaaagaaaaattagccaggtgtggtggtgcacacctgtagtcccagctactccggaggctgaggtgggaggattgcttgagccgaggtgggaggattgctcgagcccaggtgtttgaggctgcagtgagccatgcgcatgctactgcactccagcttgggtgacagaatgagaccctgtctctaaaaacaacaacaacaaatgaagaaacaaagctgattctgtgctctggatccctctttgtcccctagtcacatcttatcattaatatatgataccatgggatggtatagaggcaaccatgtggtcaccagaaatatgcatttgatctccagtggtgtaaactgaagtgtgccatccagagaaaggagtcacaaagggaggtttaggcatgccaataagagaggagcccagacatgggaagagtacagctgtgtgcctgaaatacttgttgccctgtgtgccaggaacccacgaggtgggtggaggctttgttgagatggttgggcttcaccgtgactatccatgtcaagctggctgtgtttcctttcacactgtctcaacatttcaaagaggaaatccaaggttggagatgtaactgctggggacttttcttttccagcagatactctgtggtcctgaggaccactggcaaccaaagtccatcatgtcccattcccatttattctcccgaggctgacagctctaaattataatgctccttgctgaataccattaatcttaagcaagcaacttactgcaagttattagctgctcaccttgaaatcctatgaataaagaagaaaattacccttctgtccagagccccttgttaattgaatatgtggtagaagaatacagagagtgtcattaatttcaagatacaggagtttgttgccccctttttgtttttattttacccttggatgttcatttaattaaattatttaaatttggtaatgtggggaagataatatgggggaagattttattttcttccccagtacctttaatcacaatcatcttagttaaaaaggtgttagtgatgctattgcctgtgtggtgcttcatttataggagatgaattttgaaaagtttgttgcacttatcagataactttatgaaccttttggaacattttaaatgagtttttatgagacttccatgacaatattctgtgtatctctttgatgtggagagaggaagattgcagacttcatggtctgaaaaattatgatgtatttttatttacattggactgatgatagatttcaggtcatttttcctatcaaagatatcctgatgaaagttaatattttgcgggaagattttatgagttataatattacctggattacagttttcttgaattacgtaaaaacgtcttgtgagattgttttagggaaaaggattccacttgtcttcaggtcttgggggaagcatcttactccctttgcggaacaagaatttctatgtacagagtgtcctgctgtttcctctgcttgcacttaattccctccaccttgcattcttattgagttattgagttattctgttgagttattgagacagctgtgttccccactaggtcataagctcacctggggtgtttagatattcccaaaccaggtatatagttgatccacagtaaattgttctcagtcaagccatgttcaatggaaatatgtatgattttgctagctctgcaaaggcactgattggacctgataccctccaactctgattaatgcctccccagccttctgcttttctctcaccaagacatagcatcttccagcgggttccttatacccatctgccatttgtcattgccatacaccgcagagcctggggatttgtaatgactaagctcaggtttgggagataatgtgtccaacttgaccagctcccgtggagtcttggtgaggtcaaggagaaccacatttggatttttgggtctttgatgtagtgcaaagccaacttttagaatcagagagtgtgggaggaggggttggggtctagaggtcatcttgtttaccaccttcattacttggggtgcagaggaatggatacccaacgtagttaaggtggacagagctgcttggtggaatagtgaggtccttgtcactggagaggctctggcggaagtggaatggaagtccatttggttgtgactgttgtaggaggctttaagtcttgggacaaggcagacttaagggagcattagaacagaagaccttaaagggctccctgtagattcttatcttgtctaattcaagggtgagcgcagtatttacagattcttctttgcttttgcttttcttctccatgaatgacagtcccttccttgtcattttttttccatagcttcctcttcttcagtccactgtcttctcatttttgccctaagcactttccttcactcctttctgctctatttttgtctacatttttctttctttctttcctttcctatatttgacttgttagtgagcccttcagtagagccagctcagggctgttctatttgattccttgtgactgaaagaagagatcttgagaagagaacagttaagtggctggtggaaatgaggtcagtgggagcctctgtacagaatctgggacactaggttctccagaaatgcttatggaatgaatgagtttgtaacttccattcgcttgggctaacatgatttcacatttgcataagggtgagtaggttgtgtttggtaattcctgcaaaaatatcattggaattttctacctgcttggagtgcttatcttttaaaatgtgaagataagtgaacagccgcgcagtgatgttgaataagttagggtgattttagggtgggagttgtttgcagttttaaatggagagcccagatttggaattcacctcccatgatgctgtgggtactgaggagccaccttaggaggcctggattaattctgtttatagtccaaatgagattcccagagtgtttgctgaggtcagccgacttctcagcattcctgccactgttactgtggttggcctaggagcatgggaccaggccactcctttagggcaggcttgttgactctctgaagtttgtttatgcaaatgaattaacaactgatgcaaatgggagagatggaaggcccctttaggtggtccaggccagcattccacagagtccaaaagctcagccaagccaatttgcagggtctcatctatttcaatatttagtgccaggaaagctgacctgtaggtgccgcatcccaggggttctgttctgaactctcactgtcctgcgtggaagatcttctgtgcactggcctgaaattcccttgctgcgccattttatctttcttggttttagtatgtattgtatggtgctcaaaacggtgagattgaaatagatgtttgaggacactgagaatatgaaacatgccatcacaactggcagggaaatgttgcttatcctgagtctgcttgtgagctgtgagttagttgtgacacgagagaccccaagggtcattggttttaaaagcacaaaactgaaaaactacagaacaaaacaaacaagcagcttttcagatttcttcgaaagtatcaaggctgaaatagatcagtgtctggtcttgaacctgcaaaaaaagtaacggcctgtgtgattagggtccatgcctaccacagggctgtggcctgtgcccacagacccactcagctcatgtaaagggatttttttggatatagtccttttcttctgggctccggagattgaaaataaagcttcatggtccatggaaagggattgggaaccaagttacattttgctcagtggaccatggcctctcattttgattctgtttcatgcatttatttcacagtttattactgcacttcggctatacacagatacttgccctcatgaagctcatggtttagtaggaaaaacagaaaataaataaataaataaataaaaattaaatggtgactcatgcaataaagacaacagagaacagtgatagtagtgtgcatgtatgcaaacgtgcatgtgtgtgcgtgcgtgcttgtatgtgtgtgtatgtgtgtgcatgtgtgtgtgcaagtgtgcatgtgtgcaagtgtgcgtgtgtgcgagtgtgcatgtgtgtgtgtttgtgtgtgtgtgtggaggtggtgatgatggatcagggaaacatttcctatataaggtggagaagaaaggcctctctctgaagaggacacatttcagccaagatctgaatgataatgatttttccaggtcaagagtgagggagaaatggccgagcgtggtggctcatgcctgtaatccccgcagtatgggtggctgaggtgggctgatcacctgatgtcaagagttggagaccagcctggccaacatggtgaaactccgtcactactaaaaatacaaaaattagccaggcgtggtggtgggcatctgtaatcccagctacttgggaggctgaggcaggacaatcacttggacctggaaggcacggaggttgcagtgagccgagattgcgctattgcactccagcctgggtgatagagtgagcctccatctcaaaaaaaaaaaaaaaaaaagtgagggggtaaggatggcctgggagtaggccattccagcaacaggtacccaggcggttctgccaagagacccagagaagaccaggataatttgcccctgggctctgttgaccttcagagagaggcttccacatcagacccaataggagcagaagtttgttgattcccagtacaaaataaattactgagtaaacgtcaaaatataattaacagttagtgtatatgataaacatattcttgattcagattaagtcttaatggccagatttagggccactcggaagcacagtttggaatgccaaaatattgctgctgttttggaatgccaaaatattgctgctgtgcacctcctctgtgttgatcattttgtcctaggagggccaagaaatctcccttcctccctgactacctccctccctccctcctttcttccttccttcctcctttcagttcagcaatatcagccaagggcagatcagtgagtaaacccttcttctgttggaatcaatttagctcagtagaagctttttatataaagtctggcaagtgtacattttaaagcttctattctgtttaagaaaccaaattttcatcaaacttgaactcagctggaaagatgagtagattttattattttgccatgccaatagattccagtcattctctaggctttgtcagatgttttaaactaaaaaaaaaatgacaggtggagtaatttttatgaaccttatgctgaattatcagagaccttatgtattgatagagagagcctagacagggggcctgaccgtccgactcagggaggagaaagcgtgtggaccaaatgttcctgaaggaccttacacatctggaactttgaggattccctattttaggtactttgatggaagtttcatgagccttctgtttacattttaaagatgatgacttttttttttttttttttttttaggaatagctagatgatccgggaagttgcttactgaggctttgtcatgaggcatcagttactttgctgtgccaaagtgatcttgatgggttactgtgagaggagcccaaggaagagctttgatgattcttaaaccaaattctcgagtgctatcgggtacattctgacaggccctgcagtcttcgtggttgtagttttcttgggtggcagggctgacccctggcagtggcacgattcactctggaatgcattcagagccattggagatcatgctgccctaagtaaatcactgtcactgaggaagggcatgttgtttataaacacccagattccagatatgaaatattttatctccaactctattggaaaaaattataatctaaaatgattattaattaaaacaactcagatgtctcttgacactgagaagcacagatgattaggtaaggtgggactcacaaaaagcttaaaggtttaaactgttcaagctaccagccagagggtgaggagcagagttctgactcttcagtttggaatgttttgctagcccaaggtctgcttctccaggaccatggtctgtggctctaatggcatgccacttccatgggatatcttcccactgaactttggattattcgaggctgaacttcttggtccctgtctcttcccatgtctgtctgcctgctcctgctgaccattttcctctatcttctgtccttcctgtctgtctgcatctccaacattcatgcctgtctctggatgtccttctttcctcaactggagcctacaaagatctcactgtctccttccttttctcccgactctggccatctcctctaaatggccaaagagaaagctctctcttatttccacggatggcctgaccatggatctgtcgagcattttccttgcgagcactcctttgcacagaagagcggtcctttgcggtgtttgccctgcaggtctgccctgccagtgcctccttcaggcattcaccactccactctccccttccacacccaacaatgctgtttactctccgtgggctgccagtgtaaatccacattgaaaggtgttcatttgatttggcagaaaacgtgttattcatattaggcctgtgcacttgttttcggtcgagcctttgacatgtagtctttggcaagccctggttgctacacacagcactgctgcaagctgcttggatgtgacagtattgtgggtttcccccctctctggaaatgtaaactctccctaaatctaaagactccctctccctttgttgtacattttaaaatgtggtctcgcttcctgaatggcccactacatataggtggggatgacgtaaacccagctgggcaagtgcgggcctagaacccaatgctaagtacatggagaaggtgactactaattctatataacatattttgcagagtaaaccttagttctagaataaaagtatgtgaattagattgaaacatgaaactgttgatatttcatcatttttgacttaacaaaactgcccatttcatatgattcaacctactagtattgaatgactagaaggcagggtggacattgtttacaataactctttgctttctatttcattgattcatttcttcaaggtacatctattgatcatattttctatgctgaacattttagtaggtattgggattacaaagagaaatcaagtttctttccttccctctagccaggaagaccaacacttaaccaaatccaaaacatgtcaggtgcttcaagaagggcctctctgagagagctgagggcaggatggggtgaccagctatcctggtttgcccagaactgtcccagttttagcactgaaagtcctgggcactaaaggaactgggaccagttcatactaagggatgggggcatttatggctctttgcaaaaataacagctctgtgacctgaaatgaagcccattcctccaccttgggagaggcaaggagtacatcagcaatatgaaagctccatgaagtctcagagtggagaaaactgtttaatttgtttaaccagaatttctctgacttatttgatcttggaaccctttttgtgcttaacattctgcaaacatctttgggtcctcccctctttgtcccttggggaaaaattatatcattctctatcctaaagtgcacattattaccttgtattattagccttctccatgatttgggcaacaattagtattaaaatagcccatcacaagaaaatttaataataatgcaattttaaaaggtttttcagaaggttgctaatgtgctgtgatgggttatgagttaccacaaggctgctttttttctggccgacacacacagaaccaggctgcttgctcactctttctgcaagtgaattttttgcaccaaaggcagaagcaagttgttatggaaacggaaacagtctccccatctgagaacagcaccttgctaataattagagaacatggctgagcaaactttagtggaaatgattaatctttgcaaagcacaggtacgtctaaaagattgaacaggtgttgtttggcctttgcactttccagccccagaaaattttaatttagaaagagctgaggaagctcaggctttgagtctttactgactttacaaaagaaagtcatcctttaatataatagtaattggctaatttaaaattttaaagatctctcctaagcttatagagtgtcagcgtggtttgtaaatccctgtgagcttgttaaaatgcagattcctgggcctctggacccactgggggatggttttggaatttgattgcttaacaaactgtccagatgtgtttgatgctagctaattggagctggtccttgctctaggttaggtatcggtaaacattttctgtaaagagatggataataaatagtttaggctttgcaactctatatatttgtagcacgacagcagccagagacagtacataaaggcagggacatgcctgtattccagtacaatttcatgtacaaaaacaggcaattgtaggaaactatggccccatggaggaatttggccatagtttgctgatccctgctgtaggatgtgctaagtgctgcccaattgttgggacttccattttcaaaagtatttgtgttaaaagccagccatccatacagactcccccttcagtcctacccacagacaggcaaaaagaagatgcctttgctaggtgaggggagacggttttgaacgatttgatggcaaaccattctgataaccacagttgctgagatggtttttaagtgggttgggatcttcttgccacctttcttaattgtggatgaggtgatttcctggtttgggggttattacaaaagtagaatgatgagcttgaactattttttttttgagacagaatctcgctctgtcgcccaggctggagtgcagtggcgcgatctcagctcactgaaagctccgcctcccgggttcgcgccattctcctgcctccgtctcctgagtagctgggactacaggcgcccgccaccacgcctggctaatttttagtattttttggtagagatggggtttcaccgtgttagccaggatggtttcgatctcctgaccttgtgatccacccgccttggcctcccaaagtgctgggattacaggcgtgagccactgtgcctggcctgaagttggactattttgaagaaaaatgtcaggtttttctggaaggaggagatggacatttggtagtggcagtgttggtggaggcatcgatttttgaggtattgttacccttggtttctgcctcatttgctgctataggccttttggttgagcttcagctgtgtctggggcagggggttttgaagtgaggcacggccagctccatctgcacagttggatttgtacctatcccctgacttcccaagacattgaaactcttctttgagagttcagacaattcagtgacttaagtttttcttgccatttcaagtgccaccatagcacagactgtgtcacacacattgtagctggtttttcattgcttttaaaatgcttttgaagtgaaagggggccccattgtgtaagtgttcatagttagcattagcaaatggacttgtaggggccatgggggatgtttcctctggccctctcaagatttgctgagaaattaactctcaagaggcagattaaggccgggcgcggtggtttacgcctgtaatccccgcgctttgggagaccgaggcgggcgggtcatgagatcaggagatggagaccatcctggctagcatggtgaaaccccgtctctactaaaaaaaaaaattagctgggcatggtggcgggcgcctgtagtcccagctactcggaaggctgaggcaggagaatggtgtgaacccgggaggcagaacttgcagtgagctgaggttgcgacactgcactccagcctggggtgacaaagcgagactctgtctcaaaaaaaaaaaaaaaaaaaaagcagattaattggagaaagtgcatatacatttatttaatcattgttttatgttatacaggcgccctcggaatgaagacccagcccccagtggggtgcagaagctgatataccatcttgaggttacagaaagaataggggcttggcaaaacaggtcattggaggggaagaagaggaattttgttgtggtgcagtaaatgattacagggagaagtcagtgggcttgaagagcatacaatgtctgggacaatgtcttttgggcccaaagagtggaccattcattgtttgatataaaagtctgtccaggtgtgttggcagactttagtcttccttcctgagatatgggttcagttaatgaaaactcagggaagggactggagggaactgttttcttctttggtatatccagactttaggctgataaggaacttcagagaatactgtgcattgcctagctttgagggtccttttcagttcaacatgcacaaagcactgtattttggggtgtcagtttctgagccccaacacactttttcacattttattgtgttacactggctgtggagttgatttgtcctatgtgcatacatccaaccagattattggcttttcttctttcctcgctccaggattctgtttttccaaatggtttgcttagtttcaaatttcccttttatgtgtttaaggaagaaacagttctcctggaccacagccatgaatgccttgactcattctgccttcgatgtatttcttttcacgtccttgaagcttttctttttgtgtggcagcaattccttgctgttatcttattttctgatttcttttgaagggataatgatggtggccaatttgtgcattttataatgttttaattcacgtgtgctcctactaaagctgatactggaaacaagtggtatgcacacctgagttgttctgattcagccttaaaatctgtttcccacgtgagtctgtatattgtggtgtcattagcttgtgtagctttttgttgtcattgtcatctcactcatagcaatacaaaaacattttcttttgacatatttatatccagtttcaaaactaccctatacttattcattaccaggtgatttaaagccttcctttgttgattttttttttgttaaccttggcttttagcagtccatggactttgcctaacctgcccccaggaagtgttgctttctcctttggttggggttgggggagtgctctggaggtgttggtggtgattatttcaggcagcccagtgtggcattagggagctggagtcaaaagttagaagggccttggtttccagtatagccccatcctggctgggtgacccagggcctgaggctccttctttgcaacttggggatgatagtaggttactgggaggcagctgtatcaaatgtgtgtgaaatgttgagcttatgccttccaaagagtgagtcccccataaatggtagctgttaacatgatgccaaggaaaaggttggtaaatccattgtatctgctccacagcatgagtcccttcctacaaattccacttctcccagttccttaagcataaataccatctatctaactatgccagttctcatgagcccaggctatttttgacctaaagtgctgtgccttgttacaatttcagcctttaaattccgggttttttatctgtggcttgttattttgggtcttggaccaacattattttacaagaagaatttggcaggacgtcttcagtttcctcagtttcactcctagtaacagaaatggtaggtagaacagtcacatttcaggactaggttgctgcccatccaggagcggttttatcaatctctgaaaaagctaactcctcgggcttttttaatggagtagttcactttggaagactattggctttggtgaattatcctgcccccacacttgcatcctgcagttacaaagcttccttacgagtttcatttttaggaaacgtctttacttctttagtgaaaaccatcatatatggtgatgatgctatttcaaaagttgatcaagggcctgagacaaatgctgtgtgatgggtgcggagtgctctacttcacgctcttctgattgctgctgaggcaacgttttcttaatttcactggtttctgtgtggttggattcctgcttctttgtcccctatatttatctttaacctcaagtgaatgttgctgcctttgtagttcatgagcaatgtatactcttgaattccagctctgtgaaatcggtagaaaatgaggtaaggataattttttaagaaggattaccttattcaaaaatattaccttatttccacggatctgtcatctgtttccatggaaatagaattaggagatggtttctgacgatcattttcaaggctggctcctgatcctcactccagtttccatagagatggaagcaaaactagcagaagacaaggtaaaaaggagtctgtaaagtagtaagctggagagcttccttgcagagaggagctgtccagacccttctctggaggttactatgtggtcagtttggtcatgaaccctcagtgatgctaagactcagggttagtactcagaaaatagcctttgccctaagatgagaagctctgctgttctcaacccttatttttgtcttttagagttggctttagatacggcttcagccctctggggtacctaccttggcctcctttctggagttgtctccaaggcagttgagataatcaggtattgattgcctagcgattttggtaactctggtctcccaaggtggacaggaagagagaagccagcatttgcctacccagagagtcagcctcctgagtctccacactggcagatgcctttggattttctgtgtgctttagtaagcagacacacgaagaaaaaggcgaagttgagtggcatcgtcaccaactgagctgtgctttgctgtttctgagggctgtcttggttgtttgcctggaaattatgaaattggctttatgcttttacttaaatccaaccagtctgcatctttaacagaacagttggtcagatgccgactaattgataccatcaacagaaataatctgtcaaaataaaaactgatgtcctttgaagaaagcagttttaaaataaataaggatgaaatgggatggatgaatgggattttcctcctttggatccagggcttttggttctgggctacagaggggcagagtctgggacacaaacagatgaggctgcctagtgaggagttggtttccagatctgtgaaaagcctctgtttggaaggcactataggtgacagccttgaagcttcatttgcatagcaaacttttttttttaaatttagcatctatattgatgtgagttggtggctgacagtacccagcactgcctctgcccacaccgtcaacctttttgggaggagaggggttagtagtggcttgaagccctaccttgagaggctgtacatagctcatcctgagaaggtcctgtgaccctcatcagaggcccagcacctttttgattttgaaagaggaaaaagggaaagagaaatagccatgaaagaatcttctttgctgaagattaaactgtttgactcaaagtaggaatgtgaccgcttgcatcgtctgtcagtacctcagaagttgcctgtggattactgacatgcagaaggatctggaaggctgggcctttgggcagtcttgctctcttctggctctcccagaagaagctccttctgcaggaattctgttgctactcttggggaacctttctcccatgatccagctagattcttgggtctgtcggtgattggctgagatgttatgttctaaggcagctgtctacgccctcatgcctcctgcccagtggtggaggaaacgcgtaattgggggaattttgctgggattccctgcgatggactgaatgcttatgttccctcaaaattcatatgttgaagcttaattcatatttatatgttaaaaccgaatttgtattcatatgttgaagcctaatcctcaatgtggtggtagttggagatgaggcctttgggagctaattaggtcagaaaggtggagccttcatggtaggattagtgcccttataagaagagagatctgtgaggacacaatgagaaggtggctatctacaaacccggaagcgagccctcaccaggaacagaattggccagcgacttgatcttgggctttgagcctccagaactgagacgtgtatgtctgtttttaagccacctaatctatggtattttgttatggcagcagaaactaagacatcttccaaaattcttcagcagggtctgtgggttgtggccggggctatcagtatgccttggaatttcttagccttaatttctgagaaggtttcattttttcttccttttttttttatttttgcattttatgtcttagctgatgttctttttttttggttttcttttgtcttttgccttttttttttttttgttaaaccttatttgggaagaaaaggaaaatcttccagaaatgtgagtgtaacatgatgaatgaccttagcttgatgtagtggctctacatttctgaaacccttgcccaacagtggcaggaggtgactggggtacgtgaggctttcagttggccaggtgggaaccatgctcaggcccatctgctgtgcacttgctttgtgacatgtgtgacaccaagtgcatgaccttgctttgtcctcacaacagcccgagaagtcagacgtagagtgggcacacaacaaagatctgtcgaccgagtgaatgagtgctaccatctgcatttcaaagataggaatctgaggctcatgactgatgtcagcccagctcccatagccaatgtcactgagatacatcaacctactactgaagctaaagtcccacttggacttcccttagtccaaggaggcccagagcacagagctgggattagtcagttctcccagctgccagccactgcccccagccccaatcattgttggtagctatatatgtagtttctgtcttgtcttcctttgaggctcaagtcatatattgctgcttcttctgagtcttctaagcaccatacctgtctcttgccctaacagacctggctgttgccctgctgatatcctgggatgtacttggtcagtgaccctagagttgggcatattgcatgcactaagcctgtacttgtctgctcaaccttccaccctgggcagcttttgagggtaagggctgtgtcttgctctctatatccagtaggggctcagtaaacatttgcaaaaggaggctacctgatagatgttaaccttcagtagatatctctgagctggtagaccatctggttgcccttgtcatgatgaataacaaaggcttcttagggttcctgccccccaccatatataacaggaggcttccctcttctctgtgactggtggatggttctagcctgagtggaaacagctgacactgagagtattcacccttcacttactgtgaaaaagggtttggttgcagggtcattaatcaagctgtcaggtagaacatgaaggtcttatttattatataaggaggcactttataaataaattgagctatggtgatgaatagatattggacaccaattatgttgctgctattaatcaagatactcatatttagcagtaacaacaaccatgaggggttgtaaaagtaaataaacttccctaaggatgaattgtaccattcagtgattaacctctcattatgaacattggctacttacaaattagacttgtagaaaagttagtaataaccctgcattcagacaataggtatgggtaggcataacataaggagacattacgaattatttttaagtaattccaaatatattcttgggtttaaaatgtatgtgcctgttaaaatctgccctaacatagacctccattagaaaatttaaagattttttttaagaggtcagagttaatgtgacttgcttcattttcacagctgacaggggcagagtcaggatttgaacccatcatctatacttaaaaaattttttgaggtgctttcacgtaaattatttcatttactttttaaacaattcttgcgagctggccaggttgcacatgcttcttattgaagaagtaatgggtcactggttgacataggctttggagttgattccctgttttggcccagttttcttgtgataggaccccctcatggcatgattataagagagaaatgaaaccgtgggtgtcctgggagagcctgacacataataagctgtcagaacacatgagctgtttttaaaattatatttataatggtttgaagcaaatacctcaatttggaagctggttttgatacttttaataatctagtgggcttgaaatgtcgataaatacacccttctgtaaatgtatttacaggcaacaatatttatcaaagttaggttttagattgccccagagctgaagttataaaataattttaatgcaaatacttgtgttttctatgctaggacttatgaaaaatgacagtgttttgggtaagccacttagcagtacagccttgtccaacactccctgagaactcatcagcattcagtaatcctgtcagaatggaaaaatctttttgctttaaatgagattttgcttgattggtatttttattttggaaatccaattttagctttttgtctcacttgataatgagttttttgataaatattgtcaccctttattgtaagcataaagaagaggtaacaaatggctttctgtaatgtgatactgtaataaataaaatcagatgccaggagtccgctcgtcactggcataaataaatgcattccttcctattgggcagatgggaacaggatgttgattctgagttggtaaaactttgattcccattcctttgaaaaatccaacgaatggctttattttcacatctaatgtttcttctgtagtctgaaacaaatgttactacgttatttgatttagagtgactatgttagataactctaccagttaatttggttgggttttactttgctgtggctgagtgctctgcacttgctgtggttggtggttgggaaagtgggccctgggcgatcacttcctctctgtgggtttccactgggatggcagaaactgcttatcatgccacaggctggaaaataaatcctggaagcaccatatagctcaagagacaatttgaaaataacaatcagagtcatgaatagaagccgatgcacaaattcagttaacaagcagaggaactaatctatcagacattgggtggaaagcctatttctgagtttatttcacagcacattatgacatttctttaaatcacaacttgtccccatgtaaaagatataatctacatattcctgtgggaaataatcagagacaaagctttactgtatttgtcgtttctgaagttgacctcattccccccccaaaatatttttcatgttgtgaaatgtaatttgcttgaccccaacaaaattggaataaaaaccatcacaattaccggtggttaagaaagtggaattgagtttgggagaattgaggcataaagaaaattttttttttttttttttctattcagaaaatatattgaaagaaatgcagagagacttcaaaattccatagtagtttgcacctaattctggttgatagggttttagtgtttggagtggtaagcagctgtggggtttgtggtggcctgccctcttgcaggctgagagggaactggggcctgtgaagaagaggtgacctgtttagtgtcacatagctgattggtggcagggttagatctgcatcctggcccatatacttgggtgctttttgccaacgcgcctttttcctttctaaaacttttactttcaggaagcccatagattaaaaaaaaaatctgtgtattgtgttctctcaatttctaggttcacatttgcctgagtttaataagagcctggctgggtacggtagctcacgcttgtaatcccagcactttgggaggctgaggcgggtggatcacctgaggtcagtagttccagaccagtctggccaacatggtgaaaccccgtctctactaaaaatacaaaaattagccggacatggtggcgcatgactgtaatcccagctactcgggaggctgaggcaggagaatcacttgaacctgggaggcagagtttgcagtgagctgagattgcgccactgcactcgagcctcagcaacaaaagcgaaactccgtctcaaaaaagaaaaaaaaaaaaaaaaaaaaaaaaaaaagaagagccttacttcctttcatttgaagcaaagtggaattaccttgactgtggaatcaaaaagcaggaatcatctgctttttccatggcatgcattccggtgcatttgtgatggtctttttcaatgagacacagctgtcccaggtcaagcttgaaggcagggtaattgtcatgagcacaagcacatgttgttttctatctctttgagtgcaggaaataagtactcttacagagttgggaaaacagagtgatcagagattcaggctgattggggaaagctggagccctagaggttctgtcggaacatttggcgcacacttgacaaacccttcaggctgtgcgctgcctctggtcattgctgcagccccagactacaggtaggcaatgtttatataattgagtgaatagtagccacttcctatgtgtgttcacttactctgtgctaaggccttaagccctcccccatcctcccatcaccaattttagaggcatagaaatgaagtattagagagtctgggtcatttgcccaagatcatgagcttagagtcctgaggtctgggtttgaacccaggctgtgcttagcattggctataggagaaaaggacatttgtctccccaatccccagagcatacataggccttagtgcagcccctacctcatctttcccttgccttcatggctggctgacatgtgaaatgggccatcccatggggaagtactttatggtttatgtgggttattatcatactcgatggcattgaatccatttggggacatgaggttcttcagttcttatctcttcttggtttgcatttctttgttttttctttgattcagagtagttaatgtgggtgaaatggagggaggttgcctctggaactgaaattctggagttttctggagcaaacaatggaatgttgcaatgtttatctctgtcagcaacattctgaggtgagagccccaaccatttctagtattagcgagggtaatgacttcttagtgaccagggacgtaggctaggtagggaagcccttacgggaggattcatttggcgttgtgtgactaccccaaaggtctgagccaaaggtcctgtgccttagaagtgggaggggtttgtgtatgtttcctgtaagttctgttcataaatgctgaaattcttctgttgacaggatagtaatgaacccattggttagaaggttgaagtaatggaaaaacctgtttcaataccataagttgtgattgttgtacttttcagattgcagttcttctaaatggcttatagaagtttccaagctctgctttgccctgacacataagctctttagggtacaaaaagaaatacttacatcagaattgaactttttttttctggcagaagaggagcttttggaacacaaaaagattttggagcaaagaattttgagaaattctactttaattttttcccaagtatttgcacattaagggctcttagaagtccttaaaaagaagcctgcttaattttaccctggcatctctcaaacttatttaagatccaaaattttaatttgtctgcagcacacttctagaatggggctttagatttttagaggtcagtaacatgacatctaaaggttaaattatgtttattcacgaacatattattctatagattcaacactaaatcctgtagaccaaaggatcaacacattttttctttaaagggccaggtagtaaatattttgggctctctaggtctctgttacaaatactcgactctgctgttgttgtgtgaaagcagccatagacaatattaaatgatggacatgactgtgttctaataaaactttatttacaaaaacaagcagcagttggattaggcttgcaggtcatagtttgccaatcctgtgttagatctgatgacctggtctgctgatcacactgctgcacattccctgctgttcctctggaggtaatgcatacctcctcctttgattcaataacccctactcagcctccctaacttgccttaagcatctctccctcagaggttttcttgcattccaggacagcatgtggtttgctctcccatcctcccccagatctctattgtatcctctgttccagccctaagcaactgtgctgccatcactcctttctttaccagtcctggcaccaactttgagctcttggagggcagagaccttattactagtctgtatctccagccctgaggatgggaatgagggtgaggatggtgtacccagcaagttgcagacactcactgtgagcttggtgaatgaatatgatgttgcaataacttgatacagtgttgtgttgtgttttgcttggatgaaattttagagttaatagtaagtatagcaggaggaagtgttcttttcaaatagtaattttaagtatccccaaagacacagatcggttgggtgaatctaggggtgaattccacatcctcccaagatatatgcatcttgggtgaagaaagaaagaaatgaggctagtgtgcactgtggtaaattatgcatgtaaaacagaaaagctgggtgaaaatgataatttagggggcattggggaagtatttgaaagatctgaaggtgtatttttctccttctttctttactttttagagattaagtgatatagacctttttctcttttcacccaggcctttacaatattttttctggtaatttctcttcatactacatgactgctctaattacatctctagttttaagataatagaactgcattttttaatgtgctctctgctgtgtctggatttatgatatctctccttccttatgtcttctgaaaaaaaaaattaactgagttaatattaaaataaagtgggtgaattaaatgggaatgagaccttaaaatctgagatccaacccaaaatgctcaccaacggcaggcctctccatctctgaagccaggacagcgttgctcctgccttcctccataatgggaagccctgccaagctccaggtgtggccatgaccctgagttggcctagtgaggagggaaaggaaaggctggcctgatgttcccagaggtctgaatgccattcatctacaagagacactgtgaccactttttctgagtctgctgctgggaatcagataatctctcggcattttgggctcctgctgctgctgtccctgggagtgctgtaggacgcggtgactttcagagtcttgcagggagagcaggtcctgtgttgatgccattgctgatgaacggggtgaccttggaagagtcacttgacatcttggccttcagcctccagatgactgtatctgtgtctggagggattgataggcctcctgggctgtcttagatgttagcaaataaaacttaatatactcggttgaataccaccaagtctgtctcttgctttgatctcatagcaactgggtagacagaaactacagagattttaaaggcttgacaattgaaataattgaacaccgcacttgtgttcttaattttgttaaaatacaggccctttcttcaaggagagcacatctgaataaaggaagtagacacacaaacccagaactgcagggctggagggtaatgggatctatgaagcactgtggggtgtggaggaaggcatcgctagttgtctgtctggaatggggactggcagtcaggaagggcttcccgggtgagctcatgattgactagggcagcagtccccaacctttatggcaccagggaccagtgttgtggaagacaaattttccatggatagaaggggtacagggatggtttcaggatgaaactgttccgtctcagatcatcaggcattagttagattctcataaggagcgtgcaacctgaatccctcgcatgcacagttcacaatagggctcatgctgctatgagaatctaatgccaccgctgccactgatctgacagaggtggagctcaggtggtaatgctcacttgcccctgctctgtggccgggttcctaacaggccacagaccagtaccgtggtccgtggtccgggggttgggtgtttaaggatgacctgatgtttatcatacagggagggagggtgccaggcactcttatcaaagagagtcgaactccaaaataactgtcaggtccacagacagagcatcaggggatcaacatgggtatgtgctcccccaaccagctgctcagaacactctaatctagctgtggaacatatgtacacagaactcattgtatagactgttaagcgtaggtcatggttgtgctttttccatcttttctattgcaactcactgttatcaatttagaaagggagaacttaaaaacaaacaaacaaacaaacaaacaaacaaacaaacaaacaaaaaaaccagtagcaggagaggctgtgcaggaattaccctgtagggatagcacagctgaggagagctgtaatgattcagcaccaaggacagcgacatgcaacctgtccagcttcaggacctgtaaatccttccttggtggttcatgggtgctgaatgttgtaagaatagcgttctcggcagagtctgtgttcatgatgtcctcaggactgcacccatgccatgcttgaccagcctaggctacgacacctcttgactggtggccaggtgcctcagagtccatgtattcctgtgatagaccacttggagttggaatccaaccatagggttgctcctgctgttggagcaaatgggaggccatgtttgctgggtttcctgccagagaattgcttcacggctgtagtttactgtcggctccttcatatagaagagattttcatgagtttttcaggtcaaagataatgaacacagggccccttctctaatagatccacaaaccccaaacttccaaaatggatatatatttattttgcttatcattagaatggcattagtggtgatattagctgccaaattctgtggaatatagagcgtcactcatttagtacttggcagacccctctgataccatttgtggtgtttgtccccagcaactcaggataatggatttggcctttgactgactttgacaagttgatggaattttccccacctcactcctgcaatacatccagcctgagtcaaaagtgaagccatggcatctaagcctcaggcacaactctgcatattttattacaagcatgagctaaagtaacccctgcttgagggaaatgagggctgaaatttattgaagcaattcttggacttcgtggttataaatcccaatcttttcatttctacttggccagggtattgaccagcaagcttttatgtaagaacttagttcctagcgggacccagtgtggggagtcatatttgcttggatagtcatagctgaaaggattaagaagaggcttcccatgagaccagctcactgatactgtgtgtggcatctctgactgtgaaagggcttgggtgttccatccattaattaaggtgcataactctcctccatggtagatagtcttaccttaagaccatttagggacagggccaaagtcgagcacaaaggcagaaagtggtcctgtggctctccagacaagtttattccttgctatcccatccttccatgtcctttgagatctagagcccaggaggtaggacggcagggtcatcaccatgtggtgctagttgaatatgctgtgtgaggtggaacagactggcaagctgggcttctcgggacgtaggattggcaaattgctgggatgaggggtgcttcttgcctagcttcaggaggaagttgtctggagttctgacagtttggagaggtctgctgggagttccttcccactggattgggcaccattcaccagaggcctgatctcagcagtcagatcccacacacaggcctatcttccccatcagctacaattcaaacgtgttgtgccttcaccttagattgtttacaaaaggagttgttttcttatgtcattaaagttaatgagtacacataattttctactttttaaactttaagcatcaccacccattctcataaatgctgtttgcccagttgtcttagtctatttgggctgctgtaacaaaatgccacagactgagtagcttataaacaacagaaatttatttgtcccagttctgaaagtccgagatcaagggagggcctgtttcctagttcattgatggagctttctagttgtgtcctcactgtggaaggaatgagctagctcttcagggcctcttttataagggcactgattttattcctatgggtggagccctcatgatctaatcatcctccaaaggccctgcttcctaataccatcactttgggagtaaggaatttgacatgaatttcgggggcacacacacatttaggccatgctacagtattccttactggaagcagggttattagaaagtgtcaatggcaggtgaggtgaggtacccagaaagggtgaatgtttcttaaatctgctttcctctgtagaagggagagagaatggaagaacacaagtttaggacctactgatggtggctaaaaggttgtgctctaggtgagtggtgtctcaccctgccaccagcacacacaccactttccaccttccccaaattgagagttttaaaaccttacatcattgtacgtttgatttttagccccagctgaaatctctaagcatgtcactatcagagtttctgtctatagagacctttggacatgaatcttaaatactcctgctgttgtgccttcccatctctttcactttgatgccattggcagtgagccattttgcttccagagaaagtaaatctctttttttcaatctctccttataagattataagtaaaatactccagatacattttacaaacattagttgcaactgcagaagtgtcgagatccactagacagaacacagggtgttggggtctgtagagctgaattctaattctgactctgctccctagtggccatgtgatcttggataaaagacttaacctcgttgggcctctgttttctcatctgtaaaatggggctatctgtctggaaacaaaaaaaggacccccgccccagaactgtcataaagatgaagtgggataataccagaacctgccatcatatatggtgttgaattgctacttgatcaatgtaggtggaagcaaaaaaaaaaaaaaaaaagtgcctttcttgagttggatttgttttaatcagtcacgataaacccactcaaagaaagttttgaagaactcgtatgaggccaaaacacattcctgctccggggaaatggaggttaaccctgaagcttagatgcagcagccttttctattcactaaaagagaagcagaagtggagtggtctcaacaagcagggacagtgttctgggacaaacatgtaatcttcagtggttttttgtgatggcagatcacatcagattaatgattttaaaatgagtatttttctgccttctggccatatttaatgttctaatgccttttcttttaaaacatcaacatcatcatcatcatcatcatcatcatcatcatcatcatatctaatttagtgttttcagtttcatacgcatgctgagcagtccaaacccttaaatggatttgtaatctagtacccagggagtgccttggaatgccatgggctgttttttgtctgtgttttcaagttgaaccgaccgagtacaaggaaatcggtgatacagtctcttctcatgcttgtgcctggtgctgggagtggcaaattcagcctccctcatggacaggttggctttgaagagctgagcttggtgttaggcagggctgggtttgggtgtcagggccatgcaattggggcaagttctgtaacttcttctggcctctcttttctgatgtttgggaataatgatagataaggagccctacctgcgcagggctgccgtgaagagagaatgtacacagagcccagatccggtagtcaatgaagggccccaaaagcgttagctgttgctgttgttgattatattgcataacaacaccaaatccactgtgtctcccctgaaccgggaagtggggggattctgaggatgcattggcattgaggcggtttgtttggaggaggtttgggtttatttgggacctgccagctgccttctagcacattcatggtctccctgcaagttttctttagaatgtcttgtgccatcaataatgaggaaacctgggatgcagtgctttttttttttttttctttttaattccctgtcagtcagcagtgccaagtgaatcaagagtgggtggtccttcatcctcccacttccagaaagttcttttaatgactgcttgggggtggaggagaagacttttatttttaacacaagtgatgtgttttgacaagaatatatcactgtggagagtttatgctaaaggggaagtgcttgcagttacaaacggagcttgcctttccttctgcaaacagggcattgatattgagtttcaccatgcaacatgcaggtgacaacacataattgagacaggagtggtgtgacatgcacagtattctttggtgtaaatgtgaaaaccatagcagtagccaaacagacccttgggttattgaaaacccagacacctaagggggaagatagttgtccacagagagtacatgctgtagagcattggagcttcagggtcttgggcagatgactcttctctgagtctgtttttttctcctgtaaagcagggaatgagcacgagagccatgaagtggtctcagctccctacatgcttttcccatatgtgaggtgtgtgtgtgtgtgtgtgtgtgtttgtgtattcacgccatgctgctgtagattattctctggggacaatcagtgctgccctccaggtatctcagcccagcaaatgaaccaggggttactaatggcactgcagctggtgcaagggaaagtgacttcaaatggagcaggtattatggagctagcagagctgctcattcctcagggagaatcagatcatgtaggagacccatgacggggaggaagaatttaagaattacgacagcagtgaaataatgttaaccgcagcccagcacaggctatccttcaaatgtcttttcccccatacctgggatgaggaggctattcatgattatagtttttcagcatgtaaccttggccaggcgctctgctaaatgattcacatttaatcctcacaagaacccttggagaagggaacttttgttatcgaaccccttttacaggtgaaggcatgaagctctcatggtgaagtgatacttcccagttatgtggtgagttggaacctggtttcagcccaggtggtgggactttatgtccctattccttagagtccatggctatggctgtgggatgattgaggctgctccaggtgacccagcagcagagtcatgctgtgaccaattactcagtaaacaaaagcaggcagagggctttttgctcattttcttgcaaattgcatgttgtagccagttctttttccagggttcagtctttttggaattagctagagcttctcctctgtctctgacagtggcattggatactatcataatagtaaacatttgaattctaattaccaggtgcttgctaaaatattttcaaacattatctcatttaatcttcataactgccccattaagcaggcactatgattatttctagtttctagatgaggaaaaaaggagtcactttcctgaggtcttgggaccagtgggtggctatctaacctgggcagcctatccctagagctctcactgaggaccactaggctgtgccagtctcaggagggacccccagcctggatgagtttgttgcaggaagaatattctccttcgaggctgaattacaatgtgttgttgttgagagtgtcagctccatggcctgagagacctaggttctaattcatttccttcacttatggaccatgtggcagtgggcaagtcattgcttctctgtgcctcaattttctcacctgcaaaatgggaagaacactatctgcctcactgggatgttgagagctcagggtctggcccatagttggttctcaaacatggaagctgtcagaaaaacaaatgttgcatgttctcagtcatatgtggaagctaaaaacaaattgacctcgtggagatagagagtagaatggtagatacgagggggcgggaagggtgtgtgagtggtggtgggggataaagagaggttggttaatgggtacaaacatacaattaaaaggaatatgttctaatgttaggagagtagggtgactatagttagcaacaatgtgttgtatatttcagaatagctagaagatagggcttgaaatgttcccaacacatagaaataataaatatgcaagaagatggatacccctgatagcctgacttgatccttacacattctatgcatggaacaaaatgttacctttatcccataaaatgtgtaaatatgacgtgtcgattaaaagtagttaaaaaaagtcataattgagaagcagggacatgatgatgggaccatttcataatggccaaagtcagaaaccagccccagttctccctctttcctgtctcccacctccttgtctttccaaaattctctctggaatcttcctcctggctgttccttcctcttgtcttgattaccatgtggatggggcctgtcttagtctggctctgctgctataacaaaatacccgagactgggtaatttatgaagaacatgaatttattttctcatagttctagaggctgggaagtccaagattaaggcactggcaggtttggtttcacgtgaagatgcgttcctcatagatggcactgactaggtgtcctcacatggtggaaatgtggaagagagtgaacccactccctcaagcccttttataagggctctcatcccatcctgagggcaaagccctcatgatttaatcacctcctaaagtacccacctcttaatactatcacaatggccattacattccaatacatggatttggggggacacatttagaccatagtagggccctcaacacttaggtcttctgtgaaagggcctcctgcctggcttttctctcgccggttgtacctactctgatctttctcacatggccacccatccaacgtggtcactcccatgctaagtcttacatgataacctgtcaattacagccagcccttgaacctcggagggcatccaaattatttgagggaggtttcctaatatgcacattccagagtcccgcctcccagaggtccaaatcatttggtctgggttaggcccaggaatcagccgtctggccgttgtcccagggcattctgatgcatgtgatctggaggaaaactctgactcctaagaatcaagtccaagttccttaacatgcctccccaccctggcttatttctgcgtctgtgcctttgctagaccactgaccatcagctctgtccaaagctcactcccacccatctctgctttcctttacacctggctactctgcattaagctttagctcaaagagagtctgacacagagatgcaatgatagacacaagcatcatgttatgtaatatttattgaaggtgtaggtgtggtggtcaaaacttttacagtattaaggcattaccttctcatagccatgtgaagttgatgcagttatagtccccacttttgtaaatgtggaaagtggggtacaaggaggttgagtaaggtgcccaaggtcctgtggggctagtgagctgaagaagctgctcaggtagtccaggtctagggagacgtggggatggtgatggtggcaacatttctttggacttttgtggtgcagcgttgggttttcacaggtttggtggacaccgttggtgtttaatgtccaggctgagggatgtcaagcatccttcagtgtgtacagcagccctgcttgtggggaattgtcccacacccctcatgagcagcagagatcctgctggacatttatgcaagtgaaaaccctgttcataattatttgaagctagaacctaatctaaacacacattttacaatttcatacttttaataaacactgaattttccaggagcacgactgccattgatcattgagttagtgtgttggaggagtcacatcaccgaggacaatgttggtggccatcaagatatgcttgtgtggttggcatttgtagctgttgaattttcctgatgctctgtagaggtggaagcatctgactgttttgccatgcctttcagtatcattatgcctaagcatttgtctactgaaatacgtattactttattctaaaccatttgcctttgattctcttttatattataggttggacatactattgattttaaaaaatattatatgttgatattatctaacttttatttcaggatagtaaagaagatgtcacaaagtgattggttaaaaaggcagtcttcatcagatgaagaaccactctgtacaaaataaggcctcttaaggggcaggagggcagtgagttctgggaaagacacctgatggatggatcttcacagggaagccgttaagttaaaacttgagtctggaaagcctttgctagaccccagcttgcctcctgcccacgtcacagccctcccagttctctttgagatgttaatttgttgctatgaaaattatcttgtcactgacaaacggaatctggaagaatcagctcttcttataaagtggttcctatggtatatgcagggctttgtcagtttgcaagttatgaatatttatgtttcagaaaagagtcctcatttaaattgcgttttctgtaatttcccacttaatttcacatagaaaataatgacatttccaggctttgcctaggtgaatgtctttggagatggcaatttttgcacatgggctcaaggggcattggaatttactgaattccaaatgcagatgcagttctgctgccctgcagttgcttctatgtaagataatgcatgcgtccgatacattatcgacggaagataaatgccagacatgattatggtaaattagaccttttgcattatttatgagatccaatgtaaaacgtgttttactttcccccactaatgtttatataaaagctataataggacttttagtaaacaattttaaaatttattacacaaagggacaaagtttttcttaaattttatcttcaagatttaaattttttaaagagattgcatctctgtttgttgtccaggttggttttgagctcctgagcccaagtaatgcaatgctcctgcctcatcctcctgagcaggaaagggccaagttttaaaaagctgttctagtctcagttgtcgctgtctccttccatcagctcttcaagcagaaaagcagaactatggaaaatgtcatgggacatgtattgggtgggcctgagaagggccttggagaagtcgaggcttgggggatggcaggaaatgtcttcctcgtgacctcaagtctgctgccataatatttaagcatctgtaggaacatgctgacagcctacttcaagtcctcctctcctttcagttttcaggaaactgtgtactgcctgacttcagtgtgggtccacctctggcatctttatagtagcagaacttattcgaagtgagttttaatttttatttttggtaccatcttctttctctggtttggtactgatctcttgagggaagccgggaggatgacttgcaggtaaaattccttccctgagccgtgtgtgttggtttctcacagccagtcatcataatatctcacacttgtttaggaacttggcaccttttgggaactgctcttgtgtatgagggcctttgatctgcaggcggctgggagctgctgtcttgtgagctgttacagtctgtgaggggaactgagtggaacagtcgcctatcctttccatattcttctctccattttttggttttctgcacgttctttgaaggctacgtctgaaattcctccttccccatttcctatctccaacctgaagttaaaagtttctagctttggggtgttagagaccacttgggagctgctttctctgtgaggtgaagcatctctgctggggctttgattaggaaggtgatgttgtatgtgtctttggacgtgatgaaagtaaaaatagcatgcgtgaagttccaaggaaagtgagagtcagaggccagactgctgccttgttcttatcagacttttctttttttcaccttaaaagatctaaaaggctggttctgttctttacttgtgcataacaaggacgggagcaaaccactgtctttgtgtgtcttgtctttgtaatacctaaaagagcccccatcctctaataggctccttgtggctctgcctatctgaggacaagaggcctgacacagtgaacccgccattgcctgcaaggcctgactcctgtgtgccaacttgggctttctaagggcagtttcatgtatcttgaaccttcttctaggagctacctagggacaacagcctgatgtgaggccagagcctctggcttcccgtggccccgaatatttccgtataccagctggggtctcttggccaggctacctcaatagagtattgatgggccagccgctctgtggggctctgttcatttgtaccatttgcccactttttatgcttcagttccagtatgtttggacaatgaaattaaattggtcaatttttagcacatcaaatggctttgttctcctgctttggcactgagcctcgtgtggaattgtttaaaaggaagacactcagcttgggagcactgtgggattcaaggtttcatatctgtggattctaggccatgccactgtccctcaggccccggggggttactgcctctctgggtttgcctggtggcgtccttgcagccccaggctttagccagacctccctgcagctagacgctgagtgcacaggtctggtcggcacaggccattctcaaaagcctttgttcttccacggatttttctgtgctgagtgatggccgtggccgggagctcctagatgtcttgctccttaacgtttgttgtggaaaagaaggctgctggcctgaggacatttattccatttcttttcttcctgtccctatcccttttcttttctcatcatttctttcttataaaccccttatttctggccttcacttcttgttttccttcttcaccttctccttgactctcctcctaaggctaatgattgtatgccctatttcagtataattttctttcaacaatttttattttattacatctttaaacatatacaaaatatagactaataaaacacccaaattcagtagttactaactctttggcaaatctggtttcctctgtatccccactgccctcctaccctgtccctgtgtagttttgaagcagttctaagtcatcttgtcatcttacctctcaatatttcggtctacctctctaaaagaggactctttcttgctttctctttttaaaaattttatttatttatttttgagacagggtcttaccatcacccaggctggagtgcagtggtgtggtcttggatcactgcaacccctacgtgccaggctcaagcgatccccagcctcctgagtagccgagaccacaggcacgtgctacccgtcccctccgcctcccgccactaatttttttatttttttttgtagagacagggttttgccatgttccccaggctgtcctagaactcctattttcttcttttttagatgagagaatcttaagggagaacatcctagagcctttgctcttcagaggcccttaatggtcattgaaagaacatttatccaagtgcagcacatgaggtgatagcatgcaattgttaaaaatagtattttgtgtttgtttccctgaatacactagattttatggcaaattatgttggtattccatgtatgatattaacactaggtaaagaaagggagtcaattttaaaataaaaatatttgataaatacaatatttgcaggggtcagaaaactgtgatctcagggtcaaatccagcccactgcctctgttttagtaaataaagttttattggaacacagcctctcatttgtgtgtgagctaggtatgactgcttttgtgctatcctggcagagttgagcagtgggatggagattggcctacaaagtggaaactatttaatatctggccctttataggaaaaggtttacctgtggaatcggaggtatgtggacagagcagataccatgaccttggcacatcagtggctgaagtctggaaaattccaatcagacccaacctcttgctttgtagctgatgtagctgagatccaggcaagggaggaggttgcccctggttacacagctagtgggtggttgggtgggtagtccatcctgaagtccccagtgccatgcccaggctctgtgttaacatatctgagtgttgcagattgggtttagacctcatgctgggtagctgttccagagcagaaataatttgtggttttcagtaatttctcacaaaatgctctattaagtttctgttgccccagccccttaaattattacaccaactaggagaaaagtaatttcaaagaagtaaggagaatatttgtgaagtggaataatttaccatcaaataaaatacaccgagtgcctcctaacatagaatgctgagctgatttttctctgtggtatcagttccatctccagctttagtggtggatatccagctgggaggaaagcatcaaggtaaaataaaatgcaaacgatctctagcatatatttgtgattttctcatttcagcatccattcctgctgtaattgccagagtaggaacaaagctgcagggagaactgttctagggtattgcatttcatagcatttgattacttaggattgaatagctttgagattatattgaccctgtagacttgtctcctgtttccctattttctaaacattttagacaagtgctttggaaaataggaacttttttgttgttgttgagattttaagatgaaaatatttctttatggttcaaaattgttattgttatattttgtgggagaagcaacttgctgaaatgatcctgtggtttacttagaactgcattgtccaatgtgatagccactgagccacacataatgctactgagcacctgagagtgtgtggccggtctgaaatgagacgctctgtaaatgtgaaataagcgctgggttttggtgacatagtacagcaaaacgaatgtgaaatctttcataatttcggaatactgattatatgttgaaatcacgttttgtatatattggattaaaccacatatatcattggaattattttcacctgtttccttttaccttttaaagcagctaccagaaaatttgaaattacacattatagttagcattatatatacttcgaaaagtgctgaatattgagatgagataattaaagaaattttaaacaattagagccatgatgggaaagcttggcttatttgaataagaatattgctctaatgttggaagttacggtaacaaaagaagtatagcattaactcaagaattattgattgatggaaagaacatttcacgtagactccaacccttatgggtcgtgttcagtaaatgtttacacctttaggtgtcctcaaatcacttatagggaattgtaagattatttagtaaatagtctacaactgactatttggtagaagatttgagtttgaacctcattttatattataccccaaataaattccagatagattaagaaaataaatgtaaggaatgaaattatcgaaagactgtatcatcatctagccaaatgtgtatttgattttcaatttaaaagcaatagaagaaactgtaaaggaaaaaattgaattgacaacagagaaatcgtttcattctttaaaataaatttgataaaataagttggacaaaggtataaaaacagggaactcatcccagcaattcctgaccccttgaccatatccagttcagaaaatgacatttaatgcacatcagaactctgtgaattcaaaagaattaatgaacagttttctgttcattaatggggttgccagattaaagaaattaaactatggggcactcagttaaatttgaatttcagataaataacacataattttggatataaacatgtgccatgcaatatttgggacatactcttaatagaaaatactgttgtttatatgaaattcacatgtaattgggctcctgtgttttatctggcacccctagcctgggaatccaccctacaacgtgcagaacgggaagggaagcgtgggagttgaatagtcatgtgactgcacttggtgcagaagggacctgggaccagctgccctgaaaataggcattcaaccaattgtcccctttgaccctgcaactcactgctggtttctgaaatgtggggcacctctgtgtcctaagcctgttcaggattctgtgagctcatctggctgtctcacgctgcaggcagttagactggaagaatccagccccaagtcccagttaccacgtcttcttcatgccatcttctaaaatgcatgaatcttgtttgttgcagttgcttccccattccttatactgtgagttgatatacccattttcttccttcactgttttttaaaatgtcattttagggagaggagagaagtgcttgtggtctatttactatgattaatagaaaggcagccttaatcaggacacatattttaattatccagttaatgcatggattcattttggttgaaagagaaacaatgtatacaaagtgagagttctgttgattccccagttcctggcaaaaaaacccaggaaactggggataatagacataggtaagaagaccatatatgtcccaggagagtcctggtttatgtctgatgtcctgaaagttattaatagttattaattgtagttatcagtagtgtcccttctctccccactacttgactctccaaagagtccatgtttggagaggaaattctgctgtcaagcaaggcttaggggagagtgtatgttaagtgcagaaagtgaactcaccgggtcagggttgggaggatttttctctggagaaaacgactgtgtctggggatcatggctggtgacacacatgtagagcttctagtcagctttgggtgctatcagctgcatgtcagcccgactggccacgtggtacccagataagcattatttctgcatgtgtctttgacagggtttttggatgagattagcatttgaatcagtggactcagtaaagtagatggctctccccaatgtgggtgggcaccatccaatcctttgaaagcctgaacagaacaaaatgaaacgggaagggtccccttgtccccctcgcagggcgtgcgatgggggtgtggctcgcttcttcactgccttgttgctcaaacctctaggggagcatacagatgggcaggctgtggggctctgactccatggcggtgtctaggggtgaatgtttacagctcctgaagcccttgtgggtgtgtgttacagggtgctcctttagtttgtcatctgtaggcagcttgtgttagctcagttagaccctctaccttgttgcaaggacaaagggctttctgtatcccgggttcttgccttggtatactggaagaatctgatcacacatgagcttggaaaatgagggcaaagttttattgagtggaagcagctctccgctgatggggaagccagaagggagatggttttcctctggagttgggccactgtgtggccccagttctccttcaactccctcggccaaactccgtctcatcccgctggtcagtggcctgcctgtgtgctggcatctgtcggtgtgctgttctgccgacgtgcttcctcgatgtcctctcgctgtccggccgcttgtgtcttcttccgctgatgtgcctcttgacgtctggctgcctgcgtgtctgcttgctagggtctcagatttttataggcccatgacaggggtatggcgggctagggtcgtcttggaaaatgcaacatttgggcgcgaaagcaagagtgcctgtcctcacctaggtccctgggagtgggaccctagccagggacccgcccttctctactgtgcacttcctgcctgctcctgtatccaaaagacagaataaggaggaactcacaccttttttcttgcctcaccctttgagctgagacatctcataccattttctttggcccttggattgggatttctaccattgggtcctctgattctcgggtctccagacttggtccgaattaccccaccagcttttctgggtctctgctttatagatggcagattgtgggactgctcagcctccataatcacatgagccaattcctcataataaatctccatatatatatacacatacacattcacatatgtatggaaatatatgtgtgtgtgtgtatataccatatatataaccatatgtatatggctctgtttctgttttccggagaaccttggctaatataagtgcccagtcctatgtgcacaaacatcaaggataaccagaccttgaggaaagccacgaatgtgaaagagagaggtgaaaacaatcagaaaaaaggaattccagggaaatggagacatggggccaggcacggtggctcacgcctgtaatcccagcactttgggaggccaaggtgggcggatcacgaggtcaggagttcaagaccagcctggctaacatggtgaaaccctgtctctactaaaaatacaaaaaattagctggatgtggtggcacatgcctgtaatcccagctacttgggaggctgaggcaggagaatcgcttgaacccgggaggtggaggttgcagtgagccaagatcgcagcattgcactccagcctgggtgacagagcaagatgctgtcttgaaaaaaaaaaaaaaaaaaaaaaaagaaaaagcaaaacaaaagaaatggagacatggaagaggagaaaaaaatggaaaaacttaccatctcctcaaagatgaaagaatatattgcaggtaaaaaacaagaacagaaagttttttagaaaaaaacatagagaataagaaaaaggacttggaaatgaaaagtgattgccattataaaaaatccagtagatggtctggagataaagttaagaacattccccataagtagaataaaataatgaagacatggagttaggtaaaagatgaataggaagccaggagattgatctaggtggcatgacacctgactaaccacggctacgtgaggataacaatagaggggggaaagttatcacagatataaaaagcagccttccagaacagatggaatgtcaagatggggaggactcacctagtgtaatgggggatgggattttttttgttttttatggtagagacggggtttcaccatattggccaggctggtctcgaactcctgacctcaggtgatccacccgccttggcctcccaaagtgctgggattacaggtgtgatccactgcacccagctgcaagtgaaaatttaaagcagctcataacgctaagaaaagcaaagttgtacaaggaaggaaatataactatggcctactccctggcttagcaacgaaaatgtgtttatggccagtgtttacattattgaatgttttgaaaattatgataactctgttggggagatggagggagaggaagtagggcattgttgtgagagctaaaccttcatttaccacaatgggcatcacttgataatgcctataattgatgataagccatattaacattcttgatatttagcaacttggaggcagacaccaaggtaaagagcaaaaagagttgaaagtagtccctctggggctggaatggggtgatgctgagtcggggaggaaggcacagaaagggaggtaagaaagggttgcggtggaggatgtcctcttgtattaaacagtcaatgtagtttatgttagggttgccagataagatgcaggatgcctacctagttaaatttgaacttcagataaacagtgaatatttaaaattgtaagtacgctcatgtgatatttgggatgtacttacatcaaaaatatatctggtgtttatttgaagtttaaatgtaactgggcaccctgtattggttgcttaatcgatttggcaagcctgtgttatatgtatgtattaccttgatgaaaataaatagaatgtataattatttatacatagaaaacgttcgaagatggtgcaccttagttgtgggcacttcttgggtacttcattgggaaaggggagtggtctcattctcttttcgcatttctagaaatgttctgctgcaagcatatattaatgtaaaagtaaagaaagagtcctagaaattctgaacaatgacagtgctggctgagggtcctgaggctatgagacactgagaaacggtggctctgtctgtatgctcggggatgaggtcaaacaggtttaacccaggggaaaattttgagctgagctcagattattatgaggttagaagactaaaactctattgagatggtgtttaaaagagttctagagactctgtgtcctgggaggaaggtctcattactactggcttttccaaattataatggttctctccctcacacgcattctcctgaggcatattgatcagccttaaaaactcaaacagtgaaaccctgccgcgacccaaccttgagagggtgaggctaatgctaagctatgtagcagccatgttgcactaagctataccagtaagcttagtttggtatactggtgagctatactagtaggcttacttttatgccagtaagctataccagtaagcttggggtttttatttccttcctgcatttccttttcctgtttcctttatttagggatttggctacttctgataaatgaagattcatataatagctgaattagtcagggtaactaactctggctgttgaaacaacccctaaatttcaggaacttaacataatacataatttatttcttggtcatgactatctgatgcagttctcttccaaggagtgacttggggacctgggtccctctcatctgtaggctccattcttccctagggacttcctatagcccctgacagggcatactctgccagtcagccatgaacagtgactagacacagggtaggtgataatgtggtaggagtcaggcctgcttctgctgccactcactggccagaatcccttcatctggccttaacttcactgcagaggaggctgggaaatgtagtcttcttgggtgctcagatagaatgggccttctaggcagtgtctgccacaagagctaatatgtgctgagtgctaattgtatgcatggcaacaaattaatttacatgtacagtctcactaatgctgggagacgtgtgctagggtcttcatcttcctcaccagaaaagtgaagctcagagatattgccacttgccaaggtcacacagctagcaagtggcagagctgggcttgcccgtgacctggaaccactgtgtcctctgtgtgatttgacaccactgtaatccgggtggatacattatgcttttaagaccatttaagaccaagttgaaaatctctcttggacttattggtaggtattttttcatgttgtacctgaggcttggagggatacatttctctcccttgcacaaacccactgctaaccttcctggatgaatggatgttggtgtaagattccaggtagcagtcttccaagccagcagagaggagaaatgtgcatttgtctgagttacctcgggaatgtcacggactgggctctgtgcacattccaccatatggggagtgggccatggagcgtggtcactagggagtgaggagggtgcttatggcaggaggggaaagtgatgaatctcttctctgtgtcacttcatcatgggagccacgagatagggccgcttgtcagcaagcatttccacaagattactttggattagctatctcggtgcatctattctcatgacacttatccattatccagaaaagtgatctacagcccagctggctgagtgactgcctcagtgtgaatccacatcccctgccactcgagtccagtgattcatgtcccctttggaagtttgaacagctcagtgttgtcgatttgattttgtgatacatttcttacttttctaaaatgggtgagtagtgagtgtgttctggtgctctgtttgttgtttgatcttgttcatggaactgcctttctttttgagatggagttttgctcttgttgcccaggctggagtgcaatggtgcgatctcggctcactgcaacctctgcctcctgggttcaagtgattctcctgccttaacctcctgagtagctgggattacaggcttctgccaccatgcctggctaatttttttgtatttttaggagagatgaggttttaccatgttggtaaggctggtctcaaactcctgacctcaagtgatctgtctatctcggccttccaaagtgctgagattacaggtgtgagccaccacacctggccagaactgcctttcaagatgtgggtttgcttcaggtacctgcctgatagagctggtttccaatagccctgggctggaaggcacttatggtatggaattgtcaatctctgaatggcctctgccttggccctggagagcctgcagttctgactagagactagggaggcctagtccctgtgtggccttaccagtgccagccccttgtcactctcaggtgtctctcttcttgatggagtatagccgtgcttcttttgttttggacaggcacatccagttctggtctatatgggtctgctttccttgttttagagcatcactgtgtaggtggtcattaaaaaaccttttttttttcaattatcacaatgtatttggtgttgagaatgtggtgaggaggtatattagtcagttttcatgctgctgataaatacatacatgagactgggcagtttataaagaaaaagaggtttaatggactcatagttccatgtggctggggaggcctcacaaacatggtggaaggcaaaaggcacatcttacatggtggcagacaagaaagaatgagaaccaaatgaaaggggtttctccttataaaaccatcagatcagagacttattcactaccatgaaaacagtatgggggaaaccacccccatgattcatttgtctcccacggggtccctcccacaacatgggggaattatgggagctacaatttaaaaagagatttgggtggggacacagccaaaccatatcagaagggaagtctcagaatgtggtcagttcactggaaccaaggactcacataatttttggaagatttcaagataggcatcgaaataattggagaccctggaggatgtaacaaaacaagattgggaggtcatttgtgtccttagaagagtttttcaataaagtcagttgtccagccagcctcaccctcctggccctttgtgtctgacgatcttgctgcagactcacactctaactggggctgggtctcatagatgtgagagaactttcaacagaactttcagctaatgaaaatagaggtcaaaagtaattatccctgtaccgattctgtacggagtgaggctgaaaggagttcacgcattaaattacattttcagtgttctgttccaaacgtatgctcctttacaactttatttaaagaaaagcgtaatgtgaaaggcttttaactctgatggaagaaagacaggagccgtagtcagtaatggtagaatctctcatctcattgtctgctccaagaacaaagatttttcaaacctggactcaagcagttcccttggattatattaatggaacataaccttaatagcctcctccagaggatgttctaaagtatacgttggctgtctagaaacgtctttgatcttaaactttttattattttgctgtataaattttctgtgctctttttgccaccaccatgtcatcagatatctaagcagtttgtttagaaatcggaatccctttagagatgaatgttgcatgtgtatctcttttagtttatggggatgtttgagaatggatttggggtagattttacacatatttatagggcatctactatatactgttccaggcctttaggatctctcagagaacagaaaagaagatccataccttgatggggcttatattcagtgaggggaaggcaacaagcatgataaataagaaaacacaacgtttgttagaaggttataagtgatatggaaaaaaagtagagcagtaaggaggatgtggggtggtggggagaggagtgtatgagcccagaggtggcacctgtggcccggcctctgagctgtgactttctatcatgtcaaactaggatgatgagaaattacatctaaggtttgggaacaatgaggtgaccttcttttaagaaaaactgtccagtaagtttaatcaaacagttcttaggtaataagattgcctagtgtacttccttgtagggaattagcaaatctattttaaaaatctatacactgtgcaaagtttttgtgtgtgtgtgtgtgtttgtgtgtgtgtgtgtgtgtttaagatagctcatactggtgtaagaaaaaatatgtttaaaaatctgggagtatatgtgaacttggtaaggtcaccggacttctgcagacttagtttcctcatctgttagacaaggattgggtgctggaagagtagatgaggtaatggacttggaaagacagtgaaatgcgggccatcatgtcctggagggaagtgtcctgggattggcaataatttacacaagcgcctgggagagtttattaagtgtgtggagatttggtctcctcagccttctgttgttcattgttcccctgaagagtctgccatccaggtttacccttgtgcctccctgacctgtgctgagactaagagtcaggcagagagaggtggtgagttctggtagtccttggtaatgtgtaaaacactgccaggctgcatcctgagaagggggactgggtacccatgttttaatggagggatatgttaactggactggatatataatgacagggtgtacatgaatattgtttaacttttaaaagaggtagtatatatatgtcttaagcgtcaaacaggtatgaaaaggaacacagaaagctcatctctcacctcttttccctttgtccaataatcactctccatccagataggtaataattgatattagtttatccttgtggatatatgtgtatacaaagacaagctactactaatatatattcttatttcccctctttttttttaacatgtgatagcacactatacatgttgctacaagctttgctttttttccatttaagaatacattttggaagtcttccaatatcaaagcaaacacttccttggttctttttatagctgcacagtaggacattgtgtgaatggttgttataattttaaccaggtccctttgagagacttgtcttgtgctcttatccacagtgccgccatgaataccctgcacatacatcatttcacctgtgggcacttttattttaggatagattactggaagtgaaaatgtagggataaaggctgtgtgtgctggtaattttgatagatcctgctaaactgactcttagatgggttgcagcagttaatacccctaccttggaaccttacccctgaatgacaccattacctgctccttactacgtgtattctttaatacaaaacttaattagactcatattttttgtaaagtgaatactttcttcctactattcttaattgctgtccttagtcgacaaggactcactactttcattttatcgttctctgtcgtttgcttctttaccagtgtacgtaaacatctatgaattaatgctttgtgaaagggaaactgttatttaaagatatgtaagagttattttataaaaatatattataaaatgtaacttattttacttcccctagttttttacattttaggtttttaggtattagatttgttttaaaaatggagagcaaggtgcacaatgaagcaaaggcaaaattgaaataatatgagtttatttagctagtaagactgcagagaagggacagaaatctcaacttcacccacctctctcttgccaagaaaccctgagataccttgaggaacagaaggctcaggaaatggaaaaaaaaatcctgaccaatagttactagtttagagttgtgaacccaaaagtatctgagacaggtctgaatcaacatagaaaatatattttgccaaggttaaggatggacccgtgacacagcctccggaggtcctgatgacatatgcccaaggtggtcggggtacagcttgcttttacgccttttagggagacataatacatcaatcagtatctgtaaggtgtacattggttccatctggaagggcaagacaactcgaagtggtgggacaacttgaagtggtggcaggagggagcttccaggttataggtagatttaaacaatttctgattggcagtcggttgtaagagttaagttattatctaaaggcctggaatcaatagaaaggattgtctgggttataatgataaggggttgtggagaacaaagttttaccatgtagatgaagcctctaagtagcaggcgtcagagagaatagattgtaaatgtttcttttcagacttaaagtctctgttgatgttaatgctggttggcttttcctgaattccaaaagggaggagggtataatgaggtgtgtccgacccccacttcctatcatggcctgaattagtttttcaggttaactttggaatgcccttggctgagaggggagggatccatttagatggttgggggtgggaatgccttagaattttatttttggtttacagagtcaggaatgtctgtcttgtactcagagctgatggagggcagggagggttcaatctctgccttcaggcttcagtttcctcaagtgtgaactggggatactgacaagacctgccccacaggacattctagaggattaatgagatgatgctggaatgtggcgagcacattccaggcctcctaattgcccttctctatatgtgagctcatgtatttccatggttcctcacaagtagcctttaatctgtgcacatcaggtgggcttctgagctgatgagccaaggtcagaatctccaccatcaattgtttattgtgaccaataaaccagatgaccccccttcagtggctggaaagggtgactggagctaatgaatgcatccacaaatggctcttgatcactgaaactgggtcaaatttccttccttttggaaaatgcccaggtaatttgcttcctgaaaacctattttatttcttttaacctttttggaaggctgttaatgggatagtttaaatagaaataagaaaacctcttttctccaggccttctctggttgttttaattagtacatttctatgatgttactgtggctattcaccagtatggctttgagccattaaaggccacccctcctgccttaacccccggggaacatcgataatacaggaacaattgctctctcagtattcttccttagttgcggctcatcgtcctttactggatttctccatcagtatctgtctggggaggataacagtcctttctttcttcctgtggtcctcacctgaggagcatgcatttccttgcattgctcaagggatggtggctgaattaaggaattccttgtggcctgccactttcaggttgctgaatgcagggatgagatgtggacccactggtctcatttgacatcacaggggacagagtaaaatagcatattgtgcagttgtcaggttttcttctaatactaggaaaagataaatatggggattcataatgcagaacaacaggaagatggaaataaaaatgaatcaaatgagggagattatttatgttcacttagattgttgtggagaaagctaatggcattgatacctctggcctggagtccctcttgaacaccttgctgatagagcccattcagtaggaaaataccgggaggagagaggcccaggaatcagttgagtggttggtccaccactgggtcaaccctactgtagtggggatgccctgaaccttggcattttaagtggaaatatggggatgcaggtatttgctgagatatcttagttgctggaggtcaggtcttgttggcatggggccttcagagcatctcgtggtgactcataaataccagagatgcctctgacaggaacaaagctggcagattctcatattccagaagactctgactgaattaatcagtttgaagtcacacacacaaaaaagaaaagagtaagctcagaataaagagcttagaccttgaatgggatgtggccactgaccatgcctcaatatccagtatttacattttgtcagttacaagtacttccacatgccatattcttgatattttcaagacctttcttttgcttggtaaatacaaagaggagctctaaaattgacctttgcatcacaaccttcgagggagacaagcagaggccccttctccctggtccctaagggacaagatctggagccaaagggcaggacctggttagtacacagtgggctgcccctgaaggtaggttgaagaattgagtagattttatctcctgtggtcctcatcactggtgaaccagtgctttttgctgtagattgcatgaggaactgacagagaggtgtggttggtgctcctattgttttaaacagctcagttaggtgctgaagcatcctgccagggtgtggagaggatgccccagcacagtcaggaagaggcagctctgatatatccctgtcctgtgccagtgtctagaggtgacaacgccagaccaaaatgacaacactggtgttttcatgtcttatcacaccaaaatactggtagtaaggacagagtgagacgtgctcaccatggttcttcccatttggagctcaggggttgagtgcagcaagggctgagatacagcacccaggccctttgccctttggctggagtctttccagtaagcctgataggggaaaacagtcttgaataaagcacaataccccagagtaggggtcctcagatgtgacatcttccaggcgtcagtcagctgagatgtggctgtgacatcatcctgtcccctcccaggccctattgtccacactctccaagttgatgtcagctcctcaggagagtagccatgggagcctagggccttttgggttgtggagagagagaaaagttctgtccccattttatcttcattcaaatatcctaccccccagctttattaaggtataatttacaaaattgtatatatttatggtacacaatgtgatgttttgattaatctgtgtctacattatgaaatgattaaagcaaactcattaacatctccatcacctcacatacttctcatttttttgtggtgaaaacatttaagatctactgttacagcgtttttaaagcatacaatacagtattattaactatagcagctattctgtgcaatagatctccagaatgtgttcgtcgtaactgaaactttgtatcttttgactgcgtatcagtccccccattgcctattaaaattattacacacatgtgggtttggccttttgattttagaagccaagatctagcttgtctttgttctctgggtttgccatgcattgcccaggaaatgttctcttttccaagtgaacggcgatgtgagggtgggaggtggggccatgcatcctttactttttaacctgttactcagccgcagtgcttagaacaggctttcacatggaatttccaaagtcaccggctcacaaaatcaccctagtgcccctaggtgtgaaatttatttcctctggtctcagttgccggaagagaagtaaggataatgcagggaggcattcatgcctggaaacctatcccattcaagggctaagctctttattctgagcttactgttttcttttcttttcttttttttttcttgtgacttcaaatatcctttctcttatggaacgatcgtgattgtggaaggtatgcatgtgtatgtgtacatgtgtgtcctctttaatgttcttagttggttaaataaaaacccgtcagtcctgtgttggtcccccgaattaggtggtcttcactgttcttgagcggctgagccctttgagagcttgtgcgctgtgttcctatgtatcctctgacactaccctgcaattttagttgtacgtgtgtgtgtgtgtgtgtgtatggtggggagggacaaggcagaagcacagttcgagaagcctgacacccactctttgcagagggtattttacaactaaggaagcacaggctttgagagatggaatctttgtattgtgaactaccaagctttttggtatcaatcttcttgcaataatacacttcacgtttcagtgatgtttaaaagtgcgtgttttgattatctttaagtattccaggtatatgtgtgctttctataataataaacagaagccaatacttgcatactggttgaaatctggtgctttttaaagtttgcatggacaggttgttatccagttgccatccagcttgtccaccaggtgtgttagggatgggctgtgagcaccaaagtgcgaggcctatagtggaactgatagagtaatatcaacattttaaactaattagatgaggaaaaagcatttcacagaaggcgtgatggcttcttgccctccagctggaaggtggcagagcataattggagttagaaagctttttaccatcagtgatttaactgagcacacttgaaggacacccaggagtaatgcattaactgttttgtttttgtcaaaaataagcccaggtgtaagacgggactcctcagccagaacttaaaccatcctagtaaggagaaatcaggaaaccagccatctagctcttattttttagagcacctgcttgtgtgtgctttgaggatgctgtggggccaagttcagccagggccccttattttgtggaacttctgtttggtggggggagataaagaagaactaagtagaactcaaagagtaattccaggcggtgacaagtgcgtggagaaggtaaactgaggcagcgagtgctgttagatggtgtggggcggtgagaggcagcctcctgactgaggaaggcccacgggactgagagataggagcagcccaggtgaacagtgagcaaggcacagtgtgcagtgagcaagggagagggctgcagatggggcctgggagggaggaaggagtgtgtttctggtgcgatggtgaagcagccagaggcgtgttcagcagagcagtgaccttatggggacaggcatggtctctgggcccaggggggctggcttgggagcctctgccgcctcctcctccctgcagcctcagccagtggcagtgtcccttcccctgggttctgtctgagctgcctcccaccctgccctgggctagggagttgatggacaccatagtaggctggacatgaccacctggagataccaagtcctaatccctggaatttgtaaaggttatcttatttagaaaaagtgtctttggaggtgtaattaaatattgtgagatgaggagatgaccctggattattcagatgggccctaaatgctctcacaagtatccttttaaaagagaggcaaagggagatgcagacacacagagacgaaagggatgtgaagacagaggcagagatcagagcgaagtgactccagctgaggaacagcaaggaatgccagcagccaccagaagctggaaggggtgaggaatggatgctgctttggagggagcctttggaaggaacatggccctgctgacatgttaatctaagatgcatggccctcagaactgggagagaataagtttctgttgttttatgtcaacagtttgtggtagtttgttacagcagccccaggaaattaatataggcctgagagacagagagagacagagagagagagagacaggtgttagggagagaggtgtgttagagagaaagagatgtgttagagaggtagagagagaggtgtgttgaggggggtgttttagagagagagaggcgtgttaaagaggtgttagaggtgtattcgggagagagagagaggtgtgttagagaaaggtgtgttagagagagaggtgcattagagagaggtgcgttagagagagaggtttgactccccaaactcctggaaagcccaagggtgatggagaccacgctcccactttgtgggactatccccttcacatctcttctctttgtgcttcaaccaggcctggcttaacagtgggcgtctcccactgtcacaccccaggggctggactggccacctcttgtggataagggtggcgtgcaggtggactgtgaccacctagactggcacatgcatggggcagctgcatccgtctcagctgatgctgccctgtgggatgtgggaccagtggggtcagatgtctagttttctcagacaagcctgaaaaaaatatgatttgttttaaaacatgacctgtcttggtattgaaagctggcttaagtttttaaatctgcaggtccaatttgaccctagggtgaggtgaagggttctgttttgtaacttctgtcttacagtttttatttctcctagatgttagcatattaaccccccaacacatttgtatgacttgggacaggattttagtcagtgtgttagtttctttttgctgctgtaacaaatatcacaaacctagtggcttaaagcaacatgaatttattatttagtagttctaaaggtgagaagtccaaaattgattttatacaaggactaaaatcaaaatgtcagcagatctctgttccttctggaggctctagggaaaaagatattccttgctttttccagcttctagaggctgtccttggcttgtggtctcttccagcggtggcattacaccagcccctgcttctctctccttcactgtcatctccctctctcttataaggaccttgtgactacactgagtccacccagataatccaggataatctccctatctcaagatccttaatcccatttgcaaagtctcttttttcatgtaatattacttacatattcaccagttctggggattaggacatggacatctttgggggtatatggtgccctccacagttagtgacccatattttcctgtagatctcatgccctgcatatgaaaacctcttatggcagccctgtctctctcttacccacttcaatgcatgctggagctgcctcgtaccagctctcaagagctgattgtgcttatcttttcccaattttgtgttcagtgaagtgacttcatgttggtagcttgaaggtggccagagtgaaactatttacaccttggaagtcagcaaatgctatggctcagggcttcctacctctccccctactctttaacctggagagctggacaccattgacttgcacctattcatttgggctgggattcctgccttttgggatatccgctctgtttttctagggactgccatctcatgtttggggagatgaatgtggatgtttagaagcattatggatacctccttatggagacctttattgacatctgcctgaactctgtaggtttggatagtgaaccatgtaccccttgggtttctcttccttcggggggatttttgctcatttctacttggcattacaatcttttttttcttctcatacaagggacgcgttacttatgtactggctttcagcaggtgacctccctgcataagcattttgggcttatttcctgtgtgtttcagtgttagaggaccttccggatccctctctgtgttttgacatggatagatggtgtgttggtgcatttgtgtggtggatttagtcctgttgaaagcttggtggttgtgctcactcataatctgcagagcctggttgaatagggcatatctggaaacatgctaacaaggtggtggcaattaattaagaattcttcttaattaaaaaaaaactactatctttccttactaaccgagagatacttgtagaataaatattcaatgaaaacctcaagcctgtttttgcacttggcattttattgtgctaactgtgccttttgaatctctaaaattgtgtttgctcttctgtttcttaatggaatttcaagcaacgttttgattgagaacttccatacaaaggactgcttaaaatatgaaaaaaattgtagttttttccttttatgtcaataattggttaattgtttcttggtgggtcctaagaatgtgtcttccaacttcatttcagtcggtctgctctgatagcaccagtatttttctcgcatggattgcaagcgcatttgagacataattgctcttatcagttaggttttcagtaaagtctcattaattaagcgtgtgattattatctaacattccctgtatatagaaagtttgttaaaataagttttcaaaaaatgaaaactgaccaacatacaggtgaatttacaaaagctgagatgctaatgtagcactaaaagaatgacagatgatcagcttagaaaacgaagccacactcgaatgggacaactgggtccaaaagggctctctagctggaggactagcagggctcaggcatgtgaacttctgccttagtgctcttcccaccatcccagcagcctcttccaggctgggcagcctggagcctcagcacccccacacctgctgcttcctctgcatgaggcccttcctctagcttcaggtcttagcccccatcgtccctgtcccaggaaaccctccctggctactgaaccacttgtctcctcctgtagctctggttacaaccgtgacacgtttgggctgtcacctcttcttccctgtcttctctccagagccagggctgagggtgtcctgctcagctatgctgctgagtccagcacagtgcttggcccagagtaggttcttagggatcatttatagagtgcgtgactgagtggcttcctgcctttcctgctgctgaccctaggctcatctaagatgctgagatattatgctgaatttgcctacgaggccttgggtgggaatggagggggtgagaaagtaggtggctggctggaggtgaggaagaatttgctattcaaccagcagacatttatcctgtctcctccatgccaggcacaggcaaagcgctttgagtgcatttccgcatttcattttcacaaccaccccaagaggtaacctttaatttatgctgtagatattagcacccacctgtggcaggcattttgttgagtgctgaagatacagtaattaaaatccatgagtctttgacttcacgcagcacatactctaaaacgttcaaatgttagtggtgagagggtgggatcgtgggaatggtaccgtcatgactaaaaattccaattatttagtttccatttgagattaccagcatattttatgattatagtttattctactttggatatttaaagttgattaactcagcctctttcacaattattttcactaggtactgtcataattttgaatgtctaactggtagcttgcctttaacaagaaccatttgcggttgttccaaatgtgaacattacatctctaagagagttaatccaaattgaaacctgctgaaatacatgaattattaaattaacatattatagattaggtcattgttttggggaagttttactagagagatttttgtaatttttaaattcccatgccagtacccaaattcacagatgctaaagtctttcatacaaattggtgttgtgtttgtatataacgtatgtaccttgtcccatatacttttaagtcatttctagattacttataataactaatggagtgtaaatgctatgcaaatagttgatacattatatttttagcttgtttttaaaattattgtacagttactttttatttttttttctgaaaaaaaatatttttttgagatgaggcattcttctgtcatccaggctggagtgcagtggtgcaatcatagttcactgcagccttgaactcctaggctcaagtgatcctcctgcctcagcctcccaaagtgttgggataacaggtgtgaaccactgcacctggccctcaatatttttgatcagtagttggttgaacccacggatgcagaacttgcagatacagagggctgattgtattatgcttacttattattttagttaaaaatttgtatttgtgagagtttttcagagaagcagaatcaatataaggaatgggcttatgcaattacggaggctgacaagtttcaagatctgcagtaagcaagctggggatccaggatagctgatggtgtagttccagtctgagtctgaagcccccagaaccaggagagctggtgatctatttctttctgaatgctagtaggcttgagacccaggaagagttgatgtttcagttcaagtgtgaaggcaggaataagccaatgtcctgaaggcaggaataaaccaatgtcccagctcaaggcagtgaggcagaaggagttttctcttattcagcctttttgttctattgaggccttcaactgattggatgaggcctatgtacattagggagggcaatcttctttactgagtctgctgagtcaatgttgacaaataaaactaaacacactaaccctgtgccccagtcaagttgacaaataaaactaaacatcacaaaattgtttctaatcccactacaatgtctttattgaccttagggtcatttataacactcagtttctaaacatttgtggaattttctatttcataagttattgattgctaccttaatatcactctgatcaaaatttattctgatttcaatcctttgaactttgtgaaattatgatataaatcaatagtgacaacttttctgagtctctgtttgtgttttttattttaaggaatacgtagttaagttttgatttttaagaaatctgtaatatttttaacttttagagaatttaatgtacttataattaatggaattactgatatgtttgagtttaaatgtcatattattgtttttcatttgtcccatatgttctgtgttactttttcctctccattcttgctttgttttggattaatcaagcatgactttattcagatttgtttacctttaccaccttgttaattaaatcttcttattttattcttttgatgcttaccctagatattacaaagtgcatatttaactagtttaaggtactttactgtattcataggttgttcaacaatgggcatatgttctgagaattgtgtcgttaggtgattttgtcattgtgcaaacattgtaaagtgtactaaacctagacagtatagcctgctgcacaataggctgtagtctattgctcctaggtgacaaacctgtatagcacgttactgtattgaatattgtaggcagttgtaacacgatgataagtatttgaatatctaaacatatgtaaatgtaggaaaggtactataaaatatggcataaaggacaaaagatggtacacctgtataggaaaatgataaatggagcttgcaggagtggaatgaggcagtggggtgaggagtgagtgaatgtgaatgcctaggacattactgcatactactgtagactttataaatactgtacactttatacaaaattattttttggccgggtgcggtaatcctagcactgtaatcccatcactttgggaggccaaggtgggcagatcatgaggtcaggagttcgagaccagcctgaccaacatggtgaaaccccgtctctactaaaaatacaaaaatttgtggggcgtagtggcacgtgctgaatcccgtctactcaggaggctgaggcaggagaactgcttgaacccgggaggtggaggttgcagtgagccgagatcgcaccattgcactccagcctgggtgacagagcgagactctgtctcaaaaaaaaaaaaaaaaaattatttttctgactctaataataaattaaccttagcttactgtaactttcttcttaaaagcttaaatatttgaagctttttgactctaataacagcttaaaacacaaacctattgtacagctgtaaaaaatattttcctttttatatacttactgtatatgctttttctattaaattttttttttacttaaaacattttttggttaaaaactaagacacaagcacacacattagcctaagccaacatggggtcaggatcatcaggatcactgtctttcacctccacaccttgtcccactggaaggccttcatgggcagtaacacctagagagctgtcatctcctgcgatgatagtgccttcttctggatacctcctgaaggacgtgcctgaagatgttttccatttaacttttttttttaatgaagtagaaggagtacactctaaaataacattaaaattacagtatagtaaatacgtaaaccactaacatcattgtttattaccattatcaagtattatgtactgtacgtaactatatgtgctatacttctgtgtgattggcattgtaataggtttgtttacaccagcttgaccacagacgggtgagtaacgcatcgcactacaatgttacaacacctgggacatcactaagtgataggaatattccagctccattataatcttatgagaccaccgtcgtatatgccatttgttgttgactaaaatgttgctatgcagggcatgactgtatatgaatatttcaagaaccttggaacactttcacttcttttgcctctctcttgtctttcgtgttgtcatgtatgtcaggtctctcttgttttaaattcctattagatattaaactttaagatattattcttatttcatacaaagtgtgtttagattcacatacacatttacctttttggttgctctttattctttctcatgtttcagattttcataagggataattttctgcaaatttctatggtggtactaatgtcagttaaaaaaaaaatctaccctgcttagattcccgaagcttcctgaatttgtgactgaatatcttttttttttttttttttactttatatatatactttaagttctagggtacatgcgcataacgtgcaggtttgttacatatgtatacatgtgccatgttggtgtgctgcacccattaactcatcatttacattaggtatatctcctaatgctatccctccccactccacccaccccacaacaggccccagtgtgtgatgttccccttcctgtgtccaggtgttttcattgttcaattcccacctaagagtgagaagatgcggtgtttggttttttgtccttgtgatagtttgctgagaatgatggtttccagcttcatccatgtccctacaaaggacatgaactcatcattttttatggctgcatagtattccatggtgtatatgtgcatgactgaatatcttttatcaccttctgaaatttcttaaccactgtgtttttaaaaagtgcttcctaccggttctctttctcatttccccttgtgggactccatgaggttagaccttttcacaatatcctctgtatctgttttgcagtttcctatatgtttcccatatgttatttttattgtgtgttaatctgaatattttctgttgacttatcttttaatgcactgacattctttaacattgtatctgatttactgttaaacacatcttttgtgtttgaaacctcttaatttctcagttcaagaatattcacttggtttttcttacagacaacaattatttggtgaaatttacaatcctatttttttgaacctattaattatagttattttaaagcctgtgtctgatgacctcaaacctgtatcactggggttctgtttctattacgctttttttttttctcttggccctgtgtattgatatgctcagcaacttcagactgagtggtggacattgtacttggaaacttgtagaggccagggtctctgcattgatatttctccagagagaattttctttaatttccggaaagcactgagactaggagcagtgagttcaccttcaccggattggggactgaactgacaggagcctgggtgtcagtctttgtatgactggtctatttctgactggcccttaccagcagggtgtaattcttcagtagtccagactgaaagcctggagcgtttaccagcgtttctcaatgtcattggcactgaactccagtgtttttctccccagcatcgtgagactgatgataggtctgtttcggttttctgccttttgatagctactctcagttaagctgtgctgcctctctaaccatgatacttgtcccaggtaaatatcaaaccccaggaagagggaaatggctcagactgtaaggttatcctctctgcaattccccgcctcctgcccctgatgctttttttttttttttttttggagacagttgctctgtcacccaggctggaatgcagtggcattatcacagctctgcaacctcctgggctcaagcaattctcccaccacagcctctggagtagctgggaccacaggcatgtgccaccacgtccagctaattttttattttttgttgagacaagggtcttgatatgttgcccaggctggtctcaaactcctggcctcaaacaatcctcccacttttgcctcccaaagtgttgggattacaggcatgagccaccatgcctggcctgcaattcccttctttataggatatttgccccttgattcctggctgccttggtagctctgaactccaattcctgtcttccaaccctgctagtcctataacactgccgaaagctctgttcagcttctcagccttcagccacgtggcttttgatttatccagtgcctcaaagaggagagcaatgtagaatgttgagttcacctcaggaagtttctattttttttccagaaatttggcctctcaacttctggctgccttgataggtctacagttcctccaaatacatattatctgtacttgatctagcttttctaattgttctcagtaggagtgtttgtctcctatagtctagtccatcattgcagtaagcaaaattcagggatagcttttacttttagtaggaagcagctatgtttggtagagagagctctgaactcaagttaaacacagaatgaatctcctttgtcctggcagaccggcagggtcattgtgaagatggcagaacatgttgatacgtaaaatctgctaacaacatgaatagaacagtacaaatgttatggaagtcacagttgaaaatgaaccaaggtcttggggttaacaatatgttactgtgtaggggctatgttttcacgttcaggatctgggtgtttggcaccgggagaaatgtccagcaccgggattttgctatgtgctaggcccctttttgtgcgcttcctggggataagctattaggccacatttagtagcctcctaaagttcactagtttacccagcttgcagtgtttcatttgcccatgaagttgtttacttagggacagaaaaaaaaataacaaatttttagtcttttagaagagtaaaatttggttttttggtattcctcgggagagtgaagagtggagaaattttgcaaggggacaagacagagccaaacatttcagctattgtccatggcttttttggggagggggcgggggggcagagtctcgctctgtcgcctaggctggagtgcagtggtatgatcttggctcactgcaacctccgcctctcaggttcaagcatttcttatgcctcagcctcccgagtagctgggattacaggcgtgcaccactacacctggctaatttttgtattttagtagagacggggtttcacctcggccaggatgatcttgatttcctgacctcgtgatccaccctcctcggcctcccaaagtgctgggattacaggtgtgagccactgcacccggcctgtccacgtctcttttggtcacctccctgctccctttcatgaagcttgacagaagctgttcttctgagccacccatgctcatctgaagcagaactgacttgcattggaaagcaaatggagctcctttcttggttgagtactttgttctttgttctaccatgttctttgcatggtctcggtccagcagagctctgtggatcctcttctatttcaatttaaagtttatgtgtttaagggattttgtgtgaccctttccaagaccaaatttctgccttgtagcttagacactagggacagtagaatagtggactttcagagcttccagagacttggtctattctcctgattttatagatgagaaaactgagggctgttcaaaggttcagtttggcttccttcacaggatggtatagcagaaaccgggaatcagatcctgactgtgccacttaactggttgcaatcttagagagacatctaacctccgagtgagttttgattgtatggcctgtacaagaataatgagaaggatgagaatgatacctgcctgtcactgagaattacacagaatgcatatgaatcacctaggctggtcaccactaactggtgctaaaaagattaaacaagtatttattgacttgccagactgtggtgggaacatgggccctgtctttgaggaggtggccatggtctagcagtcatctctttagcaacttcatggggattctagtcttttatttcacacatgaaattcagaccttgaagtcagaaccctgagaacaaggacttgtgacccattttatctgcaactttattctttctcccattattgctctcagcaggcctctcctgatctccaccaaggtgtacactgtggaaactggataatagcctcagtctgaattgggagatgacagaatcactgtttcacagaggaatattactgcctatattgtcaagcatggagtctgggttttcaatttgggcttcagacatgccagagcgacacagtgccctgccgctcttctctgcatgagcagctcacatttgttttcatggaagaccctgagatctttccagaggccagttgcatcagcacatttgtgtgtctcagatacctccagggcgctgggtatctcccgtggagtcagagcttcctttgtgctgtatggaagattcaggaatgaatgcatacgtttcctaaaccaacaacactgctggaaggcttgatttcctttctttcttgtttgggtgctttgttctacaatggtgattctattttccttgatctttgtaaggcctcaagggctcctggtttctatgaatttgaaagtatttcagctaattaatttttttttttttttgagacggagtctcgctctgtcgcccaggctggaatgcagtggcgctatcttggctcactgcaagctctgccgcccggattcatgccattctcctgcctcagcctcccgagtagctgggactacaggtgcctgccaccatgcccggctgatttttgtattttgtttagtagagacggggtttcaccatgttagccaggatggtctcaatctcctgacctcgtgatctgcctgccttggcctcccaaagtgctgggattacaggcgtgagccaccgtgcccggccaaattttttattttttatttttagtagagacagggtcttgccatgttgcctaggctggcctcaaactcctggcctcaggtgatcctctcacctcggcctccgaaagcgctgggattataggcatgaatcaccatgcccggcctaaagtttctgataagttaagaaaccttcatggaatttgctattcggtccccctttttttcttctcttactctgttttgcttgcgtgacaattccccagttataaaaatgccagtttcccgctagagtatctgtcgtcttggcaggctttttatgtcatgcaccaaatttactgttctgggacccattttgttatatcttgttcagaccactcatttcagtagaaagggaaattgtaatatttggacacctgcaggttacagagggcttccttcccttctcatcttgttgtaacttcttgtcatctgtgttttttgccactgcaacatacgatgcttctgaataacacagggcaggagaaggatcagccatggaaaaatgttatgcaagtaggaagcgttgccaaaggtaattttaagtttaagcaaaaaaggaaaaaagtaaaacaaaaagaaaaaaataggcttacacacagtgctattaagtcatttaattgtttttttttttttccattctgtgttttaagtattttaaagtcattagtgttcctagtttctggttctaaaagcagacatgaatttaaaaggcagcatagttttattacagggaaattatgccagatttcatttttttctttgtcttgccagcagagtatttcctagcttcttatttaagcttcctaaagatgaagatttgaagtttgtgtaattctccttcccaacttaccttacccatatccaagaagatgttttgcaacctcataagaattatgtaaggtaatacatgtttgaattggtaaattgtgagggtcattaatttctgaaaaggcataataatttctgtagataatttcgaagagaataactgtgatctatgaataaaaggctcatctcagcatgtaaatagtttctgagccagagttagacacaggggattctaaaggcaaactctgttggactctgtgggagacaggttgcaaatgttgagcttcattaagcatgttatacttacagctcaagaaatgcaataatttgtgtgagagattattcaggccacatgttacctccacagtcttataaaattccttctattttgccaaggaatctagatatgacgtttttatttcaacaatattttatataggtagatgtagataaatctctttacaaatggaggaattacaaatgctaatttgttaaattgagctgtaaacattttctttgctgcttaataggacaaaatacataaagattaattaaatgatcaaaaatttccaagcttctttttaatcgtgtaaatggggtctatcgccaaaagatatccagccctggtaaacatgatagatgatgatggggacacatggtgacttggatggactccatttctgggttctgcctgagtgtgttggccacaggctgtggtttacaaaaaatatcccctctgctaacatgtgagccggggtgtggtggtcagcagtttgctgtgatgtctttagggtgcctccccagggagaggatgaggggagtgctttgtggctggggatagggtctctaggaagtgggtggctcaaatgttattactgccgcatgtctgagtgtttctgtttggtgaaatccaggggagcaccttggctgggtagaagttcttaagcaggagttacaaagcctgccttctggtcctcactctgccagctaatttcatggaagcacagatccaccatacctgcaagatggggcagtgttacttatttctccctttcagggtaagtgtgaggcgctctttgaagtgatgattgtcagagttccttgaaaaacctaaagcaatgtgttagttaatatgtcagtaaattcatcaggtactctctgagcatctgccaaagaaacaggccctgtcctgggccagcctcatgagcattaggctcacacacgtacataactgtgtttaatcatgttgtaaggatgctttgaggtgctgctagaatgccaccttgcatctgaaagggatttttgtccagtttgttcacccatatatttctagtgtgtaataaactactattaggtaattttataaaaatttgttgaatgaatgaatgtttttcacaagtattataataaataatacatggtcttgtcaaggccaaggttattggtttcatgttcgtcatattccattccgtagaggcagacagctgctcactgtccagcaggtgcatggtgaatggaaggggggtggtcctggggcagggtgggaggggagttcacaagaacccaggcagcagggccaaggctattgcactggcccttggcgcagctgccgttgcttgttcccacatggtatggcttggctcagcccccgactctggagtccattgtctcgttatttaagcataggcatgtttcacaggaatgacctcctctgtggccttgggggcggccccagctgtgtaaacacatgtgtatatgtgcatatactttatatatatgatacacaggtgtgctgtgtgtgtgtctgtctaacatgaggagttcagctgcagagtcaaacagatcgagcattccaatcctggatcagtcactgttgctggctttatgctctcagaatggttactgaatcctttgaagcttgggggttttcagctacagggaggtgatgacagtacctagtttatagggttattgtgagcattaaatgggttgtgctcacaagggttcagagtgggttgggtggtagtatttgtaagagtgtgagtgtcagttgtcactgctctcatgtcaataccacttattgtaggattactatactgggccctgggctaagaacctcatgtgcataatattaattttaataacacaactatgaactgagtttttaaactcaaaaggaaacgttacaagcggtgacttgcatgagggtttttgtttccttgttttggttgaaagagcgtcctgagccccacccctgctttgaacacattccccaactccaccatgcttccagggtctgctcctttcttaccagtttaggtttttccctgtgtggctctttgtaagtctttccctaatattggatagcccatttcttgaactgcagctgtagatcacatgaacattttgatttatggtggcacaggaggctataacaaagttacagactttaaattatgcgattagagtagaaagccatattgtaaactgtgcccttattgtttgcaaagtgtcacgcccatcaattgccttggagtttgattgatctccactgggtgctggctgtctgcaaaatgctgtactgtcatgattagtttaacccatctctactcccaaggagttgtcagtctactgcggagacaccagccagacaaatagttatacgcaataaggtgaatgctctgacagtaccagaaagacaaatatggcgggctaaggagaggaagagtggttgggtgtgttcaggaaggcccctctgagagggaggcatttgagtagagactgggtgtccttttttcattcactccacttttcttcttagcacttaataccatctgatgcttttatgttccactccctcccatccccagaatatcaattctgtgctaacaggggcttagtctgttagcatttactctcgtatcaccagggcctgggtcaggctggcatgatgtggaatgaatgaatgatagacagatccattaactgggagccacagaacaatcacccacagactgtgggctgcatagaaagggttaccagttaggcaagggtgagcaccacacagagggcacagagcaccaatgaatgccacagggacaattcatccgaaggcatagagcctccaggcaccataagtggatgcgtccgagcatatatttttaaaggctgccctacctttttggcttctgtggccttccacaccattggaaacacatccaatgacatagcactggtgaagtggcacagtgactctttgtgcttcactttctgaaggagtataggaacattcattctttgggacagaattcttgtagcattagggaaatgagcaatctgaacttcttggcattctaatccaaggaggagttgcttgcaagcaagaaatctgaatcccttcacaggtcgaagagaagttggggatccttaagcgtggagggtttgaaactatttggtcatcatacagtttattttcaattgtcttgtagggctgcattaggaattgattttatctagaagacagaggatactgactattggtcaacaataacaccaaataagttttcatgaacattaaaaaaatatatcctggaagacaacctgggcattcatcctggacataggaacgggcaaagatttcatgacaaagacagcaaaagcaaaaattgagaagtaggatctaattaaacttaagaatgtctgcacagcaaaataaactatcaaaagagaaaacagacaacctgcagaataggagaaaatatttacaagctttgcatctgacaaaagtctaatatccagcatctataaggatcttaaatttacaataaaaaaaactccattaaaaagtggcgtgaacagacacttctcaaaagaagacatacatgcagccaacaaacatgaaaaatagctcagatcattagagaaatgcaaatcaaaactacattgagataccatcttacaccagtcagaatagctattattaaaaaagccaaaaaccaaaaaacaaacaaaaccaaaaagcagatgctggtgaggttttggagaaaaggaagcacttatacactgtcgatgggagtgtaaattagttcaactattgtggaaagcagtatggcaattcctcaaagagctaaaaacagaactgccatttgacccagcaatcccatttactgagtatatatccagaggaatataaattattctaccataaaggcacatgcatgcaaatgttcattacagcactattcacagtagcaaagacatggaattaacctacatgcccatcaatgatagattggataaagaaaatgtggtgtatatacaccatggaatactatgcagccatataaaagaatgagatcatgtcctttgcaggaacatgagtggagcaggaggttattagtcttagcaaactaacacaggaacagaaaaccagataccacatgttctcacttataagtgggagctaaatgatgagaacttaataacacaaagaagggaacaacagacactggaacctacttgagtggggagggtgagaggaggaagaggagcagcaaagataactattgggtactgggcttcatacctgggtgatgaaataatatgtacaacaaacccccaagacacatgtttacctgtgtaacaaaccttcacatgtacccctaaacctaaaataaaagttaaaaaaaattcccgtcttccagatcttggtttctaataccatttccctataaaaggaaccaagactacttggagaaatggctgattctaggatgagggcagggaatttatgagtctggggcattcatagtgtcctaaagtaaagatgtgctcagcaaaccaagcaaacacaatgattagtgtgtgctagagggacagaggggtcaactgagaaggatcctgtattagtccattctcacattgctataaaaagatacctgacactggataatttataaagaaaagaggttttattggctcacggttccacaggctgtgcaggaagcatgaagctgcatctgctcggcttctggggaggcctcgggaaacttacaatcacagcagaaggcaaagggggagccagcacttcacgtggtgagagtaggagcaaaagagagagatgggggaggtgccacgcacttttaaacaaccagacctcgtgagcactcactcattgtcacaagaacagcaccaaggggatggtactaaaccattcatgagaaatccacccccgtgatccagtcccctcccctcaggccctgcctccaacactgggggttataattcgacatgagatttggtggggacacagctacaaaccatatcagctcccagtggccaaagctggaacaattcaagcaacaaaataaagtggtattagattgtaacccaaattataaaataaatactcacaatatgtataaataggggggcagcagacaaggaattgcaaataatttaagtagctgctccggcttccgggaggtgtgtaactcccacttctcaagtgttggctgtgcatagtgactttctttcaaagagtacagcatggaaaggaagggggaaaagagtgacttgacagtggagaaacgtgacagccaccacctcagccaggtgatcagagttaacatttatagtgagaagtcacattaatagcatgtacccttgataagatgtgatgagagtgacactttacctctgtggtcttcctccccaaaacctgtaacctcagtctcctcatgagaaaaccatcagacgattcccatttgaggaatactctacaaaatacctgaccagtacttctcaacacagtactgctcaaaacaagcaagtctcgtagaaactgtcacggacaacaggaggctaagcaaacatgacaattaagtgtaatgtgatatcctagatgtgatcctggagcagaaaaatgacattaggtaaaaatgaaggctatctgaataaagcatgaacttcaattaatagtaatgtattaatattgattcattggttgtgacaaatacaccaataaatgtaagtggataaccacagaggaaactgggcgtgcgacatatggaaactccctgtatggccttagcaattattctgtaaatctaaaactattctgagataaagaagtttattgaaaaatacatactgaagtaaactctggaattattgtcacttttgactgaacagcaggatgtcaagtcaacatgccaatatgtgttctgtggatgaagattgaggggtgggttagaaaatcttagctcaacatataaaaactctgtgcatagaagttgtcaaagatgtagaaaattcttgccggggtcatcgggtgactctccaaataatgcaaagctcgtttgaaataccattgttccaagggggccaaactaaacaggccacatgacatagtggtcaagccatgctgccctgggttcattccagccctgcgccataactgccaagagattcttgtacaagtagtttacacttgtacaagtgtaaactgaacttcagtttcctcattgataacatgaatatcgtagtatatcatgccattggcagtttcaaggttaaaatgagggtgataatatctgtagcgcactcagcacagtagttggtactcattagctgttccctaaagggcagctgttgttgttgcctgaaacttctttttttttttttttaacatgcaaaacacattccattaagggaagtctaatgactctgcttaatggcagtagatgatgccagtggctaccttggtttgatttcaagggtaggaggacattcttcccctacaaagtgtctgttattaacacctcttccagtaccccctcgaagaattaattgtgctaaataatttgtgttaaatatgaccatgtctctttcaagctgctcatgtccctagaaggaataggacatccagtgtgaaggggcttataaagtttgccgtgcaggggagccttgaaacaggtagagcagaggcttggagagggagaaagcagttcagaggagagggtaaaacttgtttacttcccagacccacctagatctacctagggatggccccgttgctctttatctaagaaaaattagtattgtgtatttcctgctaagctaagtatccatgaagtttggatttatctgacttgtacaaatgaaatacaggtccaaagcatttttatagatttacacggtaaagattaatcttcacccaagcaactggatccctggagcttggcttttatgaagaggaatgttagctcacccaccaagacttcatttaatgtgctcaagtttttaattgccttttttctgcctctcaggaattattacatcaatttcatttacccagattgaaaatccaagtgcttctgttgtcagcatgggctgcacctaagcatgctgactctggctcagtttccccttggctgcatttttcatcttttctcttttctgttgcaggatttcttcaaagttatgtgagttccacaagttccatgggtagagaagtttaggggaaaaaatggttccatgggtgaataagtttaggaaatgcgaaaccaagttaagcaggtttctttactgcaggacttttcagagacttggttgtgctgacgtgctttgagtccctgggagtggtgtggtgtggctcatctcccagtcacatgaaacctgtcttcttgcagcagcccttgatgcagagggattagtgttctgaggtgcctacttgaaaaacactgctgcatacttttttccaatttctttgcattcatcagacttgcctttctatgtccccacattgtctgtagcataatttacatgttattaaattttttctccatatcattcttcctcactgcctcaatgtatgtttgtaacttttttaatagcgtggctgagcctctgtggaaccttgggttttattttagtcacgtaatcttttatgttggcattgagttattagtgagttgtcaatcacctgtgcatattaaggaggcagaagcaaattgtggctgaacccagaggtagagcaaatcacctcagtgattgtgcaaaaaaacatccaatttggctcctataattgctttttatggcagtcccactatgtgggcttattttaatagaaaaacttgagagattaatgcacttgctaaggtattttccttctgtcatcacagagcttcttatgattggggagaaagcagtaaatctcaagttatctagtttttaggttgtcagtttttatacatgacagtacctggcagagaagtggatacaattaagaaaatataccctgtttttcctgagaaaaggaaaaatgacacaaaaggtcatttccaatttaagtctaaataatgtaaaaaagaggctttgcaagagctgctatgaagacccctaaacagaaggcagttatctctctaatgcagtttaatctgcccatgatggggccaactgagacatggtacagtgattcacatcaactctctttcctcctgtgggtcaaggaaattaatttgctcctgcctccaaactgcttttgaccaaaaccataaaccatagcactaataaactcgtttgaggtcttcagatcattttgaatattttattagcaacatatacaccaacagatgtgtttattgttgtaaaatgtaaccatactgtggaagcgatgtccataaatgtatcagtcattcttcctaatgattgtcaaaatattattatttcatatgtaaaaataagtgggtgtctgaccctgtggctagaatataggacaaaaggcagtattgtacagtaattattgagtcaactaagtcccagctctggggtaggacttggcttgaagtattgccaaggcctttcaaaggctcttgaagaacaggaaaaattaggcattgaatttttgagttgctttgctttcaactctgtaagcaagaatgcagttattgtactggttaaatgtggaaataaatcagtaaatattcataaggttaaccactatcccaaaggaaggggtgtagagcaatgagcctaacctttttagcctttagagattttataattcagatggagagacaagatatatattcatggacaaagtttaatgtcagttctagaatcaaggaacactgacgcagctcaagattttcagtagctgcatttgaaaagctctgttaatatctgttgtgacccctgttgccacatgaggtgtccaagccaaaagtgttggatcagaagaagggagatcattgtgtgctaagggggttcaggaagaacaaatgtagttctactgggtgccatggttcagaatcatcacttcacttcctaaaaagcagacaatctgagtttggctcaaaaatattatactagcataggagataataacagtgtagtgggtaaatatcatggcttcacacaagtcaatcttatgtggaattttgggcaagttatttttcttagtttctaatcctctctttactcatcattaaaatagttatagttaaaatatgactacaataactatcaacctagtttctatgagaataaaatcagatagtacttttaaaataaaatcactttacactaggctagacacttggtaaagtcttgctaagtatcagctgctgtaataatcactgcaaacgacacctgtggaatcttatttcaggccaggaataaagtttgcatagggaacagaagaatacagttaaataacttaatttctaatgtggaatattattttggcatttatgacaacagcgtctggggtggtccaaagtattaaaggggctctctacgtaagagggagtttggaatagtcaacccatcaagacaggagaaaagaattcattggtgatggtcatattaggtgtatttttgttgttgttgttgttgttgaagtgaaaacatcccagataggagccaccaaaggggctggcagatcccattcgttggtttttggaggtcaaaatcccagcatttgggttgaaagatcagggatgataagcaagtctgtttccttccaaccttcccaagagaacagtaattactagatataataatgcttctcaaaggcggttactgaaaaccctctgctgcttcagcataatcagaaagacagaagttgcaggatgattttctttgtgagaggcacctactcggaatgctaattaggcgaagtaaaagggatgtggatcagcatccaacagcgcatgcattttctcctagtaagtgaggatgagaggaaggaggaggaggaagaatttgacttatctgttttatggttcatgatgtgattccccaaattgatttcaggctcttaattcttctcatctgctggttttgtaaggagatgtaaaaaactatctaaaaataaagtttggagttttgttttgttttgttttgttgttttgagacagggtcccactctgtctcccagtctggagtgcaatggtgcaatggtgcgatctcggctcactgcgtcttctgcctcccaggttcaagtgattctcctgtctcagccttccgagtagctgggattacaggcacctgctgctatgcctggctaatttttgtattttgagtagagacgggtttcaccatgttggccaggctggtcttgaactcctgacctcaagtgatccactcacctcagcctctcaaaatgctgggattacaggcatgagccactgcacctggctagagtctttatacttttgtctacttttgctttcttttgggtgccctcaaaatagaacttgaatccagtggcaaattggcccaatagccaagagccggccctcttggggtcagtctatatctttgcttttatttgctgccaaacattcagtttctaagagaaatatgaacacttatctagaaaaatctcagtgctggcctgcacagggctgttgtttaatgatcatgactgggggctccctgcgtgttgggcactgttgtaagcacttcctgagcagagctgtatataatccttatagcctacagagcagtaggttctattagtatcacgagtacctctattatagaagagaaaagccagcacagtgagctaggtggagctgggattcaaacccaggccatctggctccagagtccacagtctaagaaagcctattaatcagcaaagggactgtctggtaactttgagatgaagacacagcctcggagcagaatcggtgcaaactgggttttctggagaccaatttgggtatgcccaattcaaattgcacgcaagagacttggctggtatatggcctgcatgctggctcacgtggctgtggtcacatggatgtgggaagtgtagggatggatgccagactggcaatatcagggaagctcctgtggcataggttgccagtgtaggatagggattaagagcttggcctctagggccacagtcagcagtcacccagcttccagtgctgagtgtgttggtggtggtaactggtacatagttccaacacagttgcttttatgtaaccttgggtaagttacttgaacttcctaagcctcagtttttccatctaaaatatgatgatgataagaatacctgtgacttagggctgccatgaggattcagtgagagtttgtatagtagttcctctttatccaaagggaatacattccagggcccccagtggattcctgaaaactggatagtaccaaaacctgtatacacttatgtgttttcctatacatacatacatactcatgataaagttgaatttataaattaggcacaataaaagattaaaaataactaataataaaatagaacatgctgggcacagtggctcacacgtgtaatcctagcactttgggaggctgagacgggtagatcaactgaggtcaggagttccagaccagcctggccaacatggtgaaatcccagctctactaaaaatacaaaaaacaaaaacaaacaaacaaacaaaaagccaggcatggtggtggacgtctgtaatcccagctactcgggaggctgaggcaggataatcacttgaatctgggaggcagaggttgcggcgagctgagatcgtgccactgcactccagcctgggggacagagtgagactcagtctcaaataaaaatgaaatgaaatgaaataaaataaatagaataaaatagaacaattataacaatatgtcagcaccaccactcttgtactttggggtcattatgaaataaaataagggttacttgaacacaagccctgcgacgcctcaacagtcaatctgctcgcccaggcagctactgagtgacaaatgggtgggtagcatatatggtgtgactacgcccgacaaagagacgattcaggtcctgggtggtatttcctcatgcagctcagaatagcgcacaatttaaaatgtatgaattgtttatttttggaatttcccgtgtaatatttttggattgaggttgactgcaggttgaaaccacagaaagcaaaaccgtggataagggggactactaagaaaacattagcaagtcttggaacatggtcagttagatggtggaggtggttgcttttgttttgctattgctgctcaggcaagcagggaattttgaagatgactgacagtaaagcacctttaactatttgtgaaaatatggaaaagctctgtagaaattactcttctcaatagcagagatacaggaggagatttgggtccgggtgaattgcacagccagcctcaacagttagcctcaattgcaatttcagatcataaaccatgtgtcccttgattccagatctcctccaagattgtaccccctgtccccactctccagctcccctgtgcatttcccttcatcctgtgttcttgtggagtcctggaaacccaaggctggaaactacccagaaagacaaggggtggtgtgggagacccgcgattgcgtgggctgtcaaatgtttgcgaaacggcagctgatgccagaagaatcggccaaaaatggaatgggtgcccttgattatatttagtgtgtagtcttctgtaaattcacatgtttccaaattattttcagcactctttgttttgttctgtttttggtccttagctattcatgactttcctgatctcaaagcccagttggtgacccatctccacagcttggaaaccatgtggggttcggctattgttcatgtgtctttaactttgcagcacaaatgatagtatttcctttgttacactcattcctgaggccactgaagcatttgatagttcttactaaaaaagattagttgttaagaatcaaaagaggaaaatcaaacaaacaaacgaaaacgaaacaaaacaaaatgtcccctccctgctatacatacagcgtcctggaggaggctggccaattatctggctccaggctccagacttcaaacaactgggcaaaaagcacccgtgctctgacccagctctgccgattgctagcagtgtgacttcagacaagccacggatccctctgagccttatcctccttagctctgagtgggtaatgacaccagcctgctttcctcactggatgaatatggagatggaaattagaatgcatctgcagaccctttctgaattgcacaatgctagtctgtaggggatacagatatagggggattttcctggcagatacaggagtcctgctccccccgtcctgtgctggaaacagacctgaccacctgatgatagcaccttctccctcagagcctagtaatgccccccagtccttctcaacatagagcgatgttgggaggaattggagaagtcctggtgtccaagtaccacagcactgcgaccgtggagtgagcgcccagccttgacagtctcctcccactttcttttggtagaagtggccccatggctgcagatgagcaaaactagtctgggctggtgtgaggaagcgccccgaatctgtggcctgggaagagcagctgaggaactgcaagcagctggtgttggaggtgatcttgaaaaaggacatttcccccagactttaaactaatagcaattagttgaatgagaccgcatatgtgcaaactgtcatctatgaaacacagtaatatttgttgttattaaatcaaaatgtcaaatgccttattagctttaaaaatgacatcatttgtgctgcagactcactggctgaggagttccctgtggcaggagccagggttcccactgtggcctcttgatctggggtaatgcctggctcataggtaagggctcagggtttgttgactgattggctgaagaaaaacaaaaaaaggaagcatgcattgaacatgccagtaattttcaaaagtaagtgtccacatccaatatccagtcttgtgtgtatgatgagatcacatgtagaggtgtttaccaaacattttaatatttaaatcaaacagcaatttgcaagactttagcttcattgtaagtaataatatatttggaacctgtgtttacagtactgtctatacataggtttaaaccacatataaatatttaacaatacaattaaaaggtcatgcttgtccatgtacctcctaaaatcctcttgttcatatcctctgggatccattgaagttctagtaattatatacttttgccttttatgcggaagccagaacaagaactcaagaaaaatttagatgacatttgagcagcttaaaacgtgttgggtgggttacagctagggtactctttcattctgatttacccaggacagtgccagtttacacctgttgtcataattattaatgtcattccctttcaatctcaacaatgtctttggacaataaattatatggtcatggtccacaagtacatggtcatagcctacaagtattaatagctggattggaatagaacacagtctttttattttttttttaaaaaatttaaatttaattttaagttccaagatgtctttttatttttattttttaacattgtatgtaagtgtgcatgtgtatgggtgtgtgtgtgtgtgtgtgggagagagagattgagagagagtgcgagagaatgagaatgattattccctgggggaccccctgcctggacccatcaaaaggtggcttttgctgaacagagaaaacagtcctggctctcatggtggctcatgttcaagggttgaggcttttgacctaaggccaggcctgctctcccaccatccatccagagcctggtgttctggactgccttccacttcactgacttggcactggcactgaaagcaccttgggctaaagcatgggttccatcagtcaactttgggccattgacatagtgcagttgttgcctggtataatgcagggcttgagaaacagagcatctattcagaaggcctgcctttgggaaggtcacacgatctcccccagtctctcatcagtgtcatcatgcatgaatactgattatggaaaataggctcatctaagtattaaaaattgtcaccagtgcccccaccccttgtttcatcttcaaatgaaaatgcaatgcaagaatgattacttttaaaagagtgtattgtcaagattaatttggagtttgcttctctatcatcattgtcatctggtagtccctggagttccaagcaatctgcccacttaggcctccctaggtgatgggattacaggcgtgagcgcctgcatatctacattttgagagcatgtagctattacatactatactctcccttataatcctcatttagtcttaattttacaaacatctatatatttgctgttcactaccagacataacctctgttgttcagtgattttggttgttttgaagcttactctctagtgtatttctcagaaatggctcgaaggaaaaatattccctgagttcttacatgttgcctgtgtcctttatacttgaaattaattcaaaaatccatggcttatattttcttcccttgaggatcttagataggttcctctattttctttttgcttacattgttttgtaaagtctgatcataatattttttcccttgtaagtcacatgttctttttgcccagatgctcgaacaatttttccttctaagatttagtaataaaagtggacctgggggccggatgcgatggctcatgcctgtaatcccagtactttgggaggccaaggtgggtggatcacctgaggtcaggaggtcaagaccagcctggccaacttggcgaaactccatctctactaaaaatacaaaaattagccgggcgtggttgcggctgtctgtaatcccagctacttgggaggcggctgtctgtaatcccagctacttgggaggctgaggcaggataatcacttgaacctgggagacggaggctgcagtgagctgagattgcactattgcactccagcctgggcaacaggagagaaactccatctcaaaaaaacaaaaaaaagagccagaatatctcagcatctcagaaagcaactatcataaatttttttaacactgcatgagaacaacagaagagggagctctgaagtgagaaaagctgctatgaaccagctttgttcctaaatgtttaggaaaattaatttcacttaacaacaaggtgtataaaggatggaggtgtacaacaccacacaaagacaaagtaagttgggaggaagaatgagcagactaacatctctacatcagcacaacaaaaagacatacccacagaacagattaaaaccatatcctactccggggcgtggtggttcacgcctgtagtcccagcactttgggaggcccaggtgggcggatcacctgaggtcaggagttcaagatcagcctggccaacatggtgaaaccctgtctactaaaaatacaaaaattagctggacgtggtggtgcatgcctgtaatcccagttactcgggaggctgaggcaggagaattgcttgaaccctggaggtaggtggaggttgcagtgagccaaaatcataccattgcacttcagcctgggcaacagagcacgactccatctcaaacaaacaaacaaacaaataaataaaaccaaatcccactattgtcaaaatgaactaaaacattaagaaagtgatacaagatatgagagaacaatataaatcaaaacagaaaaatcttggaaatgaggtggcagaagtgaggaaagcattggaaataaaaaatattttagaaataaagattaaactagaaggaacacaagagcaaataaacacaacagataatgccttaaattaagtagaaggtaaacattaggaacattgtaaatataaaaaataggaacattgtaaatataaaaaatagacaaagaattcaagagaaagggacacgctattgaagataggcagaggagagcttgacatatgactactaggcacccctgaaaaagaaaactaaagcaggaaaccacaactagtacttgatctatagttcaagagaaattgcctggaatgaaaaggatttgaaattccatattgggatgtcacatctgagaatagtgacccacaatgcccaacacccaagacatactccagtcttgtctcatatctgccatgcctagtaccatgcctagtaccatgcctggtgcatagtggatgctcaaactactgaccaaatatattaatatttggtaaataaaatattctcgaaaacacctaggaaatgtaacagtctttccttatgtaacaatagttttccttaacggtgactgttaccctggatgagaatgggaatgttactgtaagctgttatggactcagttgtgtcctcccacctccaaaaggtgtaggtcgaagctctgattcccaatgtgactatatgtggagatagggtcttttagaaggtaattaaggtaaagtgagattaaaagggtggagcctggctgggcttggtggctcacaccactcatgcctgtaatcccagcactttgggaggccgaggcagttggatctcctgaggtcaggagttcaagaccagcctggccaacatagtgaaaccccgtccctactaaaaatacaaaaattagccgggcatggtggcatgctcctgtaatcccagcaactcgggaggctgaggcaggagaatcccttgaacctgggagatggaggttgcaatgagctgagattgtgccactgcactccagcccgggcaacaagagagaaactccatctcaaaaaaaaaaaaaaaagaaaaagaaaaagaaaaaaaaaggtggggccctaatcctaatccagtaggaccgatgtccttataagaagaggaagaaataccaggaatccacaggcacagagaaaagaccatgtgaggacacagcaacaaggcagcaagccaaggagagaggccatcagaaaccaaccctactggcatcttgatgttggacttctcagtctccagaaccgtgggaaaatatatttatgttgtttaagacccccagtctgtggtactttgttatggcagacctaactgattaatacaaattttaaggtttgggttactccagcagataaagaactatgactagttgaggtgcttgctgaaggcaaagggaatacagaatgggtagtggaagaaggtagttgttaataactatgaccgtgtgatcagttacagaaatgagcactgtaattatcatgagtatttccatatttggttatgaatatgtacgtgtgcaaggcaaatatctttggtttcctccctctgttatcctcttgtcatgtaatgtaagatgtattaactttatatcatagtatttaagttacgggatatcaaggagaagaataaacagcatggagagactttgcatccctttctagtgttggatttggttgtacacaggttagtttttatcatactaggaagaagtatgaccttgttgttgttttcgtttggagattaagcatggtttacagagatgcgtgcgggtgccaagttgacaaggacttgagatggttaactttatatgccaaattacaggacattcttggatgagattaatatttaaattggtgaacaatgagtaaacagattgccctctataatgtgggtgggccttgtctaatccattaaaggcctgagtagaataaaaaatctggcatcccagagtgagaaggacttctccagcagactgtctttgaactttgtctgcaccagtggctctcctgggtctccaggctgccaggctacatttgaacttgccagtctcggtaattgtgagaaccagttccttagaataaatgtctctgtttacgtacacacacacacacacacacacacacacaccaggctacatttgaacttgccagtctcagtaatcgtgacaaccagttccttagaacaaatctctctgtttacgtacacacacacacacacacacacacacacacacacacccctcatcctattggttctggttcaaccgtaatacacaatattcaacattctataccaaaattatgttttttttttttttatgtgagtgggactatttctttttttgtcttttaataatatcaaagtggttcattatgaccctagataactatagacaactctttagttacctttttgtttgaaaacaattatgccatgatgaaacttttgctatcatggtgtcccctgtgctttcagtgggtggtggagcacccaagactcctctgaaaatgtaatgggcaaattcatttggtagggttccccagagaacactgtttttctctgaatcattatgtgcttttcgtgtgaagtctgatagacttgatggaaagtagctgtgatcaactagcccatttagtgtcattgccgcagttttctctcctccttgatttcaggactggttgactttgttctaatgtacatgctgggatttccaggcaaaatcctgattttgtggtcagtggtgaacatgtggttgataagtgacaaacacagaactataaatctggcaatgtattatctaccggacagttgatgagagagtagattttaagtgttttcaccacaaaaaagtgatgattatgtgaggtaatgtctgttaaatggcttgatttagccattctaattatatatatctttatcaaaacatcatattataccccataaatatatacaattttttacttaacaattaaaataaatactttttttaaggagcaaggtcttgctttgtcacctagactggagtgcggtgatatgattatagctcactgtagcctcaaactcctgggctcaagtgatcctctcacctcaccctcccatgtagctgggactaaaggctcatgccacaatacttggctaatttttaaattttttttgtagagatggagtctagacttgttgccctggctggtctcaaacttctgggctcaagcagtcttccctccgtcatcgcccaaagtgcttggcttacgtaaaataaatattttttaaaaagaacaataaattcattttatttacaaaggtgataagcatgcaactcctagggggcttacagtctaggagaggaaggacaagaagcaaatgaacaagaaaatatcagacagtgagtggtaagagctgggcagagaaagaggcaatatgccagacagcagctgggtagtgagttggtttgagtgttcagggaaggtagcatttaatttgaaggccaatgacaggaaggagtaaagatctgagtaaagagcattctcagtaggagaaacagcgggtgcaaaagctccgaggcagcactagcctacagactatgagcacagataatctcagccatagactcttaggggagagtggtcaggggttatgtaagtgacttaggcagggtcagataagtagggaggtcaggaggaggttcagctgggtttggtgcctgcatgacactgatcttgctccagtgttttgaaaagagggatggggtgatattggggtgagagaggaaagcaggagagcagtgaagagtcttctgcaagagatgaagtcttctgcaagagtagactgaggccatgttgctggaggtgggagaaacagagtcaatctctatcataggtgcagggcatctctaactcttttattaaagtctatgtatttgtattttaaagttaacagataacaagtatatctgtataactgtcttaatttgaagccatagattattttgttttgaagaagatgacaaacctaggattccttttggaaacattattactctcatctgccactgttttttgaggatctgcagacggtggcattgtagtgagtgagaatgagtgggaatctgaaatgtcaacctattttggtcaaaagggctctaggagccttctcctctataccaattccatctcatctagctcctacagtaatttcacaaatcgtgtaacttcattgccttcctaaacagtgtttagttctggcccttgacatctgtatcttctcacttgaatctaaataaatgttgttaccttggaacatgagtaagaactgacatggagcagcgttagtaataagtgacctggttcccagaggctagttagataaatatcaaaatgatactgtcataaaacgatttcacttataagacagaacaatagtgtgaaacttgaagacctgctgggttatagcgaggccctggtgttttactgttccagcttgcctgttgaaatctgcttggttctagtatttgtgtgtttatgtaattttttattcatgcagtaatcttttttttagaaattctccttaattgagctcccaagatacactgtgtaaagtatctggatcccagtggttccaatttctctttttgcagagctagttttttttttttttgtacgatactctccgtctctcccattccctttgtactggtttgctaaaacacaggtagatccttgaaggaaaaatctttgttttcttgcaggatgggctagtgattagattgtcagaagtctagtcctagatttaggttgggctttttgtaatggattttataccagaaattatttataattagtcatactatggatatacaaggacttacttgtagaaaacagcagcccaactcattacagaaatatgataggagcatgggatcagttgtgtctcatttctgtggccaaggaaaataggctggtgtcttagctgatgtccaataggttttatttttactcattctttcctttgttttagaagtgttttagggacttctgtaaagacttcaactggccagtgattatgtcactaggactcagctgcagtctcttaaaattagaattgtgcacactctgtgtgaggactttggttgtctctctcctgtctttggtctctgcaggctgcctgccctggcacatggaactgcctttctgtgctctctgctctgttctccccagggaccagccgtatgatatagttcccctgccatctccctgtgtccccccagcttgtttgttgggcatctggtgaaagcctgcagcatgcttcctgtgctcctaccatcctagaacctgcagttgaccaagggcaccatgagaggggtgttgaggccgggaagtagagaggtagcagaaagagaagtgcagcaggattaagccccccgggaaacacatagtccatctttgctttcatcaatcttggtcttcatctgaaatcatttcctggctttagcaacctgcccacactttcagagactttgctggtcttttaaagtcagtatttgatttaatattcttcctgaatcattcggtgcccattttgtttacatgtggctctgaaattggtcctttaatattaaagattcaaaactgccctgagtttaaccaactctttttttttttttttgctcagatcatctttgttttaaaatactataatgacactgtatttttaattaatgagtcttgtggtgttaattctttctgagagcaagagagtatgggtgggtctctattagtgtgttctcaccttgctataaagaaatacctgagactgggtaatttatgaagaaaagaggtttaatcggcttgtgcttctgtaggttttacaggaagcacagcggattctgcttggcttctggggaggcctcaggaaatttacagtcatggcagaaggcaaaagggtagcaggcaggtcacatggctggagcaggagccagagagagagtgaagggggaggtgccacacactttcaaatgaccagagctcacaagaactcactattgcgagaacaccaccaaagggatggtactaaaccattcatgagtgatccggtcaccttccaccagggcccacctccaacactggggatgacaattggacgtgagatttgggtgggacacagatccaagccatatcagtgtctattcctgtcatatgtgttttgatttggaggaagtatttgtgagcttgtgtacccatatgtgccttttggaggacttaaaggatagtgaaattgggataatgtaccctctaatccaaggactatgtgattccctgtttttttttgttttttgagacagagtctattgcccaggctggagtgcagtggcaccatctcggctcgctgcaacctctgccacccacgttcaagcaattctcctgcctcagcctcccgagtagctgggattataggtgcctgccaccacgcctggctaatttttgtattttagtagagatggggtttcaccatgttggccaggctggttttaaactcctgacctcgtgatccagccgcctcagcctcccaaagtgctgggattataggtgtgagcaactgcgcccggccgatttcctgtgtttcttacagtgagcggctggtttaggtgttggatgggctcaaaaatatgtattttttccatttccctagagaatgttgatgctcatagagaccacttgagaagcactgctttggggagggatgctctcccatcagatggcagctttgggtttgccagtggtgagtttgatctctggaggatcatcttccatttccagatagggtactgaagatagagtggttcattatcttacaatccagtgcttcctccctacttgtccatttccctttcaagggggctggcctagggaccagtgagaactcagtcaattagcttctgataaattgtttctttttaaaacaatacattatattaactctggaggagtgcagtgaggtatccaccaaatgcaatcttccagtagcttctttgtggttatgtttgtgtgcctgcctgtattgatgggtgaagataaggacttggtcaaattacctaacctttctgagcttcagtttccaagtatgaagatggagatgataataatgcctaatgcatagggttcttcagaggattaaatgctaaatgctaagactagcacatagcatgccataagtgctatatgagagttagttgttatgagtattactgttgttaccaacctatttgaatcaaagtaaaaatcttccttgtcagaaattcacaggaatcaacaaggaagatatgggaaaatgctgtgcacagcagcttgtatactctaagggagttggtgcaatttctgggatgagcgctgtccttacctgcaatgtggaggctttatcaatggaatctattgtgaagagcattaataggacatcttcctgtcctccagccccagctcaaaggtgctgccaaatgcagataaaagcactggagtaacctcagttgattattgtctacctcctgaatctctccatcagtgaaattaatatttggttgctgaggggagagacaacatctgtaacatttcccctgtggaatggctgtttggtttctattgcacacatttttctctcaggttaaaaactgttgaaacctgatttccctcttttaaaaatggaatcatgtttgattttatagtaatgtttatagagctaaggagagttaagagtcattctggcgttaaaaccgtctaagccttcaaataaatatattgttgttatcttgaaactttccaaactgaacttggaattcactcaggcatcttatagagctttgatacatcagagggggacagtaatgatcctgtaaattcctagcaacgtgggaccactcttgcggcttgcaaagaacagaatgaaatgcggcataaagacttgcactggcaaatgtccacacaagtattaatctacttctacttgaagtaaggtcccaattacagaagatttattttgaaagaatttggtgtatgatcatcatctctcctctgagtgattgcattcacctcctgactggtccatctttcacaattcctgggctatctttcctgaaactgttctcatcagctcagtcctttgcttgcaagtccagcatgagactcccattgccggtaacaaaagtacaatctttgggcctttgtattccagaaccttccctgtctgcttcccaccctactttattgttctccccatattccccgctgcaggcctttgcttatgttgtttactctacctaagagcctcttctttacctctactgccacgtactctgggaatctctcaaatcatctcaaatgtcttccagtaaagtcttttctaaacacattacttccagaattaatcattttacccccctgtatagaaatggatacatgaggttaagcgaggttaagtaacttatccaaggtcacagatccagtaagtgtcagagttggggtgggcaatgagacacataatgaaaaaaaaaatgcaaaagcatagttggaaataggaagtcattgttaaatttagggacaaaaaataggctttgtgagaaatgaaccactgggctatagcctgagaaaaggttgtatacacaggatcttggaaagggaaggtccttgaacctgaaattggtgacactttttctgggggacctgaaatcttgtcactaggaaggtgtgtggtgtggtcaaaagtgctatgtgaagtcttgttgtacctggaagaggaagtcctcaggattgaatgcctcccctttctctgactgctgattaatatgcctagcattccattattggaatgctaagcatatgggaattatttctatcctactgctcaaggtcatcgccaagatctgattttcaaaatccaaaaaattgcaaccttcaggcataaatgggctagggggccatgtgatgaggaatatgggcagcttttgtgatcttctcatgccgtataggggctgtcctggatatggcagaccctgattataaatcaataggcatttgagtgaggtaaaaagaaagcagttttattagggttatgtactattgtaggtctccccaagtttatgctgcttcccagagggtccacatttttctgtatgcactagaatatgatgaatgacacacacctgagaagttcacattaatggcattgtgctctctgttactgacaccatcaacatcgaaataaagcatgttcttctcttgtcaagaccactgtaaggagtgagactccgtctcaaaaaaaaaaaaaaaaaaaccactgtaagagcagcctctacaaaatgagctgtcttctttccagtgcactttcttatccagaaggtctgtagaaaaaaataaggagcctctctgattaacaggatacaatagaagtatggagggtagttttccacattatttgtcgcactttttgggtcagtgctggcactttataaatctgcgtttggcccttccttcatccacttggactgattttcagggtacagttagcagggtctacttatgaccactgaagcagaaatgcagattcaatgagtaattattaagaactttccagaatattagctgtttcacttgctgcagtgactagtgatggaatagtccattagacatttctgttcccagcaacttctgagaattgattccaatctgaagcagccaactgctttgatcaatatcataattactcttattgatggattgttttacgatggtagccatcagagcagtccgtcagctcagaaggcaccagaactgtcccctgcaagctgtaatgtacggcaaatatctgattcaaatcaacttactattgaggccaggatgacaagcgtgaaattaattgttccacttcatgtaagacctgcattcttcttttgagagagtaattggttgctgcatgtagcgtgagagctaggggagctttccctctctgaaatgtttatagacttatttttttcccccaccagctatttttttttccctacgcttttaggtgtcagcaatgttgcacagctgctgttcctgccgttgttgtttttttgtaggtcttgtcatgtcagagaggatggttttcttctagaaaggttgattgcagacagagtaattttttttcatctgaaaagcttatttgtgaaagagggagtttgctggccaacattaaagcaagaaaaccttaagagtgtttcaatgagtataaaaaaataaatgggcaaagggcagtgggccccctgttcttccatggttgcaataggctaattcagaaggtgtaatggtcttgctgagcattttctgcattcagttgccttcagaagcttgttgatggagaaataatgagggaaatccaggtaggaagtcaagaaggacaatcgaagaaattagaaaatggggatagtccaatagtccctggttattcagtcctcatcgacaaattgaccattacattggataaaatcaagatcccgatagaacttgagagaagtgttttgaggtatttttataagtaaattcaagttcatagctggtgctggaagataaaagggctgtagaaacagaggagcatcaaagcatagtaaccttcacggcctcaggggctttctgaaaccctggttagatggctatcctagtggagttggggatttctagtacaccagtacttctaggaatggtaatactttttgttttaatatttatttattatggcatttccaagttgggccctgtgagaattgattatggaaaaaaggattctgtggacagtaaattccatatccaaccagtatttattgagtgcctgctgtgtgtaagcactgtttaggtcctgggggtgacccaagtaaatgagagtctgaacccctgaagcttaccttctcatgaaaagcttgagaagacaaacaataactgtatacccaaatctgtaaggcagtgtcagatagtgttagggatggtggatggcagaggatggcaaccttgtctgatgttggagaatgaagttcaagtaagagtaaggaaggtagatttgacttcaacccagctcatgagcctgaagccacctttaccattaaacttagtttgtctttgagatgttctagcagcagagctttcctttacactttggaaggaagagatttgatgctatcagcattcagtgcaggaaaaagatccaacataaaatacatagctgagaatgttggggatagttttaaaggtaagtgattctgtttctgcttggtcatgtaagtgtttgaaagtattgattgaacactttcataacacctgaagggatcagaagtgattaataataaataacctatgatagcaaaactcagagaagtttaaagccccagacagtgctggctagggaggaagattccgtattactcagttgcatgtgattagatacagcacataaccttgttaactcatgtctctgccatactggactgaggtagctaaagtattaacctgatcaccataatttcctatctcccattttctggtttctttgggggaaactttttctccttccatttgatgctggggtcccataagcttcagccacaatgtgggcaggggcccaggcttggcccaccaatgtctcaccttaccctggagatagagttggctaaaaaatgggcttgtgactcaggctaggccagtcagagccttccctgacttccctccaggagctagtgggaaagatgttatttccaccaggttggctaagctgataggatgagagcctggcatggtgacacggacctaactggcttctgggatggctgctgatgaaaggaagtcaagcagagctgagagttttgatcaagagaaaaacaaacacagcaggtgcagctctgatccacaattgtgagttcttaattctttaggtttgcttgtctaaacaagtatacagatttaatagaaaaaaaaaccctcaaaaaaagaaaacttgagatgtgcttccacttaattaagccacactggtgagatttcatttctgctggatggagagccggatagaaatgcttttaccgtgtggtgggattgaaaagaactcttccagaaggatacagctgagccaaaaccaagccgcttgttcctaggactcatgaggctcataccatcatctctggaagcacacttatcatgactggaagatccccttaagtaacttttatgatgacagcattgtaaatatatatcataaatactttctgtgaaggaaacatacaaaattaaacgtccatttagttgaaacagaagcctgccaatgcatttatgtggctgcaaaatagggatttctgagaagagtgacaaaatttgcagctgctgaagcaaagccctgcattctagctgttggcttttgcaatgctcaggaattttcaggcgtgtttatggaccagctgctctgctaagattccttaatgtatgggcaggggaaacttgaataaatatgtttcctcctccttctccttgggaattcagaatctttagccctaacttctaagaattaaaccaaacagtgtttgatgtttatagacgtggagtcagctattagccacttgaaccatttgtcaaatggaacaagatgtgacaaatttttctactttctaaacagaaactgtatttgttgtattgtgcagagatgtcacactttggagcctcttctactgatctcttttttctctgggaactagacccctagaattgactgcctcaaattcttagcttggttttcaaggccccaaggatgtgtctctgtcttaatctattttctgttgctataaacagaatacatgagaccgggcaatttataaagaaaataaatatattttttatagttttggaggctgggaagtccagggtcaaagggctgcatctggcaagggccttcttgctgtgtcataacatggcagaaggcagcatgcggcaagacagagggagcgtgtcagttcaggtctctcttccttttcttataaagccaccagtcatataatgaaggtcccgtcttgatgaccttatctaatcctaattacttctcaaaggttttacctccaaataccagcaacatatgaacttgtaaattacatttccaacacatgagcttcgggggacacatttaaatcataacagtctccttcccctcacgtctcctactattctccgtagtgctcaacaaggctgtggccatgctggtattcttttttttttccttaaacatgccaagccctttcagctcaggagtttgactctcacaatccctctgccttgagtgctctttccccacttctttgcacacctggctcatcactctagtttcagctcagatatcatctccattagaggagcttgccataaccaggcaatctaaagtcttttgcccagtaactctgtatcatgtgactccgtctcatttcctccagttcagcttgtctgaactctgaattcatttcctgtttgttccctctttctcttcactagaatgtaaacatcatgagaatgagggaatagtctgttttattccctgctatatctttgacacctatgtcctggcgcatagtagatgctcagttttatttctattaagaataaatgtctagatagcctactcattcctctgagccatggcaccatttaagtaagttaaacaatttattttagcatctctcttcagcttctctattatacagggcaagtggaatggaatattcacatggatgctttgattcttatttaatccttacaaaacctttaggaaccgagaatactcaagcccgtcttctctccacatctggtgtccagttttattttttggcacccagattccttcttggcgcttgttaccatggggaggaactaaatttgtcattatgtgtttactatcttcttcctctaccagacccttagtcttggtcctaggactgcttttattaattgctgaatgctcccagcctggcagagtgcttggcatgcagtggttgctcaaggtgttggggataatcctgaggcctaaaccccttattctgcctggtctggacatgggattttgcagccacagaatctccctatctgaacaaatatatgcttccccatgggtggaagaacactaaaattcctcattcacatgtgcctttgcagggatagaaggagacataaagtctttcacacccttagcattggcagcttaaattcagaaaggtctctggtcttgtgtgttcagggatacaaagtcacattctacctctcactatccttggtgtgtagaggggaaagttaggattgtgacccaaaatacacagttatactttgaaggacaatatgctagagtgtttgaaatcaggtcagtcctggaaaacatggaatgcgtggtccccatacttcccccactggaattgcacagacccccccatggtgcctgactatgtcccatcctaataagccagtcaaggcaggaggctctttgcagccccacatgtgtctcctgggggctgtgaatgcagttggggataggggttttgggggagggagcaggagttttgattttttgctgctgctctctaaggaattcttccatatttcactttagcacgttcccagaacccacgacaggctgtataattgctggactgacataaatctatagcaaggatgggtagattttgctgatgtgtttgctttggcggcagggcttggtagaccatgtctgcatatcatatcacaaactcaggctgtggtaggacagggcaaggaaagctatttattgtgtctccaaggtcgtgatgtgagatggaagaggcatcataaaagaaacaacattgaggcacagagagttccccgaagtggggaaagtggaaagatgaaagaaaacatttcctcccacgatggacccacaagagggaagctaaaggtcgaaggcaggcatttattcctctgcatcacaaatatctataatttaaacatgctggttaaaactcagactttgggagtttttacccattgtttcaaagttatgtaattaaatatgttcaggctttcaaaagagatacagaaaaatgaaagaccttaccaaattgcttaaagaattttgaattaaaaaaaaaatccattcattcaatctgcagacatttgctgagcatccgtcgtgtgattagcactatgattggagctgggggacacaggggtagtgaaaaggcagatggttcctggccaagcggaacctgtggtctagccaagaagaagccattactcaagtaattatggtttcctccttccagcaaccgcatggcgagccacctcccagtgctgggagtggagacgatgtttcttttttcatttcctttttgtttttatgtttggtataccttttacaagtttgctttaaatttttactaattatttaagtaaatcaggaatctgcttgcttataattagaacattacagatcaggattcggctcttgttgattcccctccaccccaggtagtcactatgatggatttatactatgactttgcagagaaattttgttatacttccacatgtgtgtggtgtgtgtgtatatactcatagacagcttctaccactgttctaatacaaatgaagcacatgctatgcatctattattgtgcaacttgcttattttgttgcataataccttttttattagtttttgttgatacctattaaggtagttggttaacttttaattactgaaagttgtgcttattcatagtcctatttggaagcttgtatggtggctactgtgtagagacttggaatagtaaaaattaatagtcagaaatagtatacatgtattaagtgcttaatgtttgccagacagtgttctaagtctctcacatggattgtatcatttaattatgagagcatctcagtggagtaaaggctatttttactatgattttacagaagagggaatctgaggcatgaaaagataaagtaacttgcccagggtcacacagtgaggaagtgatgccaagatttgaagtgaggtggtgcattgccagagcccaagatctgttggttctcttaactcctatgatttctgggattttagttgttaaattcaatctatgaagcagtgtgtgacagatgtgtgattcactgaggggccaactgggctggtttgtgggtttctcagtttattgatacagcaaacacatgttgtgcacctttggtgtggtggattctgcgctagaccccggcaacacagcaataagatggaacacacagccttgcctaatgaaactcacagtgagagatgataatgctgaataccatctacataaggtacgcatgatgtctgtacctggcagggctggaatctcatcccctctggctttatatggtctttggcctgtgttttctttcatttttttcttgcactttagatgacatttgttaaacttcattattaatagggatccattagcatggttggaggaaaatatgccatcttgtagtgacaatgttgccttctatgttacatccatacaggcagaaggaagagacccagcagcatgtcttgaatgccagtgttttatccccacttgctgcccagccacaatatggcaaatttgctattcatccagcccaatcataattaacataatcggctctggtgcccacccagatgtggtgggtggtgtcctcggctgattacaaagattgcagcccagcattttgggaaactgctcttacttcctgtccttgtatcacttctgtgggctgatttttctgctcttgtgttgaaaaacgaagtcatggaaaggttctcttatattgaatgtgtcttgtgtaatgatgaaagttaaccacagtgtctgtgatttttttctttgaaaatcaggagactggttaaggacagaaggaagtgtaagtctctcagctttgaactctaagctgcattcgttttcctgaaggctcagatcaagggagcatgctcatcttttcttcttatttggacctagaataatcttccagcttagcactggaagaggtttaatgtctcactcgtttctttttctttaagttttttcttggctattaacagtaaaatagaaacggagacatagaggatgttggccagactttttatccagtatttaggtttgtaataggctcagtgcagctggtggctttatattagctgctgtgaaaggtatgtggttcttatttatgtattatttattttggaaacacttaggtaaattacatgacagccttttactttttagtcagttgatccaaacactaccaagttttctttcattgccacaaaaaccgcattttaagagatgcatttggttttctgttcttgtgatactttgctgagaatgatggtttccagcttcatccatgtccctgcaaacaacatgaactcattcttttttatggctgcatagtattccatggtgtatatgtgccacattttctttatccagtctatcattgatggacatttggattggttccaaatctttgctattgtgaacagtgctgcaataaacatacttgtgcatgtgtctttatagtagaatgatttataatcctttgggtatatacccagcaatgggattgctgggtcaaatggtatttctggttctagatccttgaggaatcaccacactgtcttccacaatggttgaactaatttacactcccaccaacagtgttaaagccttcctgtttctccacatcctctccagcatctgttgtttcctgactttttaatgattactattctaacacaggaacagaaaaccaaacaccacatgttctcactcataagtgggagttgaacaatgagaacacatggacacagggaggggaacatcacatacctgggcctgttggggttgggggataggggagggagagcactagggaaatacctaatgtagatgacgggttgatgggtgcagcaaaccaccttggcatgtgtatacctatgtaacaaacctgcacattctgcacatgtatcccagaacttaaagtatgtgtgtgtgtgtgtgtgtgtgtgtgtatagtgtgtatatatatagtgtgtgtatatatatatagtgtgtatatatatagtgtgtatatatatatagtgtgtatatatatagtgtgtatatatatagtgtatatatatagtgtgtgtatatatatatagtgtgggtatatatagtgtgtttatatacgcacacacacagatgcattgttcttttaaataatgcttttacattttggtatgcatatgaaggcaaaaaaaaaaaggaaacaaagtatatctttttctctccagttagaacccactacttgaaggattttaaatttcagacagacttaaagccttttgaggttcaagtttagtgtgctgtaagcaaaacaggcagtttcctagttcaaagaggaaggaaaattttaagacttataaagtgctcaaaagccttcttaggtatcaaatagctttcagaggaagcatttgatggatgaaggacacaaggattagaaaaatatgggccaattttttctttatataatcacatttaaaagcagtggaaaaagttcttaggtctagggacttaaatcagtgacttggaagtttttggttgttgccaaacccagaaaatgcctggtttggcctgagctttgtagaagtgagaagtcctttagccatctccactgtgcatgaaactaacatgagggatgttggaacatgagatcttagtaatgcttcttagaattggagttgggtaatgtgctacctgctgtccataataaatttacaaatatttttctagttattatctcagacaactgaaatggaaaataaggttaagagaaatatgatgcggcatcaaggaatcatttaagaactctgattttctgaattcatgtgttttaggttttggagtttcatgttgcctgaagtgtactctgccctgtggaaagagaaaggtgttgggttatggttgtggagaacacagggccctcttgttgcatgggtatcttaggaacgcaagccctgacctggtttgcattagggtctccatgttcacaccaaagtctgtcatgtattcatatttgctgatgagtgagcgggtgactagatgaatgaatgatttcagtagcagcctagtccatgcagaaggacagaattcaaggccagagggagtgacctcagcaggtgatgtatgccctttcttactttagattccaatttgggtgtcagcatctgctaggtctctgccagctcttggttactagagactggcttactccaccatcactcaggtggcccttggcactcatgtggcagcagcttgggcacatatcagtggtttacaggagcaggcaaagcaggccctcttagggagagcatggaggggacagtggctttttttttgcaacacttctctgtcttttgttgactttaccttggtgtgccttgagcatggagcttggcagtttgtatacattttaatgtgaaatggggggaggctgtaactagtataaccaggatgttattttagtcactggggcttaaggatgaggcagtgagaaaaaaatacgagttttattaaaaagcaaatattaaagttgatgtttagacatttccaagtgtgacagtgggactcaaataatagaagtttgagaaacaatagttttgtgtactcatttgtactcagtgtgtttctaccttttacaattgacagattgtgtcttgcagtgtgatatttgaggtatggaaaacatactcagcctccttaagtaaccctttataaatgctctttagtgaaagtgacttgctgaagttgcaaaggaggctatgacaaaccagaacctcctgttctgggctactcgttacaatttaaatacatgggtttagagagttaataagttttccattggaggtgcaggctagattctctcttccagtcactgagatgggtggtcatcaagtttcagaaacatggttactgtgtagtagatacccagtacttcatctttttaagagtgaaaagtatcctttctgaaccagacagaagttagtcactgtttttcagaacctcagagttggatgtaagtctaaattcatttgatgcttttcatactgcaggctgatgttaaggtaaaagaacacccaatccctggctgttttaagcttttcttgtgctatatatgactgaaaacttagaagatgtttcctaagtgaaatatagaagatgaggtacctgtgatgttttggtggctgtgggacaggatattctaagtgatttttccagagcccactgctgagttattttttccatcctaaacccttatgatttttcagggatttgcaattcatccatataatgattttggggcttaagctaatggcactaaaacatttcagcctggaagcatgtgatgttttgggggtgtttttttgtaatgtttaaaatatgaatccctttggttgctctgagttagaattgatgaaaaaataaagaagggaaagcaaagaagttaatggtctgaaacctatggttggtatgtggttcatattcagaatcagaacagtgtgctggttttggcaattgggaatattaatattctgagctgtggcatggaaatttgaaaaagaggtttaaagaagcagctcatatgacaaatttttaatgggaaagaagctactgctcacgtgaaagaactgcttgtctgttctgggtcatacagccttcatgtgatggccattcaggggtcgttcgagctctgctgataccatgtccagtggctgccattgctgtgctgttaccacccgctggccactgcactgaggtgtggacccaatctcattgtgcctcactaaggctctgtgaattaggggcaattatttgtcaccattttattttttatttattgagatggagtttcactcttgtcgcccaggctggagtgcagtggcgcaatgttggctcactgcaacctctgcctcctgggttcaagcgattctcctgcctcagcctcctgtctagctgggattataggtgcccaccaccacgcctggctaatttctatatttttagtagagatggggtttcatcatattggccagggtggtcttgaactcctgacctcaggtgttctacccgcttggcctcccaaagtgttgggattacaggtgtaagccaccgtgcccagctgtcactattttagagatgagaaaactgaggcctgcagaaggaaaaggacttgttcagggtcacccagctagtaagtggcagagccgggacttgaactcagccctccccttgtcttctaatgattatgtcataggaaataggaagcagagcacttgggaacagtcaccttgaaggcagactaagtttggttctgaaacttagtggcatgagaatcttctggaagtatgtggcttcagaagggaaagcagtggatggagaagcccatggaatgggttttggtttctctccttgttatttttgggccaggaggacctgatgtggagagaagagttcctgtggcttggtttggttctttgcttttgggatccattgagcccctgctctgctcagcaaggaaaacagcagtgattggagcagccaaaccacagtttggggcctggatgtgagtgatcggtacaggtacaggtgaaagaggccccacctggatttgaattccactggtagcgccttttctatttcagggctgccatcccatcttggaattctgtggatgtccgaggggaggaaatattgctggatctagtgtgtgggcccctcttttatgatttagcatttctctatctcttgcagccttttcctaatttcttttgttctggtgtgagtttcctctttctcccatccctttgttgcattcctgtcttcctgtgttttaatgaagaataagataaagaaaagagcacttactgtgtactgcatactaggagctggggatgcaaagctaaacattgtggaccccacctttgggactgcacattctgaaggtgagggagatgtgcccacacatgattggtgtgctgtgatggcaagagtaccaaccaccatcactgtgtaaagcatgtaaagaaaatcctgcaaggagtggaggatcctgggcacctaggctggggatgcagacagtggccagggaagatgtggggaaggaggtgctgtctggaccaggtgtccagagatgaatgggagttatcttggcaaaaaggaggtggatgagtttttaaaagcagcttcatggaacagtgttagggatagaaatcacttgttttttgttgtttgtttgtttcatgaatttgattgatcaaagacacttaaaaatacagaaaatacttagaggaaagtgtctgacacttgagaaaagaccttaatacatggtctctgttgtgttgtcattatttagtagtaatcataataatatttagcagattttggccctgggcaacagaaaaataaaagcattccttggcttgttgtaccagaagctgaagcagctagtctgggtttgagcatggaaaaagccatacatgaacaccatctcattcagatcttgtgatgcttaggcgtgaaagcgttttttaaattcttctcgtgttcagcattctcctcaattgttaaattgttaaagcagcctttagcaaacttatctaggtgctgaatttgtaaatataaaagagaaagagtttcttttctctattttaacagacaacactgtttcataatttcattttggagatgatttagctttggctattgttttaatctcacaagccttgccttatataaatatagaacagaaatactgtatagcgagtgttgcaggaattaatcgacctgctttacgcatttgcttgacactgctcttgaatataccccacgagttggcttccaccattgccaccattcaacaagatgttgacggtcttcattcttgaaccatggctttgtcaaccatccgtaggagacccatttcagctgctgatggtatttctactcctgcataacaatttaggagaaatcaagtggcttaaaacgactcccatttattatcttacagttccataggttggaagcctgggtgggctctgctgagttctatgatcatcattagcacaaggctgaaatcaaggtgtcacctaggttagctcttatctggaggctctgggaagaatactcttccatgttcgttcaagttgttggctgatctcagttccttgcagctataggactgaggtttctatttctttgttggctttcagtccagggcatcttgcagctccttcaggctgccctcattccttttgacacagcctgcatccatcttcaaaacagtgcactgagtccctctcaagcttcagctttctctgatttccctttttgtcacccgttggaggaagctctctgcttttaagagatttgttttatgtattatttttatataaaatcaggaacagtaagtttccaagagatgttggaaggaggcaggagggctgcatctcatttgcatttttagaaggaattatttctaagtgacagctggtggtaacagaatgacagtgaactggaattgagagatgagggttcaagccctgattttgggaccatgtgtctagagagcagtgggcacgtttcctgggccttgatttcaccacctataaaatgagacagctgggctcttggggtcatactgtttttcttttcttttctttattattttttctcttattcacgtgctctcactctgccttccgctcacagaccttgctaatcaaccatcctctgttccctgctgagcctggatgcagtcctagaatccttttgacatggccctccaggaagtcaccaccaacccactggagttggcacaggagatgaaacctgtgtgtcatcccaacacttgaaggtcccatttcatcctaaatgctatgattctctgaaatgataaattatcatcttctttggccaaaaagacatctatagaagagccagttggccttttctttacttgtcatacagacatctggggagtgggttcagttttcaagccacaaattgaggtgtgcagaaaaagtcacttttttttcttctaattgaacttaatttctcatttgagcccttgttctaccaagttactgaagtgaaatccatggatttgtggtgctctctctggctctccctggagttgtatgcagttccaaggacctacatagagccaaggcatggtggtggagggcctctggtgccctgctgtcacctgtcagtgatggtgtttatggagacatccttgctcccaatcacctttgattttgtctcggagaaactgggccatgctaagtaacaaattcactccaaaagctctgtggaaaatataaaagttactttgttgcttaggcaaagtccccagtggcttgggcaattcttcagggagtcgtttatctagatagtgatcagggagcgagctgttttcatcttgtttcagtataaagcttctagacacccagacagggaagagaggactggaagtttcttgagtgtctcttaagtgctgggtctggatgggacacataccttcccatatccatgggctacagctggacatggccccgccaccccccatccacaaggaagctggtgtgtcgggagtgacacgtgttaggtgggcattaccagtcactgccaccgttgttgattgattttgagtcacttctttgttttcttgtacattttgcctcacctacctcaaggctagagcagttttgccagctctgtgtgcttcaccccagctgcttgcagccagtgagagaagctttccattcttcctggaccttctgggcttggggaagctgtggggccatctatggctccttaggccacctgttccacatgcatgtctttagcatcaaatgtgctggttgtgggaggaccatgggaccttactggcttcctacactgcttggagaacagaaggtgcaagtgatccctgttttcaggttcattaaacctattgtggggttcttctgttcccctcccagggatgagtgatgaggactcagggctccttcccacagatgcttgtcccagacacagctgggtctggctgcttggcttcccccgagaactctccctgagccctctgcttatgacattgcttcacttttgtgacatcgcttaatttttgtgatgttgcttcacttttgtcatattttattcatcagaaagaaggcaccaggtctaacccacactcctgaaaaggggattgcacagaggcacaaagacctctggtgtttccagtccgggtagactggctgtcaccactggggcactggtgggtacctgtgagctgatgagtgggaccaaacggctctggccaccttggaccccattcctcccaggctttgtctctccctgagccctgcgcttgagaacattaaaagccatgccttggacccccttgttctgagtcctgccatgggccgtgaggacagccggccactcttcctggtgagcagattgtcactcggctccagctgcacgtccagctcttccgctgttttgctcacggtaaatgcgtcactggagaagggaaggtggatttttgcagttccacgtgcctggcacaaggatatcatttggtaaggaaacttgttggagaatgtgtgaaggcccagggtttgttctttcctctcttccagctgtgcttactggctggagagaagggtttggattcgtctcgttactcttggctgctgggcccttcttcctttgtcggctgttcagaagtgggaaaatatatatttttttctccctctccttctttgtctctttgtctgtgtctgtctgtctgtctctctcacgcacacaccctccatcctctgatcccattctagcttccctgctttatttcccactgatttctttaatgccccaatcacatataaactaaaccattttctgttccttgcgttctggctcttgggtggtcctagttaaccagctttcacagggcagcgtttcccctttggtgtgattcacattaaaggtgagacttagacgctgtctgaagtgcaggcaatttactctggcagcaatctcacaacacggacagcaggagcaggctggtggccaaacacaaggtccagatgaccacccgactgggaagggtctccatctggcgaccgttctcggagtttgagggattcttcctcctttcttacacctgtactcagtccaggtcagttcccaggtgtttctttcataatggagctttaagctattctggtaagggtgagctttgttttaaggtttgtgaaagttgtgtctgtgctagatggccttatctctagggcaactaggattttgggatccagttgacatagagacccagtaatccctgggccagggctggaaatcccaggccaggttgcatcatactgctaagtgtgtaggtcctgtgagatgtttgagtgggcgtatggctgtcattaatcttatagccatggtatctcatagtatactacagtgtgtctttgtttgtgttagtctactggaaatgaccttctcttatgactctaacatttaccccattccttaaaaaaatctgctgtaaagcaatatttacaaacagaaacctggaaaatatacaaatatatatctctacatttgtagaatgatttctatgcatatatatatatataagaaatacggaaatgtataaagtagaaagcaaaaccccataactttatcacctggctgtaatcattctgattcattcttatagattatttttcttctttctttctttttcttttctttcttgcaactccctgatatgatgagagatccttgaggcccacttcaagtgcaagtctcctcagacacctttttatatcattattcctagccaaaagagatggtgtctttctcagtacccctagaatgttagtgctcctgctcgtcactgtgtgttcggggtcattgtattagttatctattgtattgcaaattacccccaaaattatctattgttgtattgcaaaaattactattgcaaaatagtggcttaaaacagcagccatttactattacacagtttctctgggtcaggagtctgtatccagctttactaggttctctgtccaggatctctgacaggctgcactcaaggtgtcagcggactgcagtctcacctgaaggctcggctaggggggaactgcatccaggctcacgcatggtctgagggcttccaggccttgctggctccctcagacctttgccacgtgggcctctctgttgagcagctcactgcatggcagctggcttccagcagagtgaccaggggagacagcaagagagcctttttgtaatctgatcttggaggtgacattgcttcacttctgtcatattttattcattaggaagaagtcaccaggtctaacccacactcatgggaagagggttgcacaaaggcataaagaccaggaggcagggaccactggggtccatccaagaagttgcctgccgcagacaatcctgcttatgagcctgtgctggactgcatgccgtcttgggcagagccctgccttatctttatatgtctaatgagatcgtgtatcttgtgcctgatgggcactcagaaacccactttgctgttccctctttcgtctctcatagcaggcgccctcttcttggcagcctctgccccggcccacctctgtgcctttgctggataagtcgtctcatgccttcaggtctcagggtgtgcacccctcccctaggcagggagtagttcttgacctcttttatgccatcaaccactttgacagtctgaaacttagattttttcttagaaaaaaaattcaagttcaaaaacaatatgaaaggcatagaattataaggaaactcaattataatgaaatacagctatcaaaatataaaaaacccagatttgtgatataataatatatgtgcttatttagtaacaccttaaatagcaagatgtgcagcagtcttaatttcaaaatagtgatgagaatgaatgctgttttgagatactgacagacactaaaaggtgataggaaagtatctgatttctttttttttgagacaaagtctcactctgtcacccaggctggagtgcagtggcatgatctcagctcactgcaacctccgccttctgggttcaagcagttctcgtgcctcagcctcccaagtagctgggattacaggtgcctgccaccacgcctggctaatttttatgtttttagtagagatgaggtttcatcatattggccaggctggtcttgaactcctgacctcaggtgatctgccgtgatctgcctgccttggcctcccaaagtgctgggactacaggtgtgagccactgcacctggccggaaagtatctgatttctactggggataaagttgcaggttcttttaatactaattttatttgtttactttaagaactcaaaattcaaggaaataactacaattcagtgcaaggttattaaaaatcagggttggattctttctctgacatcctgaagccccgattgaatgcccctccctgcagggatgggttggctgcccactgcacccctgagccctctactcttcccaaatgaatgtgccctgcgccctctcccactgcccccttgttgaggagtgaacagtcagcagggttcacactggaaagatgaagatgggatgagagagaaggaagagcagtttgataagaaaacgaagaaagaggccagacgcagtggctcacgcctgtactcccagcatttgggaagctgaggcgggcagatcacttgaaaccaggagttcaagaccagcctggccaccacggcgaaaccctgtctctactaaaaaaaaccacaaaaattagccaggcgtggtggcatacgcctgtaatctcagctacttgggaggctgaggcaggagaattgcttgaacttgcgaggtggaggttgcagtgagccaagatcacgtggctgcactccagcctggtcaacagggcaagactctgtctcaaaaaaaaaaaaaaaaaagaagaagaagaaagagagagccattagagagagtccatgctgattgtacaagagaagtttggtattttgaggcagggaaaagaggaattagggaggggatgagaggcagaaacagagtggcagggctggtatgggagagaggatggtaaagaagtttttttctgtgcatttcttccaggttaaggtaaaggtccaaattgtttattttctggctacccaactgttgcgtctaaacccatctctaggctagagctacaccctgaggcagctttccttgattgggttgcccactgatgaccaatgacggatgactgatgactgtacactgtggttgtttatgtagatgagggttgatgagctatggcccaccgcaggcatgccgcttcttgttgtacatctccagttttcaaattcagggcctgtcctttttcagatgctgtattactgggccctggtccatggcatggaggtggcacataatgacacagacccagtgtaccatcctgtccttcaggcctgggccagggaggcccccacacgctgccctgcaggactgggttgctgccattcacatgaacgtctgccctttcctccctttttaaaatcccgccagtgcctatgtcctgaatgatattgcctaggttttcttctagggtttttatggttttaggtcttatgtttaagtctttaatccatattaagttaatttttgtatacgatgtcacgaaggggtccagtttcaatcttctgcatatggctagccagttttcccaacaccatttattaaatagggaatcctttcccgattgcttgtttttgtcaggtttataaacgattagatggttgtagatgtgtggcattatttctgaggcctccgttctgttccattggtctatatatctgttttggtaccagtaccatgctgttttggttactgtagccttgtagtatagtttgaaggcaggaagtgtgatacctccagctttgttctttttgcttaggattgccttggctctacgggcttttttttgattccatatgaaatttaaagtagtttttttctaattctgtgaagaaagtcagtggtagcttgatggggatagcattgaatctataaattactttgagcagtgtggctattttcatgatattgattcttctgtacatgagcatggaatgtttttccatttgtttgtgtcccttcttgtttccttgagcagtggtttgtaattctccttgaagaggtccttcacatcccttgtaagttgtattcctaggtgttttattctctttgtagcaattgtgaatgggagttccctcatgatttggctctctattattggtgtataggaatgcttaaaacaccaaaagcaatggcaacaaaagccaaaatggacaaatgggatctaattaaactaaagaagcttttgcacagcaaaagaaactgtcattagagtgaaaaggcaacatacagaatgggagaaaaattttgcattctatccatctgacaaagggctaatatctagaatctacaaggaagttaaacaaatttactagaaaaaaacaaccccatcaaaaagtgggcaaaggatatgaatagacatttctcaaaagaagacatttatgcagccaacaaacatatgaaaaaaagctcatcatcactggtcattagagaaatgcaaatcaaaacccagtgtgataccatctcatgccagttagaatggtgatcattaaaaagtgaggaaacaacagatgctggagaggatgtggagaaataggaatgcttttacactgttggtgggagtgtaaattagttcacctgtggaagtcagtgtggtgattcctcaaggatctagaaccagaaataccatttgacccagtaatcccattactgggtgtatacccaaaggattataaatcattctactgtaaagatgtgcacacgtatgtttattgcagcactattcacaatagcaaagacttggaaccaacccaaatgttcgtcagtaatagactggataaagaaaatgtggcacatatataccatggaatactatgcagccataaaaaagaatgagttcatgtcctttgcagggacatggatgaaactggaaaccatcattctcagcaaactaacacaggaacagaaaaccaaacaccgcatgttctcactcataagtgggagttgaacaatgagaacacctggacacggggaggggaacatcacacaccagggcctgtcgggggatggggggcaaggggagggatagcattaggagaaatacctaatgtagatgacgggttgatgggtgcagtgaaccaccatgtcacgtgtatacctatgtaacaaacctgcatgttctgcacatgtatcccaaaacatgtaccacacacacaaaaacaccagtattgacagcccagctacagagcagacaagaatcaaattagcattctttaatgtacacggatcctgcgacgatacctaattcactgctataaatggacttgtttcctcattccccaaagctttactgtgcctttgtgaggctccaacgatggagagattggctgtgtctctttgatgactcatttaattcccagtttcatgagtggaatgcacaagtccaagcaggggtgaggtgcagattctgactaacgaatggaaataattgaaacattacgagtgatttcagtgacacctttctaccactcatggctgcaggcgggtgggcagcagtgaccttcactgtgtgtgtgggagtgaggaccaaacgggatggccctactagtatgtatgcccaaggagagctgagtaatttccccagggactgaggatttattaaatattggaatcctgacaagctccctctctgtgtctctggtactacgctcttcccagagatgaccttggctacactgagactgcacttagcttgcactttgaaaatggagctttcatttaaatgccttgtctccttgtggcgcaggaaggttggattttcaagaactttccatctctgtccccctgtctgttactggagagcagtatgtagtgccagcagccctgttgtacctacaggcatgagtgtctgagtagagctctggcttagtcctaataattgaaaccatttcgagttctagcatcttgtgcacagagctgtctctgttctcaaaacgagaatggagggccttgtcttgagggtttgggctttgagtagctgcctcaactccatgtggttggtagactgtgatcagcataggacctgaggtgttggttttgttgttggttttggtctagcctgcagcatcatttttacacgaagcaaaggttccctaaactgaattttataccctgtgttttcagtggtaggggccagcctaggctagttccacctgtagagaattccaacagtgatttctttgatacaactaagcataagtgaaaccaacaaagatgacttgtttgtttgtttgtttgtttatttatttatttatttatttatttatttgagacggagtcttgttctgttgcccaggctggagtgcagtggtgcgatctctgctcactacaagctctgcctcctgggttcacgccattctcctgcctcagcctcctgagtagctggaactacaggtgctcgccaccacgcccagctaattttttgcatttttagtagagacggggtttcaccatgttagcgaggatggtctcgatctcctgacctcatgatccgccctcctcggcctcccaaagtgctgggattacaggcgtgagccaccgcgcctggcctgttcgttcatttaatacatatttattaagcacctatgagtcttggacccaagctctttgctggtggggagtaggcagaaacccaaagaagttcctgtattcattaaagttctaatgtagtgtaggggggacagaaatgtgagggcctgaacactgtactaaaagagggagagtaaaggagtgtagtcagggcaggcctcagggaggaggtgacatgaaagcctagacttgattccccgccacagtttggagcatgcctgccacgcagcctcatacagtttccccctcaagtttagcaataacaacccttcccgactctgttctctcttgtgccctttgatctcttgcctttgagcctttgctttgctgttccctctgcatcattcattccctctcgccatcacctttcttagctaacgattcctcctcctttttgggtctcagcttaggcatcccttcctctgggaaatgcctttaatgctcaagtctaggatggagcccactcctggaaactgcccacacactccatacttcccttgctatggtgttgagcatactactttcttgcttttttcctttatgaggctgtgaactcccagagaatgaggactgtggctatactgtttattcctctgtcttcagcatccaccctagaggctggcacactggtttgtgtttattgaatggcatcatgtgcaaatgagtgctggctgaggccctggctcctaaacaacctggagtggagaggaggaggacagcaccatggggaagtgtgggaagccgacagtgtccacaggtgattcactcatctccattaggcataaggcgatgttgagcaaaacagtatcaggaacagggcccctgccctcccttgccacttggaagccatgatttatggcacaggaaggcatcactatatttttatgtagattcttgcacattttgtgactcagtatcttttccactgtgtatccagattgccgaaaaacacaaggctacctgcctgtgtcagaccacgtgggagctaggtatagaggcctggtgaaccctcccggtggcagagtggatcatgagggggaggaagtgctgggctctgaggggtgcaggcagaccccagagcgcactcaaacatggcagctctgtaatgaggtgatccttcattccttaaactgctgagcgagagctgtgcgaacagatgtgtgcccaccatggtcacgtggaacacctcagagagccacagaaaggccagttggtgcggttatgttttattgatgtcttcctgcctctgcacattcttgctgggaataaataaattatattttattgtatagaattaaagctgaaaatgatacagcttaagctctgtattcatgcagaatattaggaggtgagctggatctgaatcagtggcatttcctggcagttaagaatggatgttcagtctccgtgggtttgatgtgaccagttgacaggaagttctactgcattgtactgacaggagttaacactgctcagcagatagcacagagtggaggcttccttatgtgtgttaaagcaaagtgttcattgctccctctctcccgacatttataaaattaaaaagatagtttattgcttaagtggtctcagcaaatcaaagcatgactaaccacagcagtgatgacaacaaagtgtatactgacatagaaggctcttcatcacataatttgtaaaaggcacttcttcataaaatggaaaacatatgacagaattccagtttgttaaaatgcatgttgaacgctgagaaaaaaaatattaagctagggggttttgcagggtaggtgggaatggagagttggtggaattgtcactgaattttctatgtcaaatatctgtaatgtttttcaatgaatatttattagttttttaataaattaacataggtatagagatgctttggaattgaataaatacaagctcatgatgccactttataagactaagttgacatgctaagaggcccttggatagtagccattagccagcaacaaaccatcaggtgtgaggaaagatgcgtcaaggtagagacaccagagtactatgtggatcattctggtgctccagcaccctcatgaggggtcaatgtacttgtggagttgaggaatggaaacttagaagtcttcatgttactatcacgtagacttctagacatctagtctgatctaggaaaagaagtgactgtattcagtgatgttactgtccttgtgattcttaagtcaccaggctatgtgctgggctctgggtatgcaatgagcttcatgaatttacagtgtagtgagaagacattaaagcagatacatatataagtgtattacaagttgtgataagtattatgagaaagagcacaggtttcaatgtgagagaataaaagacatcactttctgtaggaattagccctctaagaagaacatacacttttagttttcgctttgtttttttttttgtcatcaaatacagtcattattagttgaatcacaaaccctatcatagtagttagcattgtttgtgcttgtagataataaaagtctgttatcaaataggaagaaatacatgagaaataggtctttattcttgagggtacatttcccttttgatgaagcagtttcgtactttacatgatcctaaaaggatttttactttaaaaacaaagaaggagagattgatttgagttttgagccagcaggactttgaaatgtgattataattataggatacaaattgcagaattttagtgagaagtaatgttgtccaaagagaattgatagggaaggtggtgtcagtgaagcagaaaagatgccagtcctgttttcccaagttctactttctgatcctggcagggacagcagtggtggactgccctggggtaaaatccctgccctctgtagggtcagaattctttttctaaatgggaagagatagactttaagggtcctccctccatggatatctcctgatgctgtgaaatgtttttggtcgcagaatataatgtgaagttgcatatctgcactcttttagcagagtattaaacatgagaacaagatatttaatgggcaaatgttttgagcttagatacctaacagagcagataaaattcttcaggaagtattaataacaagaggaagaaattgctttagaggcttactctgtgtttctggctttcattgtagtgtgatattctggggatatgatttaattggtgaggtcagaaagcaagtgcaatgtgtgtgtgtgtaattgcacaagttgggatacatcactggtgaatcacattccctttgtccgctcaaaacctgataacgacagtgttgttcttgaccttctgacaccagaggtgtttctctgtgtagatagaggaagaggctgctgattttttttaaactactcctctgtcccagcactttgggaggccgaggcaggtgaatcacttgaggtcaggagctcgagaccatcctggtcaacatggtgaaaccccgtctctactaaaaatacaaaaattagctgagtgtggagtgcgtggctgtagtcccagctactcaggaggctgaggcacgggaattgcttgaacacaggagaaggaggttgcattgagccgagattgcaccgctgcactccagcctgggcgacacagtgagactccatctcaaaaaacaaaaaacaaaaacaaaacaaaactactactctgatatatgtacttacatattaaaacctttttcccttttaaatggttaaaatatttaagctaatgctaaatgacgagttaatgggtgcagcacaccaacatggcacatgtatacatatgtaacaaacctgcaaattgtgcacatgcaccctaaaacttaaagtataataataataaaaaataaaattaaattaaaaaaattaaaaaaattaaataaaatggtacaattaagttttgtactgatgttaatcttatagttttataggttagttttaattttatatttgtaatatattatatattttagctttgtatttgttatattgacaaatataccacaataacatataatgttaactttaggagaagttgggtgaagggtatatgggaactctattccctttacagcttttctgtaaatctagaattatttcaaattcaatctactaaaggaaaaatcgtattaaaatgtcttaattttaaggatgacatctaatatactctgaacagtaaacatctctgtcttgatgaacagtgtgagaataaagtgtaaaaaatgaattttggtggaatagagctccttcggtaccagtacttcttaataaaaatagtcgtccaattacctgctgcaataattttcttaaaatcaggatcagagacggatattcattgcagcattgtttacaagaataaaagatgttctaaaataagggattggctaaataaatgacacctcttcagtatcctggaatgctataaagcaataacaatgatgatgtccaatgtatttgacattaatagtgctttcgatatgtggaaaagtatgtcataaaggagtatataaatatatacctacgaagatggccgaataggaacagctctggtctacagctcccagcatgagcgatgcagaagacgggtgatttctgcatttccatctgaggtaccgggttcatcttactagggagtgccagacagtgggtgcaggacagtgggtgcagcgcaccgtgcgcgagccgaagcaggacgaggcattgtctcactcgggaagcgcaaggggtcagggagttccctttcctagtcaaagaaaggggtgacagacggcacctggaaaatcgggtcactcccaccctaatactgtgcttttccaacgggcttaaaaaacggcacaccaggagattatattcctcacctggctcggagggtcctacgcccacgaagtctcgctgatagctagcacagcagtctgagatcaaactgcaaggcggcagcgaggctgggggagggtcgcctgccattccccaggcttgattaggtaaacaaaacagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagcttttaagagagtagtggttctcccagcacacagctggagatctgagaatggacagactgcctcctcaagtgggtccctgacccccgagcagcctaactgggaggcaccccccagtaggggcagacagacacatcacacggccgggaactcctctgagacaaaacttccagaggaagatcaggcagcagcatttgcggttcaccaaaatccgctgttctgcagccagcgctgctgataccctggcaaacagggtctggagtggacctctagcacacttcaacagacctgcagctgagggtcctgtctggtagaaggaaaactaacaaacagaaaggacatccacaccaaaaacccatctgtacgtcaccatcatcaaagaccaaaagtagataaaaccacaaagatggggaaaaaacagagcagaaaaactggaaactctaaaaagcagagtgcctctcctcctccaaaggaatgcagctcctcaccagcaacggaacaaagctggatggagaatgactttgacgagttgagagaagaaggcttcagacgatcaaactactccgagctacaggaggaaattcaaaccaatggcaaagaagttaaaaactttgaaaaaaaattagaggaatgtataactagaataaccaatgcagagaagtccttaaaggagctgatggagctgaaagccaaggctcgagaactacgtgaagaatgcagaagcctcaggagcggatgcgatcaactggaagaaagggtatcagcaatggaagatgaaatgaatgaaatgaagtgagaagggaagtttagagaaaaaagaataaaaagaaacgaacaaagcctccaagaaatatggaactatgtgaaaagaccaaatctacgtctgaatggtgtacctgatagtgatggggagaatggaaccaagttggaaaacactctgcaggatattatccaggagaacttcctcaatctagcaaggcaggccaatattcagattcaggaaatacagagaacgccacaaagatattcctcgagaagagcaactccaagacacataattgtcagattcaccaaagttgaaatgaaggaaaaaatgttaagggcagccagagagaaaggtcaggttacccacaaagggaagcgcatcagactaaccggatctctcggcagaaactctacaagccagaagagagtgggggccaatattcaacattcttaaagaaaagaattttcaacccagaatttcatatccagccaaactaagcttcgtaagtgaaggagaaataaaatactttacagacaagcaaatgctgagagattctgtcaccaccaggcctgccctaaaagagctcctgaaagaagcactaaacatggaaaggaacaaccagtaccagccactgcaaaaacatgccaaattgaaaagaccatcaaggctaggaagaaactgcatcaactaaagagcaaaatcaccagctaacatcataaggataggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaagggacggaggaagatataccaagcaaatggaaaacaaaaaaaggcaggggttgcaatcctagtctctgataaaagactttaaaccaacaaagatcaaaagagacaaagaaggccattacctaatggtaaagggatcaattcaacaagaagagctaactatcctaaatatatatgctcccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatgaaactagaactcaggattaagaatctcactaaaaaccgctcaactgcatggaaactgaacaacctgctcctgaatgactactgggtacagaacgaaatgaaggcagaaataaagatgttctttgaaaccaacgagaacaaaggcacaacataccagaatctctgggacgcattcagagcagtgtgtagagggaaatttatagcactaaatgcccacaagagaaagcaggaaagatccaaaattgacaccctaacatcacaaaagaactagaaaagcaagagcaaacacattcaaaagctagcagaaggcaagaaataactaaaatcagagcagaactgaaggaaatagagacccaaaaaacccttcaaaaaattaatgaatccaggagctggttttttgaaaggatcaacaaaattgatagaccgctagcaagactaataaagaagaaaagagagaagaatcaaacagatgcaataaaaaatgataagggggatatcaccaccgattccacagaaatacaaactaccatcagaaaatactacaaacacctctacgcaaataaactagaaaatctagaagaaatggataaattcctcgacacatacaccctcccaagactaaaccaggaagaagttgaatctctgaatagaccaataacaggatctgaaattgtggcaaaatcaatagcttacccaccaaaaagagtccaggaccagatggattcacagccgaattctaccagaagtacaaagaggagctggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaatatcctcaatcaaatactggcaaactgaatccagcagcacatcaaaaagcttatccaccatgatcaagtgggcttcatccctgggatgcaaggctggttcaatatacgcaaatcaataaatgtaatccagcatataaacagaaccaaagacaaaaaccacgtgattatctcaatagatgcagaaaaggcctttgacaaaattcaacaaccttcatgctaaaaactcaagaaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagtcctggccaggagaaggaaataaaggatattcaattaggaaaagaggaagtcaaattgtccctgtttgcagacgacatgattgtatatctagaaagccccatcatctcagcccaaaatctccttcagctgataagcaacttcagcaaagtctcaggatacaaaatcaatgcacaaaaatcacaagcattcttatacaccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaatgaggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctacgccgaaagaacaaagctggaagcatcacgctacctgacttcaaactatacaacaaggctacagtaaccaaaacagcatggtagtggtaccaaaacagagatatagatcaatggaacagaacagagccctcagaaataatgccgcatatctacaaccatctgatctttgacaaacctgagaaaaacaagtaatggggaaaggattccctatttaataaatggtgctgggaaaactggctagccatatgtagaaagctgaaactggatcccttccttacaccttatacaaaaattaattcaagatggattaaagatttacatgttagacctaaaaccataaaaaccctagaagaaaacgtaggcattaccattcaggacataggcatgggcaaggacttcatgtctaaaacaccaaaagcaatggcaacaaaagccgaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacagccccatcagaaagtgggcgaaggatatgaacagacccttctgaaaagaagacatttatgcagccaaaaagcacatgaagaaatgctcatcatcactggccatcagagaaatacaaatcaaaaccacattgagataccatctcacaccggttagaatggcggtcattaaaaagtcaggaaacaacaggtgctggagaggatgtggaaaaataggaacacttttacactgtgtgtgggactgtaaactagttcaaccattgtggaagtcagtgtggcgattcctcagggatctagaactagaaataccatttgacccagccatcccattactgggtatatacccaaaggactataaatcatgctgctgtaaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagcaaactatcgcaaggataaaaaaccaaacaccgcatgttctcactcataggtggcaattgaacaatgagaacacacggacacaggaaggggaacattccacaccggggcctgttgtggggtagcggggggtgagggatagcattaggagatatacctaatgctaaatgacgagttaatgggtgcagcacaccaacatggcacatgtatacatatgtaacaaccctgcacgttgtgcacatgtaccctaaaacttaaagtataataaaataaaataaaaatatgtacctacatacacaggatggatggaaaacatcgtggcaggttgcataccaaaatacaaattgttgcttttaactagcctgtgggttatgagtgatccttatttatattttgcttatgtcagtttcctactttacctatcatgaacatatattacttgtttaataaagaaaataaaaattcgtgtctccaccatcaccacacaaatttaaaaagcagttgcaggaatgattaatatcctttttctcagataggcaattaaaatggcatgtccatatgtaaatattgtctaaattttgtccctttaaagtaacccttaaggctactttttcttgaaatgcatcatctttttacctgttcctttgattttcattcatattggtgaaagcgcaaatcacagttcatagaacctcttgtcatttttgctgttgatgtttggtggtaactgaattatctgagcctgtaatcttttttttaaaaaaggtaagtgttaattactatggactaggaaaaagtgtgcctctccccagcgaaacagaacagagcctggcgggagcagttggttttctgaaacttttattcataatatatgctatctttttgataagatttagtggtaggcttctgacattgcctagaacccaaactgtgatcgtggagcaggtgatgtctggtggacatagttactctaggaatgggagtgctgaacagattcgaagtgtagtctagggaaggaacatttacattgattcactcattcattcaactattgagtaaatttctgttacgtgctgaacactgtgctaaacattttgaaatgtaacacttacaatccagtaagggagatagcatgcagataattaatggtaagtaattattgaccaaaaaaataaagttgaaaaacaacattagtttgatggaaagcccagaaacaaaccctcacaaatctagtcagttgatttccagcaagtgtgccaagacctttcggtggtagaaagaaaaatcttttcaacaaatggtgtggggacaactgcatagccacaggcaaaagaatgaagttggacccctacctcataccatacacaaaaatgagtcaaaaaacctaaatgttagaccaaaggcccaaatttaagagctaaaactgtaaagctcttagaagaaaacatagatgtcaaatttcatgaccttggatttggcaatgaattcttagataatgacagcaaaagtatgaggaatgaaataaaaaataaatacattggacttcatagaaattaatttttttgtgctttcaagaacactatcaagaaagtgaaaggtaacctagagaaagggagaaaatatttagaaattatatctgataaaagacttgtttctagaatataccaaaaacccttacagctcaataataaaaagacaacacaatttaaaaatgaacaaaggttctgaataaacatatatcttcaaagaagatacacaaatggccaataagtacatgaaaaaaaatcctgaaataatttgcctcagtgagatataaattaaagccacagtcagataacaacacttcacatccactaggatgactataaccaaaaagtcagatactaagtgttggcaaggatgtggaggaatcagaaccctcatatgttgttggtgtgaatgtaaaatggtatagctgctgtgggaaacagttcagtagttctacaaaaagttaaatatagagttaccatctgacccagcaatttcattcctaggtatacactgcaaaagaacagaaagaagagactgaaatagagactggcacaacaatgttcttagcaggattatccacaatagccaaaggtggaaacagcccgaatgtgcatcaacagatgagtgaattaataaaatgtgatatatgcatacaatggaattttcaaccataaaaaggaatgaatttttcatacatgctacaacatggataagccttgaaaacataatgcaaagtgaaataaatcagacacaaaaggacaaacattgtgtgattctacttatacgaagtacctggaataggcgaattcctagagacagaaagtagaatagaggttaccaggaactgagtggaggggagaatggggtattatttttttattttcttttttatttcagtaggtttttggggaacaggtggtgtttggttacatgaataagttctttagtggtaatttctgagaatttggtgcacccatcacctgagcagtatacacggtacccgatgtgtagtcttttatccctcacccaccttacaacctttccccagagtccccatagtccattatatcattcttatgcctttatgtcctcatagcttagctcccatttatgagtgagaacataatgatgtttggttttctattcctgagttacttctcttagaataatgatctccagttccatccaggttactgtgaatgccattacttcattccttttcatgactgagtaatattctattatatatatatatatcaatatatcacatccatgcagtggaatactattcagtaataaaaaggaacaagctagaggcatacacaacacccacagatgaatcgcgaatgcatcatactgagtgaaagaagctagaatcaaagggccacatttatttttatttatatgacattctggaagaggcagatctgttaggacagagaatagatctgtggttgccagaggtttgggttggggagtgattgattgcaaaggggctccttgagggaattttctggagtgatgaaacggttctgcatcttgattgtggtggtggttacacaactctgcatttatcaaaacaaataaaattgcacacccaaaagagtgcatgcctgaaacatttaaatgcatgcttgggggtagtggaaggcccccagaaaggagggggagaaggagaaatttttattttaagaattagatgttttgaaaacttgtttacattacgttaaagctgatcccataatttggaagcagtatgaaatggcagaataaagaagctgggattttgtactttctagcaagggaaaccctgatattcgccagtgctttgggaattgatgagtaagaaagactaagtaacagcctgtcccacagtgatcatctctgccaccctgtgttgtcattttagatactgtctttttaggggcccatttgcacttggtcttgcccaaggatcaaggaaagtatttctgccactttccaaagaagccttgcataacaaatgggtatgcgacaaagtttttcgagggaacaggttcagtttaggccccctggtgacaagaagacgtctgtgctgtcctcatgagctatcctcctgcccaccagccctctgcttgtcctctcctttgagtggttgctcattcttccctttcacttgctgctggagccactgtgggaggaaaaagagtagacaaggaaaaatgccaggagaaaccttgcctttgtgcatgaagctggtggtgtggggagtgtgtggacttgttccccacgctttgcatgaagtctgtgttcaaatctaaaaacaacacacatgtgagtttccaggccttggtcattttatcgattttctgtcaccctaactttctctccctcacatcaccttgacgggcatttccagtgcagggtggtgctagtttagggaaaaaaaataaagagatagagctggagattgcctggactgcagaggaaggcagcagacctgctgtggagtgtggtgatcattggctcttgccactgctggtggccttagtggcttctcttgctttagagaagtcaggggtttgaaatgtagggagagactgtatgtggctttttctcctagtttgagtgaagctacaccagatcattgccttgcttccacttttttttttcatgtttgtctacctattcattctcatccacctattcactcagcaagtcttttgaagaaataaatccattttgtgccagtcaaaggctgtatggatgatgaagaaggagacacagaatgagacacatcttcagtggagacacatagagaagaggtgattagaaaaccctggaggtgtagcgagagctatgccgagaagagttgggggtgccaaaggtgcatggaggtggtgaggtgtgctttttgaggctggggattcaagagggtagacatgacttgtaggagacaggtaggagatgagggagtgtggagtatggagagctttccagataccatgaactgtgtggggcctctgtaaaccaaaggtatctgaaacaggtctcagtgaatttagaaagtttattttgccaaggttaaggacgtgcccatgacacagcctcagaaggtcctgaagacgtgcccaaggtagtcggggcacagcttggttttatacattttagggagacatgagagatccatcaaatatatgtaggatgtaccttggttcagtctggaaagacgggacaactcaaagtgaggaggaggcttccgggtcataggtagatgagagacaaacggttgcattcttttgaatttctgattagcctttcactgaatgcacaatttacaggaatagtcacttatgccttagttagtctagcttagtgaaatagtaaggccgaggaagcaatcagatatccatttgcctcatgtgagcagagggatgactttgagttgtgcctgtcccttgtccacaaagaatttccttgtgataaaattgtgagggatccgtagctttctataaatttttgtagttatcttacttaggaatagaatgggaggcaggtttgcccaatgcagctcgcagcttaacttttccctttggcttagtgattttggggtcctaagatttattttcctttcatacctcccttcccaagttcaaggaatgactgggctttgacaaaagggtagggagcccagggtgcctggagcatgaggggaggttggcagggttcagttggaggacgtcccttgggctgtgtccgcctttgcccagccttggaaggggatgaactttagggtgcacgtcccagtggctttatggagggaggactggacatggcaaggccgggatgacatttggaagacgcctgggcactggggtaagagatggatgtgaattgaacttggcagtcagaatggttagaggtcagtagattccagtgaagtccagtgggagaaccaaccagaccttttccagaggatgtcttttgctttcttcctctcccttctcctccttttctctctcccagccaccctgatgtgttggttatgtaggaaagtacagctggacttgttgctttctcatttctcacccttggcttccatcacatagacccaggtctgttggagaaggaaacttactaacctaagatgaatgagtttggccacaaggagttctgcatttcccaggataacatttgtctttattttaaatcatcaaaacagcatttaagtgagaacagggatccgtgctcgcttttattcactgtgttttccaattgctcacattatcctctaataacgggatgtgtacacgatatgatatagaggccactgggctgcagagtagtcattagctttccctcaaaaataaaaagagaggctgccgtttgaataatgatccctggctgttttctttgtacacgggccatttccttaattaggtttcaagcttcatctctcttgtttttagctaaaaagccaactgagagaaggagacaaattgtgttgtggggaaaaaggagagaaatgtgttccatgcgaagtaaggggcaaatgaataaaacgggagattagtggacaccctgatgttcaagctgagtttggcagagctgggcttgtgtctgggatgaactcagcgtctttggaggtcaggggtacctttctgcatacctcagggaatacctcctccacttcctacctagcgcttttgatccaggtctcagaatttgtctctagggtcacctttcccttcactttaccttgaaatgaccttggcagtgtatcttttaaacatgcactgttaggagtcagacagcctggatttaaatctttcccttctacaagccagctctgtgaccttgggcaaagcctgccattccctgtagccccaggttgtgctttggtaaaatggaactgataatagtagctacttcacagggttgttgtaggactaaactactaaactactttgtttttacgtgaagggcttgggacagttcatgggtcagggtgaatgctcacttaagcctagggctgctgcagctgctgtggctattatccttattattattattagcccctgaaggagagtcctggtggggggtgtaggacagatgcaggattgttacttcataacccaactctcagttaggaaaagcgagtcggcatgcaggggccataaattacagagaacattgacaacctcgtttatattttcccagaatgctatgttttctcacctgtttttaacttctgagctccctgagatcctggagatggttcctgttttgagtttgctgaatatggtggcaagtaactttgaatttggactgagaccttggttcataacctgttccatcttctcaaatcagggtgctttgtgttttaatgttggttcccctctccccgccaccaaaaaaaaaaaaaaaaagagtgaagaaatggtaacaccactaagaagctttcctgacctccctaggcaggaattcttcctcactctctcagtgagtctccccttacccccatttctagctgcctggtgcatgggggctatggagatgaaacccacaatctttccttttaaactcaaattgtggtccatggaccactagcattagtatcacacagaagttgttagaaatgccaaatccccaacaccaccccagatctggatcagaatccaaattttaacaaagcacctcgggagattcatatgcatattaaaacatgccaaactctaggatatctcactcccattgggaagatgaatgagcgtaagccaaagagtatataccagtgtggtagaccaaagtgtcgccccagggaatgtagggacttcttacaggcagtggcccttgatctgggtattgatggatgagtgggagttggctaggaagaggggagagtgagggcaaatagaaagacggacctctacacgaaagaattggaggtacaaagccagtggtggcaaaataatgtgacctgcttttacttttctcaacttggtatttatggcttccaggatcctttctagcactcacacagggcatgtgccgggttacgagaaataattttgaacaatgcagcagtgttttgtttctaaaattcttacatgtgaacttcaggttcataaaaccgacagacgagagttattagtactttgcagtgagtttactcaactttcagattaattccttaggattaagaaggaaggagtaggccgggcgcagtggctcatgcctgtaatcccagcattttgggaggccgaagtgggtggatcacttgagcctagaagttcaagagcaacctgggtaacatggcaaaaccttgtctctataaaaaagtacaacaattagccaggtgcggtggtgcatacctgtagtcccagctatagctactcaggaggctgaggtggggggaattacccaagcctgggaagattgaggctgcagtgagccgtgatcatgccactgcactctggcctagaaggaaagtggaggccaggtggctccagaaggcagtggctcaaacctgctactcaggagattagttgggaggattgcttgaatccaggatgtcgaggctgcagtgagctgattacaccactgcactccagcctgagcaacagagcaagactctgtttcttaaaaaaaaaaaaaaaaaaaaaaaaaaaaagaagaagaaagaggaaagagtatggatgggctttgaaatcttccatttgggtctggatccacagtctgccatttgcaagaagaaatgtgggccagttcgtagcctctgcagtctgtaagttttaatttgtgagatgtaccttttgatacctcactggcttgttgtgagaacttggttggtttgtagtgggagtcatgaaattcatgcgtctttaccttcagatgtgtggttccattattaaaaaaaaaaaaccagtgctttatagcctaactgaaacatagcagaggcagggaggagggtacagggccccacaccacactcctggtccaggactgtgtaccgtggcactgcagctcctcagagagtcccagtcccgctccgctagcctagccactctctcttctgttggcaaggggagtgtttgcgcaagtctgggtgcttcctcagctgaaacattttcaaagttaattttcactttcggtgtttggctgatgttccagtcttttcctttttctctggttaaccttttgtagcccatcacttgtgttttatgaaagatgaatggattaaaggaagcgtaatggtaacaaggaaatggaatagctagaaaagcattcaattaacgagagagcccacggaacacaaaatgaatgcaagaaaagacagataaattcagggctcctttattaactagaattcaccttgaattcagaaaagggaactttttcagtaaaggattagtgacaagatttgaaaagcgtcccccggggaaaaggattaacaaaaggagacattatagaatgaaatagaagtgaattaacacatcgattttctgtaagggttaggagacacaagatttatttggaagataaatatttggtaattgaaacctgtaagcgttttgttgctggtttttacccagtgaatctgtgcctgtgtagtgaaaaccttatggctgatgaacgtgggatggtgtagaccccctaacaatgctgtccgacctccttctctctcagcatttgctgctcggatgtatttttccgcttctttagtaattcaaaggattttctctccgatcaaagaggttagtttaaaagttaaatgagaatatgggaccagaagataaaatcattatttttaaacaggggaagttctttcttttaataaggacttctattagatatttgtttaactttttagcttcctgtgcttcaattgagttccatgaaagcatttttgttgtctacagaggagtgttttgggacttgtcttgttggttgacagcagcagtttacctgatgggggtttcataggatgtgatgccctgtcaccaggtgatggacttgatgtaggaagtgccaccagcagtctctgccacgtggcatattctcccaaatggcccttgccattccagaggatgttgggttgcattgtctgactcattaatttacaaaggattatttattttctaatgctctatagcttcttcgccttcaggatgtgggctgtgctgctgaacggagaggggtagagcttgtaagcccgtgacttaattctaatccggtccattgttcatcttcattcatgccttttctccctgtttccttctgttaatatgggaaattgatatctgattatatatttggcttttgactatgctgctttctgagtataagtatgaccaataatgtcattgtcaccaattctgattttggatgatcaattgggtcagtggggtctttttaaagtaacttaaccatgctgggtgtggtggctaacatctgtaatccaagcactttggaagactgaggtaggaggatcacttgaggccacacgttcaagaccagcctgggcaacaaagcgagactccatttctaccaaaaatttgttttaaaaaattagctgggcatggtggtgtgcacccatagtcccagctactcaggaggttgagaccagatgatcatttgagcccaggagtttgaggttgcagtgagctgttattgtaccactacactctagccttagtggcagagtgagaactgtgtccctttaaaaaaaaaaaaagaaaaaataaaggataagttaagcctgggcgacatagtgagatcttgtctctatcaaaagaacaaataaattagccaggcttggtggtgcagatgtgtagtcccagctactgaggaggctgaggcaggaggcccacttgagcccaggagtttgatgttacagtgagttatgactgagccactgcacttcagcttgggcaacagagcgagatcctgtctcaaaacaaacaaacaacaacaacaacaaacaaacaaacaaaagacagaaaaaaaaaaaagaggccggggatggcggctcacacctgtagtcccagcactttgggaggccaaggcaggcggatcacttgagctgaggagtttgagatggcaatgacctatgatcatgacactgaactccaacctgggtgacaaaatgagaccctgtctcaaaaaaaataagtacaataaattacaattatttacattcagagataggaaaaagaaaaaggaaacatatttaatacacacctatataataattttagtaggaaatcatttaatattatgaaagttgcaattactagttggagtttccaaagaaaatgtagttatcctacctattgaaatagtccatgatttcccgtactggttccacttttccttgttcccagattttatcctaccccatgaaacacagcaggcacatgtgcacacatgggcgcacacacacacataacaaacacttgtcccagatttctctgggagggaggaggaagagagtagatgattcccttgaaactatgttgattttagatttaccgatgtttggaaaagtgacacctatgactcaggcagatacatgtctcccacctgaccattgtttaagataccttatgtagatctgatgtacattatagaatatataattcaagagagggaaaataaagtacttctctgaaattgaactacaaaagcctgtcaaacaattatacaggaaactttaaacagttcttgcctcacgttgttacttttctgattcctgatctagcatctgtaagttagcattggtgtgtaacagcaccaagctgagatgtgctgaaaaccctgagtattgcattcaattttataccaaagctaggtcctttagcgacacattctcctctcactggtaaaatctttcagtcaaggcttcttgccttacaatttctccaccggaataattccagcatctctcaggtacagtaaaatggatgtgtggcctctaggattgttaagtctctgtgtggctgctaaggattgaagatgtggaagtggttggtgtagctcaggggtctgtatttaaaataccctttgtttgtggaggggacttaccatcttaccattcaggtatttggaaggtggtgtttttcaggtgaatgagttacagtagagcttccagggaaaaattcggcaaggtcccaagtataagatggaaagagcgcttggtggatcctcttctaattcttgatctcgagtttggtcttccaggctgtttgctgaaagcatcactgcagctgagcgtgcactctttctccacatactctcacctcctcattgcctgtgaataattttaaacactgaaaatgagactgcctttcccaaagtctgatgaggaaaccatgcccatgtcccagtgagcttcaagatgggttgacatttactgcttatccctgtgacctcaccctctcctgtctgtccactcctccttcatctgtttctctcttcttcctcctccatccggttgtacacggaggcatctgcttggggctttggtcccgggacctgtgatctctcctccctgctctcatctcctctttctgcctcttgccctctgttattgagggtgatcttattcatcttcatgctgcttttactccaggatcctccgagtgtaaggtgtgggcacatgacattttccatgcctgggagtctcttgtctctggtctttccctctcctgtgacctcatcctttccgttgtggtaacagcagatcctcagagaggcctttgctctccatctaacttcatttttgttagactcacaggacttgatgctatttgtcatggtgtataatgacatgtgtgttctgtgcttttatttggttgacatctccccagtagattctaagctctgggtggatggagagcacattgcttttcttctctggagtagtcctaccactcagcatagtatctggcacatagtaggtatttaggaattatttattgagtaagacatcagtggttgacttgattctatagtcttttctgacagtgtcagggcattgttgaaagcgaaaattttcttctaattgtatttaatttcctgatggaaattgttttgttggtttgtttactaagaagaaattaattcagcagagtttcttgtttgactggacgagtgcatatatcaagtctctcactggagccattttcaaaagcctattttttccagcagagtatgtttgcacatatgcactgtgctatgaaatgtatgactggagtctgtgagtttggtggcctttctgaagtttcaaagcatgatacctcacccagggtgttaactctgcaagcctcagttttctcatctctcaggagttgtgcctgtctcaggagccgttgtgagaaggctatgatgcgtgaaaacacttaggggagacatggctcacgggacatgcccagctgttattagctgctatcttgatcgattagaagatggatttggtgtgcatctgctgtcagcctcatcagtgactttttttctgttttttttttttttttttttctattgcttagtgctgctcagcgggagggattgccttgtggggctgcaagaacctctccatggaagagtccaggggccactctttgagatgcctgggacagaatttcagctactggagggacactgggtttgagtcatcagggtttgtgttatatgcattcagtataaaatgattctctaacccagtttttctcaacctctggactcttgacatgtttggtcagataatcctttgtggcggggcctgctctgtactttgcaggatgtttagcagcatctctgacctctgtccactggattcagtagcaactccctttcttcccccgagttgtgaaagccaagattgtctgcagacactgccaagagtccctgcaggacagaatggtccctggttgaggcctgttgcttcaaatgagcctcccctcttcctggagaagcctattgttttattgtcttcactacacccaccccatgggtctcagtgtgtttgtatgagggcccctgggttgtcagagccttgcaagtccctgtttgtattttggtgagctgaaggatgagctattttgttcttaagcttcctagggaaataaattgaaaatagatccctttggcatgtataggatgacctcactttgattgtaaaaaaacaattacatttataatcttacatttaaaaaaagatctgtaaagatataaattgaggagtaaactgtgatatttgggagaatgaggattaacatttttcccccttctatttgattacatctaccatctgattgttttccttacagtgagtacattttgctttaataagaagaaaaaagtctcgttttaccttccaatgtcttaggagagttattagggaggtcaggacatgggctatcgaatgagcctgcctggatttgaatcacatccttacttttctatttttctccattttaggttttatgtttcctaatttaaaagctatgtcacaaagcaaatttagaaaactggaaaaagtcatccaaaattctgccaccatacccaggcacgattggaattttgttgtggttcctccgagcatcttttgctctttttttttttaaacatggctttaattataaacacaacacacttgtataatttgcatctgtatttagcattatttcatgagcagatttctgtgacagtacacagttgcatagacattgattaaaatatttattttggcatagtaacgtagcagctgtggacaaaggccaggcttgtttgatgggttgtttaattcatgtcttgaacataaacgtgagtcagttacactcctctttgcacattatgagacaagacagttattatatttttataacagtgattactaaatttctttgaacttgacactttatgtatttttaatcacacaaataatacatgaacctatgttctttgtgaagaattttaataacctagtggtacatagggaaaaaattatagttcccattaattctaccctgtgaccccggcctgaaataaaattgcttccagtttagtgtttacctttcctcagtccatttgagaaatcatcatttattggcagaacagccagagaaactcatgcactataatttatacttagagaacagaactgtctagtggcattgtttcaggaaatgtccaaaattttatgtatatgtttaaagtacagaaaccttaaatcacatgatgaatgtacgctaatgatcagacagtacacaggatgacttagtgacatagaccagcatttgcccataggcattgcctgtcctgacactgtgtaggaagcagtggcagatcaccattcacacactgaaggactttttccaggacttcttggaagtgcacagaggtgctgaacctgtatctacagtcttgggagaattcaggagactataaatatagatgagaaaaaaatgacatcttttactttcactaacctctaaccaaaacatatgactttcttaacttacaaatgtagatgacaagccacagcagtgcctgtgactttgtcatcaacagaaatcacagatcgtttcctgtgatgtcatggttgatgtggatatctccttgctgttgctcatcctggacactgacgataatgactctagactcaccactagatctcattgtttaatgcacccatgaagaaacacctgtgtttctgcttcacaaatttatgttttaaacagttttgaaaactgagttttaatataatcagtttctttcctctgtgtcttctttttttgcattgaaaaaagtcattctgaggaggggtccatgggcttcattggataccagagtacctgtggtctgctgcaccccccaacccgaagctccaaaaatccccattaaaggcacattacagcataataatcaggaagatgtggatgaattgatcaatttccttatattttcctaaacagatgttaggagaaaaaaatattggtagcattgtcattttatgtgtgtgtatatgagagagagagagagaagtattagttacatttcttagtattctaggattcttcagaccaccatagaaatgtccttatcttgagaataatgtgtggacttctattaacttcctcaactccaggtttctatttccatgactaccaacctaaaatgtgtgaggaatcaagtgcttttggtcacacttggggtctgtagggaaaagcagctttgagttctgagcccttgcatggccaaggaactgtgagtggtgagaaggaccatggctctgcttcagctggctgggatcttggtgagccaggtgggcatctgtcccttattggccctggctggccgctgccctctcagggcctcaggctcatcctcacacctcacgagggagatcgtggcagtgcctgattggaggctgagtgtgtggtgcctggaagcagcctggttgctgcccagcacatcagtggtttctgggagatgccaggctatgttactgtgtgtgttaatttcctcaagagaaggaagatatttagagacattttgtactaagccccagcatgttcaaagaactggactcagtgggagatttcatataaaaacacagatttctggcttctcatcacaaacagaagatcgggtagctgccgcatgccccccgccctgccgacacaaagatcaaagaaaccaagaagtggctgacttcttaggatgggatggaagctctgccgtctgatgccgactccagactggctcatttctctcacctgatatgacctgtctggcttctggaggcatttgagttagtggtgtctgaaatggattatttctgggttcttttgtatttgaacaccctgattttaaagatgttgggagaaagtgctggtgctgggcttggtgaaatatgtcagaaaaatcatttgattctgaagttggtgacactgaaatttttagagggtaaagatgatgtcttcgcatctcagcgtagggatggctctgatgtataagaataccctcatttttagtactgtttatggtgatgcaaattggaaggtcacctgctgcaatctcctggaggacccgtgggctgctgtgggaaaatgggaggcaatgagatgtttccataaaggatgctgatgctgtgggtcatttttcttagcctctgatattggcagtagggaattatatgtcagcgtctccccaccttttcacagaggaagcttcccaacatgggaaggaagactcagccattgcctcttccccaatgaaaagctagggtccagctgtgccataaaccagcgtctctttactcaatttggaggtgaaagagttaaagaatcattcagatgcaggttcctaactctcattctggcttttggccctgtaactacagaaaccacttgagcagctgcaaatagtattagctttaagcttgttagggatcttgcagactcattcattgatggccttcgatttccaggacatcttggatatagaatttaaaagactttagttaagccaattaacttttgtggcgcctgggcaactaatatcgtgtgctagagaaggtcattgatgttattcaaatagcagttttatttgagctgggattaaggaagtcagacaaaaggtctaagaattgtttataatgtattcctttctgtgttgcagtatcttggcctttaacatctgattctgaccataattacacatacaagtgcttggttatgttattctttctgtagattgtggcttgattgcaccagctctcaactatccatcttgcagattgttcccagccaagttttaatctgaggtttcatctggttgtggtttatcaagcttttaaaccaaggtgtggtggttaagagcatggactctgaggctgtgctgcctgtgttcaaatcctggctcccctggtgatttaagctgcttcttccatagtgttgacttggagcctggggatagtcctcagccatgggttccattcctcaggctgtccttcatctgattggactatgtgtctaattactgccagtggaccatgagcagaactgataagggccacgtccaggctaaggagttcaagaagcaggtacactttctccactccctctcccccaatcggctggctgaatgtggaagactccaaggcctgagaggagaacagagctgttggattgggaggatcctgggtccctgagtcactatgtggaaggctacctgatgaaaagaacttcttcatggatggttacatgagcaagaaataaacctttattgtgtgaagccgctgagatatgggggttattcttattataatggctagtatccccttaactaataaactccttggtagcagtgtaactttggataagttgcttgatctctctataccttagttacctaacctataaaatgggggaaatagtatctccctgacccaaatagaatgctcagtaaatgctggctgctattattaataatacattattgttattgtggtcattccttttgattttctgggagcaggaaaggtgaattatcttcaactggaacatcagaaaaatgtgtttgaaaaaaagtaggctgcagaaagcaatctatatgaagtagtgcaggctttgtacaataacattttattatttgcatttgggctgtagttaaatttgttggtgtgcataaagacacttgtaaatgcatacaaagagatatttcttctctagcacacatggacttgtaattattgttttggctgtggggttgtgaggatgtatgtatagcgtaaatattctcatttcagagcctcagatgcccatgcaggaatctagcgaatactcaggaattggagtttttaaaataagcattgagactgttggattttgtttagtagacagattaattccccaggtttaaagcattatgtgatgcccccatacaagggcacggatggttgtatcaatagctggtatagtagcttgcttctgacttaatttcctttatctaaaacaggaatgtaatgcagtattcacatgcagttttataccatagagctacaatttatcagaggcatttgtccagttgactctgttgaacaggaaaagcttatgcaatctatgaagattttttttaagagtatagacagtaaaacaggagaggagagatagccatcttttaattcagaacctgacaatctggaagtggtggaaatctgtcagagaccacccatggcagagccagctgctctcggggacagcctccctggatctctggaatttagtcaggcactctaaaacagctagttgggagcatgggctctgggggcactgggcctgggacccctgatcattctgacagtgctctcctgaggggggtgtcagaaggcaccatggaaagtcatttagaccacaccgttcctcccgtctagctggaagttcttaaaagcacgctgaggaaactctgttgctttcgatattggttcatttccatgcttctcaaccccctaaggaggcgctgcttacaggtcatgctctgaatccctcaagccggatccatttgccacattgagccctgaagaagtaggggctgagccactccctgcatcctctctgcttcctctctgcttgcagttcagtgccatgtcctcttctctctcttcatcatttctaaaacagtcttttgttcagattcaaatagtctcttgttcctgtggctttgacagaaaaattgcattcctcaaggattgtcctcaaacttcactagatctggaagagcacagcattaacaatggacatttttgaccttggagacactagattggaatacctgtgtgaaacagaattattcatacaatagggcactttccatttcaactagaaaagtattcttttgtggctgagagttccatgaagtcagttttgtttttgtgatggttaagaagaagtggtcctaacttcagtttaaaggatttggatgtgtatttacttgaaaacgtaattgctttggagtattgtgttttgaagtgacacctttgtatgcaataattgggttaagaggaatactaagcacatttatgtcataataagaaaacgacgctgtctgtaaggagagactgcagaattatacattagtttttattgcaacatctttagtaacatatctaaaaattgtcttccctctgcccccccaatacacacacacaaatatggacttctagcaaccaatttctgccagaacagagtcctcaccaaataattattattgaagagtccttggagccttgtgaatgtattagaaaaatgccattgcccagagcaacatcgggagctagttggtctgttaggttgtaaatgttggttgcacgtttcttcttattgttgcggcaaaagaatgacgtatttcagaaattttagaaatactgagatttattacttctcccatcaccattatcatttgtgagtattttactctgtgttcagcactctgctgctgcgtactttacacacttcacatcatttgatcatctcaagagcagtatgaggtctggtctcatccaccttactgtcaaggaaaggaccctggtggaggctgatcaacttgttacgtggctagtacatggtaacatgaggacttgaacgtggaacatctggctagagagtccctggtcctcggcaccatgacaaacttgaagctggtgttaggaccgcttgcccctagcaagtgcaccttggtgattctactgcgatttgaaccctggccagtaattctaagccaagcgggatgctgctatcaggcttcgagtcagcagcacagcagcaatattgacacagattctttccactgggcccatcgtggtcagctatcttcactaggagtaagctgagggagacagagtaggaactacatcactctatccccactggagggacataggatgagcttacagcttacatgcaacctgaagagactgtcccctgtttctcttctcccctccgcatctctccttgctgcccctttctatcacaccttggtcacagatgtcctgcctcataatgactcatgaccgtctcattacattactaggctccttcatagactacatcttccaggaagcagggaatcatatatgctgcataggcatccccttttctgggaactttgactaatccatcattttacatcccgtgatcctctttctccctggtgactgtgatggccggtcctttctgtccctggccagagcacccttgcacatctggcaggagtaacatacctctactgcagaccagtgtgccctccagaggaggcacacagaccagccgtgcaggatacgagggtgcaagtttacatagaaatgatccatgcagctctgtgtcaacttatttttaaataaaatgaaccaaaaataagcctccttttaccccaagggaaccacatgtgtttgtcaacacattccccccatctccgtgcagcttggcacatggtaaaccatttgtaaatatttgttgaatgaaagaaaatagccacattttcagtttaagtttcttttttgtattggcatagtcccatcttaaatgattgggttaatgaatttatctcttgcactgtggctgtttcagagcttgaaggaataaaaagagaaaaagcaaaagaaaaaaaagaaccttagggtgggaacgtgaggcttctttcactcttacataaacaaagcaacttaaaggccttggactatctctgggttactatcccagtgtcagggttattgggggatctgaattagaggattttaagggaagtgccagagggttgggagagggatagagaagcagcccatttatttcaggtcgcagacttcaaggcaaacgctccacattttcacttggggatgggcaggtccttgctgtgccatctccccgccagggccttctgttaatcctcatgcagtgatttaattatgtcgactctagaggtgtaatttcagtttttgatgagaaaatctagccaagagaccatgttaacatgcacccactctttggctaatgatgcttcctgcatttgtcctctgcagagggtattttttttcctggtgccaagtccactcagagcccctcttccgtgtctggcttttatccgaattaattctgattggccagaagtctcctgactggagctccctctctgggggctgttctaggcgactcacttttagatacacaattctcacataggaaaaaaaccaacccaaacgtatgaacaacattaagtgttctgacagtgaagtagtacttttctcttcgtggtgtttgtgtgaaatgatctggcaaaatagatgctgcagaaataatgcatttctgtgtcttccttcccaaatgataaatgttcttggctcaccacaggatttcttgccaaatgctgattctgctaacagaagggatggaaacttcagaggctcttttgtgacagagagaatacaaagtttctcaggcttgcctttcttccatgtcacaaatgtgacacagaatgcgttctgcctagaccccagtcctggctaaatccacaggctgccttgctggggcatctctgcttactgcaccaagccggggttaggcccagtgaagacatcagcatcatccaccaccctgtcggaatttgtctgttacatcgagaccttcagtttaggaatatgaaaacacaatgcttgctagaatcccctgtagccagaaatgccaagagggaaaaataaggtagcactaggatttggggtggttcattatgtgcaggcactgtgctgagggctttgacagatgtcctcccagtaagactgcagggcagccctggatgatggacatcatcatctcttgagttctgaatgaggaccctgaggctcaggaggttaatggcttccttaaagtgacccagccagctggcccaaagtgttgctgtgtctggcccctagaacccttgatgtctctccaggagccctgcctctcattcctctgcctcttatggcccttccccattgccatctttcgagtcctggccactgcagcctctgacttccttgtctccatccagttttgcccccttactctattctgcacactgaggttattcaaaagtacagacctgatcactgatccctcctaccctcaacacccctggtggctccagttgttgcctgtccccgcagccccacccacctccccacatcaggatggggtccaaactcttactcctagcacaccgcccttgatgacctggcctctgctcacttcactggcctcatctctcaccaaagtcatccaaccgtggccatccatgctccagtgcagtgggggcagtgagcacttccttgagccccgggagtctcccctctggacttccctccttgctgctctctcttcctggcatctttatcccctgttgcccctcccaccccacccccagccttgtcgtcctcaaagggttctgcaagataggagtcactgccctgactaccctcatcagactttccctgatgctgcatcttccttgcctgtttccttctcagaatatcctggcaaagaaagcaagctttctttaaatttttttttttttaattttcacatgtttttggggaacaggtagtgtttggttacatgagtgtgttctttagtggtgatttgtgagattttggtgcacccatcacccaagcagtatacactgaacccaatttgtagtcttttatccctcgcctgcttcccacccttactccctttctccctgagtcccaaaagtccattgtgtcattcttatacctttgcatcctcatagttaggtaccacttataagtgagaacatatgatgtttggttttctattcctaagttactgcacttagaaaaatggtctccaattccctccaggttgatgtgaatgtcattaatttattccctatttatggctgaataatattccatcatatatctataccatagtttctttatccactcattgattgatgggtatttgggttggttccacaattttccgatagcgaattgtgccactataagcatgtgtgtgcaagtatctttttcatataatgacttcttttcctctgggtagatacccagtagtgggattgctggatcaaatggtagttccacttttagtttcttagggaattgccatactgttttctatagtggttgtactagtttacattcccaccagtagtgtagaagtgttccctttttaccacatccacaccaacatatattattttttgatttttttgattatggccattcttgcaggagtaaggtggtttcgcattgtggttttgatttgcatttttctgatcattagtgatgttgagcattttttcatatgtttcttggctatgtgtatatcttcttttgagaatttagacagcaagctttcttaaacatcactttactcgttatcatgtgcttggtgtctagcaccctgcctggcataccagagacaccaagtatagtttgcagaacaaacaaatggagtgctggagacaggatgcaaagccagcctggctcaaacctttcacctggtgccatagtcatcgcttccatttttgttttcctctctgccttccttttgtgtttagagggacctggtaatactttcttaactccttttcccagttgaaggatgactgcttttacgtgaaacaaaagtaatttgtactggcatccttgaagctatagaaaataaaaaggcccattgcctgcacagctgtgtggagaggcaaaccctaggaggagaaggaagaattttaggtatttttcctccaggtctttcttggtactttagggaacagaagccagttggtagcctgcatgtggccatggagtaatttctaattgaggttccagggccccctccagaatgggcttgctttgccctctccaggtatttttgttgttgacagctgtgtctactccctgggggaaggctccaagctcaccccgcagaggccctgtggaggaacaatcaactctcgtgacttcacatgtgacctgatggcttggaacagtcgtgtaaactgccgcagcccctgttaactgccaatgtctcctggttttggtatttgcctctcttgccaagttcaagccactgttggctacaaaatcaacaaaacaagtgtttttatggtagtaaaatgggtcctctgaaacaagtttgcaaatttttagaccctcagtcacctacccctctactccccttccccacaaggtcaaaagatggagcatctagaagaaagaccctgctaggtttgaaaccctccaacgaattgaccttcaatgctggttgaccttctgtgtgcctcagctctccacctgcaacatgggggtttgtgaggattagacaaattaataggtgaaaagcttctggcaccatcctgggcctgtgatacacgtgaaaagcttctggcaccatcctgggcctgtgatacacacaggactcattttactgacttccttagactctggtaatgaagacatgtcgcttaactacaaagagtctaattgggaccacattcccttaaaggaatctgtttattaggtgctcatattctgttgtaaatataactacaacttatatatatttttgaatgtgaaatagtcattgaaaaattagaaaataaaggtaagcaaaagaagaaagaaaaaaaatcatttgtgattgtacagctggctgtgaatgtacaatcacattgtgtacattgtgtatgtcctcctagcagggtgtgtgtgtgtgtgtgtgcacgtgtgtgtgagattagtgatttaaaacaaaaagtaagcagttactgtcatacgttgtgacactatttcctgtattctttgacacagtttgggatggctatgtgaaattcttttgtactggaatagctcactctatccagttactggaggtcaaattgcttggttttctactgtaggtaccttttcagtaattttgatgtatgtcaacattttaagttactaagggcttttgattgattaatgactatcactgggtctttgttcttcagaatcttttctttccagcaaagtgaaacatttcctggaaagagtaaggcattatatttttctaatgtgattccagcagtcattaacatgtcttggaaggacagagtgctttttgcttatgagatacttccccaggatgataagaaagtagtatattcttggctcgtttgcaagaaacacctgtgggtatgtggtctgaagggtggatactcaggctagagaggaatggaaccattaaactgctcagcttatcccagatctggaatccacagcttggcaaagagctttgtgctgagattagttagcgatgttacaggcaccagtagtcctgggagactgacaacctgccgtaaagccaggggcttctgttcacagagcagactcagaagaaaaaagtgggatataggaagatctcattgaaaacttggtggaaagttagagttcaataaatcgattcccttctagaagtctattgggagagaaacacatacaggtaacagatatggccagaatattggggcctggtttaaaaccaaaaacttcagataaagatgaattgtgaaatccattttatttttctttatcttgagcctctagattaccttaattacagaatttagacatcatttcactgactataaatattagactgcattagtttcgtttgttttactcagtcttgaactttgtatttttggtggtaaatcagccttgggtataagctgagtttcaatgttggtttttggagcacatctggcaggcagcaaagagctcctgggaattttagctccaaagatattggcttccatttgaacttaggaatagtctcagtgatggtcattgaagttttattcacataccagagcacgctgttagcttgagccaggtttgggctggccagagccccacctctgaggccaatccagtcaacctcccaaggtaggggtagggaaggtcactctttgccttactgtgttgagtgttgctgtaacagattatcatagattgggtaatttacaagagaagagttctatttcttccagttctggaggctaggaagtccaaggtcaaggggcccgaatctggcaagggccttcttgcttcatcatcccatggcaggtggtagaagggcaaggagagccaagcctgagagcaagagtgggccaaactcacttttttttttcttttttgagacagagttttggtcttgttgcccaggctggagtgcaatggcgcgatcgcggctcactgcaatatccgcctcccaggttgaagtgattcttctgcctcagtctcctgagtagctaggattacaggcgcccaccaccataactgactaattttttgtatttttagtagagatggggtttcaccatgttggccaggctggtctggaactcctgacctcaggtgatccacccaccttggcctcccaaagtgctgggattacaggtgtgaaccaccgcacctggccccaaactcgcttttataacacacgcagtttctccataacttacctactcctgtgataacagcattaatccattcatgagggtggagccttcataaccttattatctcttattaggccccatctcccagtactactgtattggggattaagtttccaatacatgaactttgggggacacattcaaaccatagcagccttatagaaccataggaaaatgcagctgcatccttccttccatcttccttgcattgtaaaattgcaattactctgcaataggctccatccagagaaatcttttgtgtctgctgtgggctgtggcagcaaccacaaggacctgtccttgcttccagggccacacaatctatgatgccaggagagaagagcacagacggttttggggtctgggatggagcatgaacccttcttgtgttggagaataggacagctttggtggggagagagaaaagtctagattgaaggaataaatggtttttcaggtgagatgcaagagaaactcataagatttttatggatgttttcagggagcggggggaaacatgaaactacaactcatgatcaattataggaccatgtaaagcagttcaaaacatctaataagcagtgtagcagatgtcaatcttggtctagactcacatggtccagaaataccacttcttaatttttccagggtcaacttaatgctgagaaactccaagctcttgggtctaatattcaggtcagaggaagagatccattttgaggacctcttcccacttcccctatgccagtgaatacggggttgctggggagtccatgtctaggttcctacctgcctgtaagggtaagaggagtatctttttttttttttttttctgagacaaggccttactgtgtcacccaggctggagtacagtgggataatcatagctcactgcagcctcaacctcccaggctcaagcaatccttccacttcagctcaccaagcagtgggactgcagacatgtgccaccatatctgattaattaaaaacaaacaaaaaaaaatttgtagagactgggtctcactatgttgctcaggctaagagaggggtatcttgctgctcctagaacacatggccagatgcctccagcctcacctctaggctctaaggattttgttttagtttaaggatctgaagaattctctctttacattcgttgctttccttagagttcctccccttgtcctcaaacagtaatctcatttcaggatacccagtattactgcgtcaaaagacttggacatttgagcatttgaacaaggaagggaagcattttgtgacacacacacacacacacacacacacacacacacacacacacacccttcctcgagtcaaggagaaactgagcctcccaatttacattttgaaggtataggatgggaggaatgaatggagagaaaatgtagatttatatctcaaaaattattctgccattaaaatgtaatacattttccttttcacaactaactcttaaggtctctagagctgagatgagatgtggagccccttgatttccctgggtaagagcttggggtgaggaattagtaaactgattcagagtttccccacaaataagagtaaatatatcttacccagcatctttaattttccagctgtttgataaccaaataaatgtgatggattcatgttgacattaaaagtgttataaacttcatttggaaggttcctattaataaacaatatttccttccactaggaacaaaattaaatctttagttaaaccgtgttttgggtctcaggaccctttacactcttacagagtcctgaggactccctgagagcgtctctttatgtgggttacttgtgtctattgatatttaccatattagaaattaaaaccaagaaattcaaaaagtgattaatacaaggataaaaaaactcattgcatgttaacatatatattataatatattttatggaaaataacaatactttccagaataaaaaaattagaggagtagctgtttttcattttgcaaatctctttaatatttgatttaagaggaaataggtggattcccatatctgcttctgtgttcaatctcttgtgattggttgctgaagaaaatctggcttcacatagacaacgctgttggaaaaatgaggacttcatggaccctgaaagggtctcagggacccataggagttttgggatcactttgagaactgcacatttaaacagataaactaccagggtatgtgatggcttttaaatgaaaaattgtctttagtgagaatttgagtcaactgtgggtgaaatcagtcccttataaatagacagatgatcgtttaattgggttaagatatattcctttcctgggtgctggttaagtctcccaggagagccagagtcagtttcatgcttctccctagttggcttaataattttgaaacacagtttaatatccacaaattcaccagaagcagtcatggtgtaattttatctttatttattccttgtgggtagatgtggtctgaaatcacagctgtggtgttttacggtgtcatgtgtcttgaatgttgccctctcttcttacagaaatacaaagagtatgagaaagacgttgccatagaagaaattgatggcctccaactggtaaagaagctggcaaagaacatggaagagatgtttcacaagaagtctgaggccgtcagggtaagtgcctatgttttgtgccctgtatcgcctgaaggcacaaaggcagcttcaggggatggcattgatgaaccaatctctcaaagataaaagttgactcacgcatctattacgtaaatacttttatttttacagtctggttagccaggaaaagcagtcactaggggcacaaactgcccttttcatagagggttcctgtgccagttttattctggtaaatgtatgccttcagcagagctgccactaattgtacagccatacaacgtgggcctgtaactgtatgatgcattcagtaatggccaaaaaccattcaaaggtacactagggttcaactaagctctagtctgagcattttcttgtgtcactgtgttttgtgattttctcaaatggttgcataacatttcagtctatgagtgtgtcataattgatataactgttcctatatatttggatgtctgagttatttgaaagtttttattggccgggcgcggtggctcatgcctgtaatcccagcactttgggaggccgaggcaggcagatcatctgaggtcaggagttcgtgaccagcctggccaacatggtgaaaccctgtctctactaaaaatataaaaattagccgggtgtgttggtgggtgcctgtaatcccagctacttgggaggctgaggcaggagaattgcttgaacccaggaggcagaggttgcagtgagccaagatcgcgccactgcactccagcctgggtgacagcgtgagactccggctcaaaaaaaaaaaaaagtttttaagagatgtgttgcccaggctgttctcaaactcctgggctctagtgatcctcccacctcagtctcctgagtagctggggctacaggtatgtaccaccacacctcgctcacttgcaagttttgacataaataatgctgcagtgaatcttcttatatatttataatggatcaaccaaccaagcacctactacaggcaaactgttcctttaaggaccgtatatgtactcacttgtattatccttgtaacacctccgtggtggatgttagtattatccccattttacaagagaggagactgagaggaggaagttgagtagcttctctgaggtcacatgaggagtgagagagagccccagtcataatgaccccagagtccgcattctttactgccgccttgctttcagtgtcctggagtgtgtttccttaatgtgaattccagaacacagaagacagttcagaggctcagaagcaatcttcaaggttctttatgcatatgaaagcatttctgtccagataaggttgtgccaattcacagctgctccagcgacagtggtgtgcaagtgcttattttctgaaatccttgcaaaaaaaaaaaaaaaaaaaactagtaacagcattgtcaatttgagagggggacatattattttagcatgcatttctttgtgaatcacagaattttagaggagaaaaggacataaatatctttaggttctgcttctacaattgacaaagtagccctggtgcctggaattaggggagcattgggagtggaaggaggagggggccatgcagcatgctgccttgacacagaggtccagccagcaccagaacctagacctcacctccttgaggcagtgggcccacgtggtcagtgagacatgggctctgaaagtagtggaactgtcccgaatctcagttctgccccaaggtgggagaccagtgagcaaagctgagtaacccctgtgaatctctttttttcctcacttaccagcctggcggcattacgagaagtcaatgatttaataaatacgtgcttacacttattgagttcagatgcaccagcccctgtgctaatcactttatgtatgcaatctcattcttgtatcaacactaggagtgagacactgttattattgttgtcttagaaatgaccaaacaggcttggcagggtgaaggcatttgcccaggtcacgtgggcagggctcagcagagttaatttttacacctaggtggtggggttgcagtacctctgtatctgtgtaaggtgtttatttagctcagtgtctggcaaacagtaaatgttcagtaaacatttgctgttacagctggttaaagggccttctaatctgtgaacatctgataggaggtagtcttgcagctttaggaaacacctggatgatgacaggagggaacgtgaactgggtttagcgtcttcgtattgcctaattttaaaacctttttgtgttaaattagtgaagataaaaaaaaaaagacgatttggtatggtgggtgtagttcctttgagaagaaaaaaataagttgctctgtttaaattgaaatattcccagaataaaggcagccagattccttgcaatgtgtattctatatattttaaaataaatgcacaggccttctgtaattacgcttgatgctcgagcctgtaacatcttggttaattggtccagtgttatatggatttccccacgcccgtctttaaagagagtttgtatgtcacgtaggggtttagtctggggatggtagagatgggccttgtcctcactgtgagccatgtggctctcttgttaacactcaggacccatatgccatttggaatgagatgtccctttggaggccagggaagcagtgagtgtgactcttttcctattttaatgataccttgattctccattaggaaaagtcgctgtttgcctgtgagatttgtgaacatttgaagagcaaagacctcaggttcaaatttgcccatgggtttgcagtggagtcattatttgtagccttgcactggaatgcaccactgtgagacaaggtggggtcctttcccatgccacccactgggcagtgacccttccccctcttttctctcctttcctctcctcttttctttttcttttctttttttttttttttaaagacagagtcttgctctgttgcccaggctggagtgcagtgatgcgatctcagctcactgcaagctccgcctcccgggttcacgcctttctcctgcctcagcctccccagtagctgggactacaggcacccgccaccatgcccggctaattttttgtatttttagtagagacggggtttcactgtgttagccaggatggtctcgatctcctgacctcgtgatctgcctgccttggcctcccaaagtgctgggattacaggcgtgagccaccgtgctgggcccccaccccgctattttctgataggtcaggaacagaacagattttaggtttggccctatcactctgatgcgccacacctaggaatcttccatttccaagcccccatccccctcccccagcagttggagttgggtcccaggttcaggtgccctaccttgtgttttcctagtgtgaatcagtggtgactccagggacgtgtgtaagagaaacctggttcacaaacaaccctgatttattaacatttccattggtgtatataaaatatttatgagcctggcagtagcaatttaggaagctacaataacaacacctttagtctgtgaaactaggttcagttagtgctgggggaaaaaaatggagtactacaataacctcgtcctttaatgtagcctgtcatctcctgcctgttaaacaatgttgatctttttctctgtctcttctggcttgatttcatcattttcctccatcacttttcccagtgattagttgaatcagagtgattttatcatcctcatctcctatttgaattactctccactatgcaattatcctatcacagaaagtcctattttctccccgtcagatgtctgaagtaaatgtgaaacctaaagtggcctgcccattacataacccctgtcatctcattggtaatggactatatgtaacttttttttgaggctagcaagttataaataaccttagcttcagtaatttccattaacataatggtgccatcattatggtagcatttcttaactaatattttctagttctttttaatgccattggtggtttaagtaattttttcacacccacgcagaggctagctataggttatttgatatggccatgctcctgcttgcttttgtgtatagcagttgtgcccaaggcaccatctctcaccttcattgttcagacatatttatgctaccaagccctcaattaatattgctaagcagtttgtcaagttttaagtccctacgaatggacaagaaatggagtccatttgcttttagttcattaacatttcaagggagatatttcacatgttggacatagaggaaaggatatgcaccagtcctctgccaactgtggattcccatcagaccattcctaagtgacacctggaaatgcttgtctgtgtcacaagtcagagctctttgatattgatggaaggcaaatttgacaccactcccctttcttctgagttgctgatgttgagaaatgtaccctgatttgaggggagggagaaggcagaagggttatattgcatgaccttggttatatggacaggctgcccccagcctttcctttgtctttaaaatccagcccttcagggggagtagcacaaactatcaatcaactgcaagcattatctggggctccagggaactctgagcaggcacagccaaatgtgcagtgggaagagaatatgtaggaagtaactgcgtaaccacggacatctctgattgtaaggatatactttgaggaccaattccatcacagccaagggggtgtcatgatcctgtaattttggtgcggtacatataactgagatgagcagcacaagagaaaagcagataaaccaggaaatgacaaaaagactttggtgaatttatgattttatgctaatattctctaggatggttttctaaaggtgaattccttctagtggattttgcctttggttgcactgaacagctctgccactgccttcatcacactgatttgagctggacttagaacctcctctggtcttctcaagtgtttctggtttcagggccagacactgattcagaggaccctaaatgtcagcctatgcagacttcagacctccacaaactttaacaggtttcagagcgggaaggagcactggggggattataggatagtatctgttgtggtagcgtttcaagcaaaacattacaattaattagttgtatctaaaagaatgaactcttttggggaatgtgaagagatataaaacacaagttgtagctagacctactcagtgatgagccaattgttttcaaaccttgggtaagatatttaataaattttgaaagcaccctgaaactcacacctgtaaataaacttaatgttgtttcacttattttttgatttacattgataaaatgataaatcaggcccttgaaaagagtgttttgcttaaaaataaatacctttgcttgttgggaagagctaaaggagactagattttatattaagttttccccccttcctatagttacctgctgttcattgtggaactgattcccattatagctttactgtggaaagtaattgctgttgtacagtaattcaatttcagtgcattcacgcatcagtccaccgataggggtttatctggagaaacctgggacttgaaagctttttatcgagaaattccacatgcagcaagacatttttcctaggaaacgaatatcagtatttgcatttaataaacatttaccttctcagaaaaatggatttttctctctgcagaagagatttacgccaatcttccaaaaagctagagggtactattaaagcaactttcttggaatgttttttgactggtgcctgtctacatatgtatgactataacatacatcagtgtttttatgggaatatatacagtgaggcatgaaaagcaggatgcacccaagtaaagcatactccatccccaaaatataagctgtataaggaattaatatctatagggactatatgaatacttctggtttaaaaactcatctgatctatagacattgtgaaaattgtgtttgaggcatactttcaaaaggattacattggaaatgaaataattgattccgtttatccatttgtaagttaaggaaaggttcttaagacagaactgattattttctttacatgttaagtccaaaatgtggaggttttaggaactgaatatagcctaacagtgccaggatcactttaagttctcaggcagtggaggtatatatggctgtatagatctaaaatatttttgttttctgtcttgttttcatttctgatctcatctcagaatttcaaagcttgtactttgaaagagcagtacatttgtttcagaaaaaaataatgttttctgttttgagtcacagatagagggaggagactattaattttttatgttgatgtatcttgtctatttgtcccctttttttggtaaactgggtcgcttgcaaaatcgtacgtatatatgtaaggaaatttagagcaaaaacctcaaaccagaagaatcttaaaaaagagcaacaatctgtattcaccagttttgatgaggtcagtgaaccatctttggttaatggctgagaacaaaaccacatggaactgcgtggtcctcgtgggtttcaccccaaatgggcccagggtttccgctaacatacttcagtttgagccaacctgagcctcacagctaagcccagaagactgctgtccctcccacgttgagagggaacaacttgtccacccccttgggggtacatgcttaccactaaagggaaggaaggggaaccactggatgacttgtatgtgtaatttcatgtcttctctcctcaagctctcagttttccatcagcctcacatcattgaagttggcttgacttggtggactgtatcctaactttcatgcttattctgggggtgttggcctgtagaaagcattcttctttgtgggtagaaccattgcatcaaaccctcctcaacttcatggttatttatctctttcccaaataattggactaaacgctttccatttgcaaagctttatggaagtcttagttttgtgttttctatgtctactgtagaagcacccatgtgttttttaatgctttttgtttttactggttataaaagtaatacatattcatcgtgaaagagaaaagaatgtgcagaaaatgaaaaaggggaaaggaaagatcacagcatgaagaaataagtttcaaacagtacttaatgtctctcaataccttttgtttttcagcatcttagtttttgtccttacaggtttttttttctgtttgtgcatgagtatatagatatgtgtgggtgtatataaacttctaaaacattggattattctttcttgtaacaggctttttaaaagattacatgttgtggacatgtcaatgaatatagatttctattatttttcatgactgctttctggatgttccaatcaagcagctctctcttagtgaacattgatggcatccgtagtgtttcacggttataagcaataatatgataaactctcttgcaaagaaacttttgtccatttatttgatgcatttattaggatgtattcctagaattgaaattaaggctttgggtgtatctttccagattgttctacagacaatgctatgcctgcctatgttcccacctgtgtggttggaggggaactatttccgcattatcctctctagtatttgactattattagtcttttggccaagtttagtatctcatggttttttgttttgtttcgtttgtttgtttttttggttttgagacgcagtttcactcttgttgcccaggctggagtgcaatggcccgatcttggctcactgccacctccgcctcccgggttcaagcaactctcctgcctcagcctcctgagtagctgggattacaggtgtccgccaccacgcctggctaatttttgtatttttagtagagatgggatttcaccatgttggccgggctggtctcgaactcctgacctcaggtgatctgcccacctcggcctcccaaagtactgggattacaggcatgagccaccacgcctggcctcaagttattttctttaattactcaccgtttggcacagtgggtccctccggctcctcatctgtcctgcaccagggtttgaggaaattacaccatgtcacacagagagcatgggcttgccaaaacagagagatggcccaggtgctgatccccatcctcccacagagaggaatgtgggtgtaggcactctgctggacatgcttggaggggccctccccttctcctccctttctggagtgtatcatgggaacagtcctgaggaggagggacaggctaactagcactaagcttcctgactttggggtgccagctgtttggaggaatcagctgggagcatcggcggctcaatacctagggactgtggtgcccagggtgtttcagcctccccactactgtgggagaaagtcagtagttgcaagagaatttgagcttggtgcagcccctctcaccgggaaggggtcctgttcccagatggctcgttgtctgagcacccagactgaccaccagggtcactttgattgacttttctgaaaggtactgtgtagttaagttgaccatctttttacatgtgtattagccatttcttcttcatttttattttttattttcatacattgcctggtaatactctttccccttgtttaactgtactatttcttttcttgtcccaacttgcctttactgtggccccagtgcctactacggtgcttcaaactatagttaagtgctcagtaaatgtttgtggattgacttacaggcctttgtcttggggtcaggataacttaaagtgagggtgatatggatggtatgggctacaccccttccctttggccagagaactcctgataaaggggaaaagaaagtattagagctcaactgcaaagcaactgtggggttcatggactttccagaatcctccactgtcggctccaagcgaatgaacctgacacagcaatgtggcaccaagatgtttgtcccagttctgatttttcagagtattatgttgttgttgttgttctacactaggccaggtagaaaacaatgcctcttaatttatactcaggccaggcaaaagcaatcttaaaaggtttgtgggtgggaggaaattatgatgggtgaattactgatgtgttaccatcaagagatccaaatgacagaagaaagccataataataataataataatgataataaaagaccactgtctataattttataaattaccagcaacaaattaaagggtttcagaaatattttgaatgcatatttagtctaactagcgatgtgttggtggcattggttgtacttttttggtctttactcagtttcccatatggaggtgaggagcagctggtcctgcaaacagagtgagattatttacattttctaaattaggttatgagggggaaaatgaaaagatagttaggaattcattggcatttcatttacactgcattcagtggagagatgacagcccttgcgagtaatcagaatctttgttaaaaatcagctgggatatcatttattgcacatcccaggcttactggcagcctgaatagatgaacatgcaaggctttgtactatcaggggtaaatgtggattttttgttcttgtatgctttttaattgatatgtgtgtgtgtgtgtgtgtgtgtgtgtgtgtgtgtgtgtcacttgggaaggaaaatcagatccttgggaatatacttagagagcctcccctcactgcacccagtgactctggagcatttcgtgagtgtgtttgatgggatttatagagaggaacttctctagtacctctgcaaagcccgtgatggatgtcagaaagcagactcctcatccagggtcacggttggagttgctcatagacagccccactccagccaatgagcaggagtcttcctacctcaagcaggtgtttctgcagacactggaagactgctaaccctaacccaggttgtggccctgatttgactaatgcaggagttgccttagtaaaaactctaggctgggcaaagattcagactcttatgacttttaaccagccatgaatacatgggtaccagctgcacagagatgatggaagcagctccagtcagactggagcacagtcagactcataggggagcagagccctgcaggcagcctcttggccagccagtgggtggcctctgttaggatgccttttgagcctggcagcctgtctccaagaggacttcccttcaaagggctcagtggatccattcccttgatgtgctgggagtctgtcattgcagtcactgtggccatggtctggggatagtgcatcagcttgctgtggtccacacgggggaattagggttggcctctgagaccagatttggtagagatgattttttttctagggaagtatgttcagtacacatgtgtttataatggaggggatgggcagaagtgtgggggttggtggttgacacatgagcattcattttcatgggaatttcgtcattggagatggggaaataaaaaataattaatcacatcagaattgtaaacctctgtcccccaggccaatcctggttgtagataccttttacttggtctgtgtgggctttaagggggaaaaatgaaatcacatataaaaatatgtagtgatattaaaatatccagatttaaatcttggaaaatggagaagtgtagccatcctgggcctccatgtccatagaaaagcaatcagcatcagcatgaatgtctctattggttgatttccatgcagctccgtagtcgtttatttgctactctggccccaaggaacattgagtttgcaacccctgcattagtcagattagggttagtagagtctatgtgtatgtgaagtaggcagcatacttagagcttccataattcccccacagaaagccagctggagtcattgccattgttttcatcattgatatcatctctgttgtcatcatgatcatcacattactgagtgcttcttgcttgccaagacactatgctatgctttgcatatattatctcatttaagtgatacttgtgaagttggatttaaaaaattcttggctgggtgcgggggaaagaccattcaaaggatttaaggtaagaatgtgcattataaggggacatggaatctttcttttttaaagttcctgaactaccaaatgagactgagattttcttcacctttaacatttgaggatgtttagctcttgttcagccctcacctattaaaagttctatttgttttgttgtctgttttctcccaatctcaaaaaggtttgattcatgtaaataattcccagtctggtcccattcatagaatcggcaaatgaaaatcagagctatcccctccctccctcaatctaccctggtccccagcataactttcctgtagcatggactgagacagtattggtcacgtggagaaggggatgaaaaatgctcaaagtggctacatttgaatatgtggcacttatctctctgcgcaggcaccttatagaaaaaataattcattaaacttcgttctagaaagaaagagcattaagccttcatcaacaacaacacaaagagctcaccatggcaggaacgggacaataaaggggttattttagcagaattaacaggaagaaattagccccatgtatccttcctttttatcacagtgtggtgcatttacatattttgaaatttcacatttgcatagtcaatgattttaaattatattctcacatctcctctctgatgtttgtcatgtgtacaacttgtcttaataactgagttgttagcatttaaaaagcagttatctaattattggcacaaccttgaaacatagcacccagccacccttgcaatttttaagcagctttactgagatataattcacatatgtataggacacgtgagcatgcatgtgtatttacttatatgccactttgaaacacatccaatgtgtaaatcaagttcaggttctctgatttatctggtaaccacagctgagaattggactggggagtgatgctttgaactaatgcctgtcgggagtgggatgaagtgcttatttctttgagaattcctgtcatttcaaagaggagaaaataaaagcttgagagtagaggtgcaatttttgtgtcttcttttcctgtcctgagctaccttcattcgtccaaggcctgtgtgtgggtggggaagcatgctcacctcacctgccccatctttccttgaccacctgtctgctttgtgggctataagttatatcagcctggggtctttgggttggctactgttaagatctagatttatagcgggctccctccccacatggagtttatgtgctattaggggagacaggaaggctttgaaatcgggagtcctggccgtgccacccagggaacccagggagtgaagccaaacatacaccaggtcctgggaggtggcagaaccagaaggaacagcacatgtgaagctggagaggaagtagaatgtgggaccagttgaaggcattgagaagaggatagagtggagagagggtttggagaggagagagcaagacaaggggtttttttttcctgctgtgaggggcatggtgtggtggaatagaggtggtcgattcatgtgtttatttcaatgtcttcctcaccacctcccaggccagtggttggtccattttactctgctccccaattttctcccagcgcttcacacacctggcttggtgggtgctaggcattcactggaagagttcgggtgtcattttaagaatacaggaagttgcggcagggtttgcatttctgtgtctgcactgctcattggccgcctccctttccctttgtgtctagggaaaagctgccatgttccccacttttctctgggtattgatgtatatgcacctgcccacccttagaaagtatgttgccttctcagtgatcagaggctgtggtgccctgagatggctcctttgttgcctgttcctctcttccagccaaatgcgctctggagactggagagcacaaatcttttgtacagcccaccgagagtgaagcccccggggcagcactcagggggagggagctgggaagtgcagccgcctctattgtgctgggagaaagcccgagaagcctgtgtttaagggaagcaaagagcctgctttttaattttcagctacatttagcagatggaccagttcaggattgtcctgtttagggaatctcccccaacatttggacaattcatgggtggagggaacctcgtaggagccagcccaaaggggaacgtcacctgttagttctccaagcttgtgtcccattgggtctcacctctctgaggcagttataaggagacaatgcataatttgctcactttcagcaatggctgtggttctccaagcacgctcccttaacctgcttcattggccccagcaatttaagaaggtcagccttgggaattacttcctcttgtagaagtggaagtgcagggactttgccccagtcatttgttttatgtgttgactttttaatttaatttaatttttttttgagacagagtctcactctgctagctggagtgcagtagtgtgatctcggctcactgcaacctccgcctcccgggttcaagcaattctcatgcctcagcctcccaagtagctgggattacaggcgctcgccacgacgctcagctaatttttgtattttcagtagagacggggtttcaccatgttggccaggctggtcttgactcctgacctcaagtgatccgcccaccttggcctctcaaagtgctgggattacaggctattttgtatgcagactttgatgcacttagatgttcagtcatctcttgggaaacaggttcactttggaagggagtgaactgggctttggagctagtgagacctgaggttagccattatccactgacagtgagatctgaggttagccattatccactgacagtgagacctgaacctccctgagtctcagttttcttgtctgtgaaatggacgtgttctcatgtggcagggattgtgactctctggatatggcaagaatggatttgaggctggttccctcagactagccccaagcccaggtcacacgctccctccttgagatggaagcaatcacacgagtgacctcaaaactaacatgaggatcaaatgagcaaacatgggtctggcatgagcccatgggttacatggcgaacactttgtaaatggtcatttatttttatttgtatatgtaaatagtaccttttacaaccagcatagcagaagcaggctctggtttgggcaccaaactcactcagctcagatcctgtcctagtcatttaatagctgaataatcttgcccgatttacttaaactccctaagctttgggaaccttaactgtaagatgagggttagaatacctacttaatggagttattttgagggtcaaatgagaacattgatgtaaagtgttttagcccagtgcctggcacatagttctacttcctaaagactagttactattattcttggtctaattattaatataatcatacagaaagtatggatatgatagaacacttaataggaatatttgaagaggttttaaaaattcagctatggcaaatgctactattgcaggacaggggtcccaatccagaccccaagagagggttcttagatcttgctcaaggaagaattcagggcgagtccataaagtaaagtgaaagcaagtttattaagaaagtaaaggaataaagaatggctactccataggcagagcagctctgagggctgctggttgctcatttttttgttatttcttgacgatatgctaaacaagaggtggattattcatgctttccctttttagaccatatagggtaacttcctgacattgccatggcatttgtaaactgtcatggtgctggtgggattgtagcagtgaagacgaccagaggtcactctcgttgccgttttggttttggtgggttttggccagcttctttactgccacctgttttatcagcaaggtctttatgacctgtatcttgtgccgacctcctgtctcatcctgtgacttagaatgcctgactgtctagaaatgcagcccagtaggtctcagccttattttacccagcccctatttaagatggagttgcggccaggcgcagtggctcatgcctgtaatcccagcacttttgggaggctgaggcgggcggatcatgaggtcaggagatctagaccatcctggccagaatggtgaaacctgtctctactaaaataacaaaaaattaaccagctgtggtggtgcatgtttgtagtcacagctactcaggaggctgaggcaggggaatcgcttgaacctgggaggcggagtttgcagtgagctgagatcgcgccactgtactacatagcctggcgacagaggaagactccgtctcaaaaaaaaaaaaaaaaaaaaaaagatggagtttttctggttccaatgcttccaacactactatatctcagggaggtaacctagaagaaactctgcctcctcagaatcccaggagacttgtctgcagggcggccccagtgggttatggagagctcccatctgtatagtcttcttacgcatggacgccctcctgctctgcacagcctgacttcctcagctgggcagggtccctgacacggacaaggagaggaaagtgaaggtgaaacaggctctgcattgcagtgtcttccttgggcacagagggaggggcttcaaggctctgcttggtcctctcattgctcttgcttgtttgagagagggagaagctgcaggttaaacagaatgtttagagaggaaaactagattggcagcctgagctcattggccccagcctatcagtggaatgcaggatggtgtccagtgtgaatgagcatcaggccggtccttaatggagtgatgtacctgtgggagcccaagggtcacacgctcatagctgtctaataattttaatagttacatgaaatttacattataacaaatataacttccttttaaagtggaagttatatgttatgtacgttgattcaaagaaacatattaagtaaaggtgaggtgagaaggccagttgcagcctggtttttgaaggcagctagagactccctagaacccatcattagggaaagggacagttcaaatgtgctggatgtggttgcaaaagcagtgatcacatagcaacccacactgatcttgagcgaaacaatgcataagaaatagcataagatttatagtacagtagcatctatataaattaaaagtatataaaacacccatatgcattttctataaacacatgccccattaaggagtccattgaatccattagagtgggtgcaagtgggggagggaataagagtagaggtcagggctgaaggagatataaatcaagatggggccttgcatggaccagtgatgatgatgtgctaagagtatgaatagctcaagtttctgtatatacacagacatagaacgagacatagacagacagacagacagacagacagaaatccgcacacacggtggtaggcagatacggcaaatggtgatggtggtatgctgatgtctgaggttggagcagtagtgcaaaggtggaaagataacatttacagtgaacttttcttaactgctttccttgtacctggcttcccaccttgtgcctaagacacatctttgcattccattttctcaacaacctcatgaggtaggtggtattattacctccttttgacagatgaggaaactgagcaggtccagcgtcccagagggaaagcttggcagagcagatgcaggtccagtatgtccaactccagagtccagatccatcagtgacattgctgcacagccttctttgtcttagaattcctttaaaatggatgcacttttaacatccttattaatacctgcattgcttaagttctgctgtctctgcattagtggaaaactgagttgtcccacagtagttgtaggccctattgagaagactagactggtccttttccagtggagggggatttattgatgccatccctttgccactcctgatacttgatttcatgcctctaaagttccatgtcttttcgcttcctttctttccgccattccctcctcctccccgttaataagccagccagtcaaatagcctcatttcaaacagcatcttcaccctcctttcttccaataggtggctatataacattggcattccatgtatatgtcttcaaagtgatttatcagaaagatgcacaactccacgggaggtggctaagtcacctggaatgctttataggttatttcattgtccacaggggtagatcaagccatggacacccctttttggttattaagacacaggctgccacttgcatccaaaacgtttgggtgccttaagtgagtgcctcacttgtctggctcgatggctgttggcagggctgtgtgagtgctccccgaggacagacaacaccagtaaatcttaatcactatggagcactatagaagaagtaaacagttctgaaactgtgctataaattgtcatccagtgatgattctgttttattatggaggttaaattacagcaatcactggcgcacaaaggcgctgcagtaagaaaacatttgggaacaatgtttttctcctatggcttgggtgatgggtgcacaggaataaaacaccataacttgtttaccgtgggccacaaaggaaaatatgaactctaacccactgccacatgtgtgctctttttcttttctgaaccaggcaggttgtgagcatgttgctgttgccacaggaaaaggtgatagatacacttgacttgaaaacagctttcagctgtgtttttcttctttttatagctctcttcatctcccctccctgtgtgtgtgtgtgtgtgtgtgtgtgtgtgtgtgtgtgtgtgtgtatctatttgggttaggatgggctaggagaagatgagccagagaatgacacctgtcttcagcaatcagtcgcttacagatactgtctttctggcattccccagcatgctgtccaaagggcttgtcgcttatgggccacttgattattggtgaagaaaatggtctgtgggacctcctggatccaggttcaagtcctgactctgcctcttgatcgctttgtgacttagggaaggtcatttctgtctctgagcttccagatcatctgctgtaagatgagagcagtgactgccctggctcgtggggcttgaggaaggaacggcctgtaaaacatgtgtcccaattctgaacacacgccaaagcccattaattgtcttttctagttatcattgtgtagccacagcagctattagcagcatcaccacagacattccagcatcccagtagccaggttattttctctaaccctgggattatttcgcagtctatagaatgtatacatcaaagcaaccggtattaatcctggaagttcggttcgttattgcagagaacttgtcatcctctatgatttctgactttatttacaatgaaatcagaattcattggcaaggccattgaatggtcctggccacgcctgtctctcccagcccctcttctgctgagttccctccgggacctccctcaagctctgtgaatgtgccaacctcttctctcttctagagtgcccttgcatgcagtgttctctctgagtggaatcttcttcaccaaaatctggtctctccttgatattcagggttcctcttggattcttctctttggggaaaatttcattccttggccctcttgcctaaggtagaacccctttcaccctaccccaaatacccccttcacccctaacacctcccaccacgaccgctgttacgctatcattttctctcatgttgtcttgtttataccttttcttcatagaactcgtcagtatttaaaattaccttttaaggcatctggctctcatttgctctcccactagaactttagcccagtgaggagaaggactgtgtgtgtttagttcacccaggatagtgcctcctgtagtgcagacatccaggaagttcatggaatgagtgaacgatcagaaatttttctgatatgccagagatctgatcagaatattttacctacaacaatattagaaactcgagtaacttaaataagttttctttaattaatagccttttaaaatattaggcaacagcactattctttgtgagtgagttacaggatgcactctagtgggtagaattgaaactactaatggtaccactcactcctgttaattacagggtggaaagtcataggaggtttaatcatcagaccctaattttcttgtgactttaaagagtaaatatttattgagtaactaattatgaattttacatacatttatttaaagatgctggagagttatttcttggagaaaagatttctccaaaggtgatgagtccatagtggttatctcacttttcaggatgacaaaggacaaagaaacgtgacagtactcaaagagaaatgattttagaaaacttaggttatgggcaagtttatcctattgattttgaaagaaatacttagaaaaatattgcttctaccaatgctatttttcaggtttgtgctgatagtgttccctactcacaacattttattatgaaaatatccagacatgcaacacaattgaaacaaatttgccacacaaacacccatacaccccccattcatatctgccattgatattaagtatcctcatttcatcacttatctgtccatctctctatccttctagccatccattaatacgtcttatttctggtgcgtttcaaagtgagttgcagacttgttatagtatttttaacaatccatttgtccatgaaaaagaaacatattttgtcaaggtcaggctgatataaaagcttaatatgtttgaaaagaaatgaatataaagtgaaacagaaaacgtaccttcttccagtatttcaaaagaatgggaagcagaaaggttcatggtgctgtcctgctgagtggtgttccatggtgtggaagtaccatagtttatttatccattcacctgctaatggacatttaatgtaatgtgactggtgaagtggagcttgttccaaatgaagtgagcttttggatttctgtggttctctggtaatagatcctgtccattttttcccctttctgtacagcatccactattctacttcctggttttccatggagatctgtcccttcttgatccccagtccacaaggcttggatggggcacatcccaggtgtgagcacaaggctgaagtttgtctaatcagagggtccccacactcctcaccacagaggtatgaggtcagagctgctctggtctcgtcactgacctgatctcgtctgtttccattttctcttttactcactgctccccacttccctgctctgaagcttcacgcctgctgtcccctcacctagactgctcttcctccagatggctggtggcttgccctggacttcttctggtgtctgttcaaatgtcagttctcaaaaagactttccatggtcactttcactaagataactctccagcccttttcatcacatgagctaatacttctcctatgttgcttaagcacctttgagttccattaaagaagtccgggtgaaaatgctgcatttgttcaaactgccttcagtgtttgttctctttatcttccaagtttctcaacccttagactctaccagtggctgatcagtcatcctgatagtagagcctcccggggtagatcctctgagccagttgctaggttccaagctatagtgcccatcacctcccagctaggtaacttggtggagatttactgggaagctgtgcagagagactatgtgacccggaggtttggcatagagacaaactcagaatgggagcactccagcgtttcctctgacctgaaggggtcaggaaggttggttcaccctggcatctggtgtacataggatggcatcacacagataatttaaagcctgggagcatgagtttggcattattactgctactagcgtccccttctttcagagctcaaaaccctgagaggttgccaagtgtcagtagcatctccagcaattgatagctactaggtatttagaaccttcctcacttcatccatctgctggctcttacagtagatccaaatctttatattatcttagcttctgctatgagacctccagagtgtatgtaactaactgcactccttcaagctagagtgcggtttttttttgtatttttgcatgctgagtacttagcatagtgcctgggtcaataatgatagtacttgttgaattagtagaatgatatataacatttattaagtgtttccagtgatcaggcatggttctgattttattacatgtacaagtttatttaatcttcagaacattaaggagtagatgttgctatctctccatctcgtaggtgaggaaactgattcacagagctattaagttatttgccaaagaatacacagttggcaagtgggtgagcttggacttgaaagcccatcaatatctatttaatatttattttaatcatatgtaaaagtactatagcagtagtataatattactgtctcacctaaacatatattagaatgtttatagtagaataccataggccacttatccactggacatttattggaccatgattgcatgtaaataataggcattagagggatttaaagatgagtaaggcagcttcaggatcagagaaactcctactgttgagttagtaatagaaatctacacaaaaagcagtcctatgaggcagtggatctgagtatcattctaaaggcataaaattgcgttgaaatggtggagattgatgttgttgtatgtgcatggagagggcatgtgcaggctggttggtaatgttgggaaggatacggtggggtggataggagtggggtagatcatcccgggtacagtgtgattggtgacttaggagcaggacatcttcctgtgtgaagctgatgcttcagagcttggagtcttgtgttccctccaaaccagtagcttaggtgacaaatcattgataagaacggcactgtacaaattaccaactggtttaaactttgaaaacacctcctgagtttcaggagataaaactgacatcaataacgagagtgtctaaggtggtcaacagcaactggtttgaaggtgatgagatgtgtaatttaccacttgcagaggtggcgagatgcttcccgaagcctgatctgggctgtagccacccagccatagctctcgggctgtgcggggcttggcaggcagccttctctgagcaggaagcacctgcctcagaggagcatgaggcccgggggggcccgccctgggtagccgcacagagtttgcacgtttgtgccaagaccactccttcacatcacaggccagtgtgtgggcagacaccctcacacactgaaaacaatttactgtccttgctgcccaaagtgacctttcttcaatagtgagcagttgaaacagatttattgcattaagcaaatttttaaacttttttttccctcttgggaaaatttgtttaacccagagaagtgcttctaggccttcagtgtgtttaaagcccccccctcccacgaggagattgttaaatgcaaattcctgggccctaccctggagagttgattcaataaacttagaggagggctggagagttggaattttcttttttaatttttttttaagagacagggtctagatctgtcatccaggctggagtatagtggcaccatcatagcccactgcagcctcgacctcctggtttcaagggatcctctcaccacagcctcccaagtagttgggactacaggcatgtgcccccacgcccagctaattttttgtagagatgggatttcaccatgtggcccaggctggtctcaaactccagagctcaagccactctcctgcctcagcctcccacagtgctgcgactacaggcatgcaccaccacacccagctaatttcttcattgttttgtcttattatgttgcacagcctggtcttgaacttctgggctcaagagagcctctcacctcatcctctcaaagtgctaggattacaggtatgagccaccatccccagtggagagttggaattttaaaccctctaccccccacagcccaagaattcatgggatctcatttagagaagccttgagccagagtagtgatttctaaagaaggacataggatacatctctgcagtgcagggagtaaatattgaaatatctcttttaaaatgcctatttttgtttaagtttagagtatacatggtagagcaatagtatattatgataatgtccataatcgtgatatttatacagtataatattgtgcataaatatatctatttgtaggcatatgctgactttttgctgatagaaatatgcattttaaaaaattcagggacagtttaaaggaagtttttacgaattattttgctgcaaattatctcaccatgtcacagataattggaggaagtagtaatagaatattacagtctacttattattagggactaacaagcatcattattaaagggcactgctgagttaggttcccgcagcctctctctcacctctcccgtaggctccctcctctgttccagggcaccctgcagttacagcagggagtgcttcatcacctggtgtctggacttctgacttgattatgagttctttgaaggcagagcagtatgtctttgtgccatttgtgtctctgctcccacctcagtgcctggctccccaaatatttggtgattgaatgagggagggagggagaaagggagacctatccattgctttctaacatgtccttggcactgctggaaaccataaagtaaagcaaattgtgttctggcaacgagaaatcatttatccccatacaattcttttctgcctcatatgccatctaaccagaaggtttatattcctcaggcaacttttctctaggtggagacagactcacaggacctggcttgagttccagcttggctgcttattagctctgtgacgtctatgtagaaattgagtctcctcttgggtgggggaaggggagtgtctcagtttccccatgagtacagtaaatgagttggagtgacccagctgtcagaggtgtgtgaaccagagcactccatcttaattaggagctgggtaaaataaggctgaaacctactgggctgcattcctagacggctaaggcattctcagtcacaggatgagataggaggtcagcacaaaatacaggtcataaagaccttactgataaaaacaggttacagtaaaggagccagccaaaacccaccaaaaccaaaatggccacgggagtgacctctggtcgtcctcactgctgctctcccaccatgagcgccatgacagtttacaattgccatggcaacgacaggaagttaccctatagggtctaaaaaggagaggcatgaataatccaccccttgtttagtgtattgtcaagaaataaccataaaaatgcacaaccgacagcccttggggcttctctgtctgtggagtagccattcttttattcctttacttacgtagtaataaacttgctttcactttgccctgcagactgaccctgaattcttttttgagcgagatccaagaaccctctgctggggtctggatcgggacccctttcctgtaacacaacctccagctatttctgttttttccttcataatttttgccttatctgagtagtacctgtagaaatgtttaacagaatgtttttctttacattttcttctttttttcaatttattttttaaagcaggcttttaaacactactgctgaagggaaaccagctggtcatagaagaagatacctaagagggagagtgaatccaaatggccttgctcagttctagctcttttccatgacctgcaaggctttcatcagagacctgtggtgagagggcagaggagctgggatcggagttcccgagaggctgagacattgtttttccttgtctcaattaagaggcatcaaggagaacaggaaaaggaagactttttttctctgtgaggctcagtgtcacttaatggagtgtctagcgactaccttctgtcactccccaaagcacctctaagcctaacgtcatctccactggcctctacctttgctgtggaagagtctaagtctttgcaatcttagataggacatgattagttccaagtctctcttgatgctcttttttttttttaaaaaaattgcatgtgtagaatctgaatcaaagttttgcaggaaatcaggtgttgttttctgttaaataaatacagggagctggaaatttcccacttgtgtcatgacatctgtcctcccatgccaggatttataggatgctgcccctgaacctctggactgagtggacctttggtggaggctgggggtaagggaggagggttgaaaaacaaagttcccatcctcaaggaggaggaaaccatatcctggctcaagatgtttgatgaccctgccttgaagttggggtgttgttagttcaggcctgattcctggtgattcatttgtaagtgttacttcccgagatgaccgtaaaacatggcatggaggtgaggagacggatgataggatacagaagcctccgtcagagcaacctggcccactgctctcatccagtgtctggtccaactcagcaccagggagcacagctgtgtgaagagatcattttgggctgttggagtagccagcatccacgagaatgacatggaattgatttctcctttagaataccaaatagcctttgccatagttatctgtttcctcttcatgatatgtagatgttaattgtatttgggatctctgtgaatttgtttgacatggcataattgttacctgtttttcttctcatgtggtcttaaaaattaatatatgttcttgggagaacaggtttaggtttacagaaaaattaagcagaaagtacagagaacccccatttacctccttcctgccccctccagtttctcgcattattaacatcttgtattagcctggtacatttgttgcaatcaaacaaatactgatacaatactattaactaaagtctataatttccattagggctcactctttgtgttgtatagttctaagggttttaacaagtgtgtaatgtcctgtatccgtcattaccgtatcatacagaatagtttgactgccctaaaaatctgctgtgctcttggcaacctttgatccttttactgtctctatagttttgctttttccctataattttaaataattggaataaaatgtgcacaacataaagtttaccattttaaccatattcaatttttgagtatacaattgtaagcatacagtttaaaatgtacatgcatttataatgggtttagattcgggcaagtggctgactgtgaaggttacaaatgcgatgaggaaaatgacaaagccagccatattgttcatggcaggggacacattgcaatgttgatggagccttgaccacagacagcactgtgctgcatattttatacgcaagggcccggttggcaccttatgcctgctggacaggcagatgttgttattaccccttcacccctcacacataggaaggagctgcagggagggagtggctcaggccatagttgggaaagctatgattaaacctccatctgcccaaccgcaaatttccatctcttaaccagtgcactttcctgctggcatagaggtttgaagaagtgttttaaatgctctttgggagtataggggagctgtaatatgaaatccctttcattttggagaccagctgaagtggggatctttactctgccttattaataagttctttagacggcaacttaagatgatgcctcagctttctgctgctcatgtttctatcagatttgatggatgccttgtaataaacaccctaaacgcagaatctacttatttctatattaaacatcagatgtttgtgggatacagagaaaagaatgagattgtgctgtgtcaggaccaaaataacttatgttggttgacttaaaaaaaaaaaacaaaaaacaccatgggctccttcttcatagaaggctcctttagggtccaattgccagggaccccatggatctggtaagatgattccaggctcctctcagtcctatcctcaatagaactggtgcttccttgcctgagacccaccgtgcctgtataaatgacctcaatttccttccacttgctgacatacttgtgggccctagaaggcagtaccctcccatggggcttggtacactgtaggctcctaataaatgtttatttaataaatgtaattgtatagggctatatgcttttcgaagcaggcccatatacagaaagccacatcatacatttatttgactcctatgtatgtatgtgaatacaaagaagttaatcttccttaaaaaaagaattctgagattattctgctcttgggttcattggagtgatgagttgattgcatcataggtttgatcaagaacacccaaggtgtcagccaggaattaaacattcacttcctgacagtaatccagttttctaaccacagacccctttgctgccctttgaatggattcaacatagtcaattatcattctttttggaatttggcccttgttgctctcagcctgagtaagtattggtacgttttggtggagttatttttgatttcactggctgatactgtagctgaaagagctgtgacccatgatttatggaaacattttaactgcaagataaaatattttttgattgacagagtctccatactcaagtcaaaatgggtaattttcttataattttattgctgatgttctgttatctacaatattgtgtttcaagttagaaaatgcatgatactatgaactcagcagagacatctatttctttttaaatggaaattcgaagcacactatcaggactctcttgttcgcagaagaaacactgcttatttctttggccgtaactcaagtttttcttattctggggattattgcaaatggcactaaaattatttgctcatctttcttttctgtcaagaagagagatgctgtgtcagaaacacacctaattgtgactgttgtttttttatttttatttttttgagacggagtctcgctctgtcacccaggctggagggctgtggcacgatccccactcactgcaacctccacctcccagttcaagcacttcttctgcctctgtctccccagtaacttggatcacaggtatgcaccatcatgcctggctaatttttgtatttttagtagagacggggttacactatgttggccaggctggtcttgaactcctgaccttaagttatcctcctgcctcagcctcccaaagtgctgggattacaggcatgagccactgcgcccgtccgactgttacttttttgattagcatcctgcagtaggaagtgagagactcttggttgtgtcccagggagggagagagaaaatgggtctggggtggtagaaaactaaagaaaggcattttggggacggggtgctgagtttctgagctgttcttgcaattgcagctctcagctccacagtcacactgtggggttcaagaacagggacttaggagggtggcatgaagcagagcaagaggcgcccacacaccccaagcctgctgagactgtggattgcatgcatcctggcctggcctcctgcaaccattggttctgaacgttgcgctttctcattaggaatttctcattaggaggcattcctgagaggcagctctttttaggaattccaaagcaaagacttcatggagcctatcagcaataccagccccatctgtcacacctcctcaccacagcccttaatggctcccctgactctgagccaagctgtttgcttcttatcttttcggagcattgctgtgtttatctttatttcactatgctcctttaatttttgtctgtctaacttttcattatttgcttccttatctatacaatcacccacaagcttcttttttctttttaattaggtttaagcttcattgtacacaaagcttcctgaaaaatcactcccccctcccccaggcatccatcacgtcttcccatgatagcaggcccatcttggctttctcaggggatgtagtgcgcatctgttcatgacttctttaagttcttacctcagtgtttaacctcagtcctccttcctgtacctgagcatcagaaatctgggttcttgttctcattgttcagagcagttgctcatcttctatgtgtctgcgtatgctggctgccatgacgtaaattctctttaacacattccttggacagagggcccattggttcagactttggtcatgcatttgtcttgtgttttggcttctggtgcctcttttgacattttatgttcaaagtagctaaattaaattataccttcaactctggctgctgatcatggaagacatagctgatctcccagtgggcagtgtttccttcccccttccagttgaaattctgttctttcagaacttgtattgtgagggcatttgaatggagagtgtctcctcctcttttttttatttatttattaaaagctgttaaaataactgtactctcttgctgagaactccaaatgggtttctagttacacagtgtcattttagttcttatatgtttatttaaatggatatttcagataagtatattttctaatggagattaatcactttttcatttttttttaaattaagcatctattgcattttaggttctatgccaggtcccaagatagagaagtgaagaagacagatatggcctttctctctctgggcttgaagtctgagtgtcagtgcaagtggaggggtaccactgactactttaggattagcgttcagaggctttactgacaaaagtgtaggccattttaggttcttctaagctaactgcaaaatagttcacactttcacattttgtgcatgctttattggagcatatttggaaacatctagaagtttcaagatgatgggctcaactgttctgttatcaacaccagccacattgtatcctcttgctcacaacccaggcaaatgctccacaagagtgagctttcgagatactcgaagcatcaaccttgtaaaatactgtgaattttgtgggacatgtgttttcaatgtgttctctacctgtctgcttacctggatggtattataacttatcacttcttttgtggccctgtctcacggcttttaacatccatgtgtgtgtgacacagtcacttggtaagggcatacagaagctgtttgcttctaggtcagatgtttccatactgcttggattttgagatcttgagtctgtttttttttttttgtttgttttttttttttttttttttgagacagagtctcactgtgtcgcccaggctggaggcgcgatctcggctcactgcaacctccacctcctgggctcaagcaattctcctgcctcagcttctcaagtagctgggattacaggtacctaccaccatgcccggctaatttttgtacttttactagagagggggttaccgcatgttggccaggctggtctcgaactcctgacctcgagtgatctgcctgcgttagccttccaaagtgctgggattacaggcatgagctaccgcgcccggccttgagtctgatttttaaacatttttctgtctcttttttccttgtcagccattggtggcttcctgctgctgcttgccgccatttttaattttactgcatctaagtgtgttgtgacttgggaagtcatataaacaagattgttggaatggtgttcaaactaataaagtgtttgtgttctctgctcaaagcccttcatctaactcttgttctcagctttgtctccgtgtttgaaggttcttagtaactaagggtagttgtgttgtaataactttaaagcgtgcttcatttcagcagtttatatggttccattttgtgtttataaggtgagaaactccctttctacaagccagttggtaacctcctctttaaactcactgcaccaccaagcacattactctttgccaagacagttcttggaacctctgccctagcctctctgcctaccaccctatataatagcagggctgtgccctgttgtcaggtaactttataaagcacatcctagttttatcattccttgctcggctctctttcggcctcctggtgccttatgcaataaaatgcagatgcctaatcttagcattcaaagatctcgcagagtggtctgaagctacacatcagattcatctaaacccatgttggatacctcctctgcagagtctgatttctcctttgcagcacttctctcagagtctgcagcaaattctccctcctggtcttcatggctattggtgctttgtttttgatgacctgtactgcatggatacgtggatacatacgcttgtgttatttccccaggtgatgataggccagggcattcttattcttataatccacttggacttggcacaatggaaagtcagacagcaaaagggtcacaggatagcaggtgtacctgatttctagtcctgggtctccctctctgcccatcactgtgcaagctaactttattcctgggagcctctactgagtcgtttataaaataaaggtggtagtagcacctacttcgtaggatttgtgcgaggatagagtcctagggtactggtacagttaaagacagtggtgtggtgttgatggttgtgtattattactcctccttggagtagtagtattattacccctaccagatattcaataaatgcttgttaaagtgaactgaaccttaacagtttgttctgtgccgttcacagacatcaacctgggaaaagtcagttgtaactcaggaggtcacaacaaataaatcagtgtgtggaaaagtcacagacataacagcagcagctcctgaggtttggaaaggcccttcccaatcggatcaggcacttctggtcccccagggagcagtagagcccatgctggatggcacaaagcccccgcagtttggggtacttccacaaattgcagcatgctcccaaatgtcaccttccactgtgagtagaaaggcagtggtgcttactttattcaaggaaaatacacaccaatgttagcaacaattaacttccagaagtcttgggatacagttgtggtcataaatcttgataagttctgaccaataaatttggtgattttcttaaacaactttttttaatttttaattcttgtgggtacatagtaggtgtaaatatttatgcggcacatgagatgtttccatacaggcgtgcagtgtgaaataggacatcataaagaatggggtatccatccctgcaagcatttatccattgagttgcagacaattcatttacactctttaagttgttttaaaatgtataatcattattgattgtagtcagcctgatgtgctatcaaataatagatcttacccattctctctgttttcttttttgtacccattaaccatccccacttcccccactagccaatttggtggttttcttgtcaccttatttaagtcgtgcagtcttactggtagagctattccctcaaagtcagaaatagcagtatagttagggaagcagaatttctttgtagctctgaaagaaatgcagagatggaaacgtgaaatccttgggaatggttgatgtcttcttatggtttgtatccagcagctgagtgtggaatctctgagccggactaacatgggtttgaatctcacctttgccccctgccagcagtgtggccctggttcagcagatatgggtataagaaggtccaggaatagcattttttttttttataaaggtaacaccctccctgtattttccaggtagttttgattatcattggagtttgggaaccacatctctaaagcaaggcattctgatgagttatctagcattcccaccgcgccccctccctgccacccaactctttcccagccatgcagtagcgcagagtagtgtttgaaaatgctagcctcagctctgcatcctgaaatgaccttgtggaagcattcccttgtctccctgtgggctttagggaaggcagtagattagggagatgaaatgccagagaaattagccaagccatctccctgcagacttgggcttcttgccacctggtcctggtctaaaagttaggccagtcagccttgctccaggagaggtgcagaagcctcaggaaaggcccctcagggtgatgcttggttctgtactaaggagaactattcttccgtttagaagttcttcctggcaggacggctttttatcatgtttgcccgagattcccattactcttaattgccttctttgtgtagctttggccattattttctttcccctttagtgtttactctgtcaaatatttaagggcagttatcatgtctctttagccaagctacacacattcaaggtcctttcaacttctcacatgaatctcagccttccagcccctcagcacctacccatacgtgctgtgcagtgtttgctttggatcagaatttggaagcggaggaatttttctccttagagttattggcgtcagtgtgcactttatgagtctgctgcaaacaccctcacacagggaattaaggagacacgatccagtttgctattgttttaaggacagcccagggcctttttgcccttctgatgatatctctttaaattgaatttgagacatgggcaaaagtcaacaaggactagtgtttcagtactttaaagcttataaagtatgaaggatttttttaaggtctaaaaccaaaaaaggaaaaaatgcaagtataatttaaaaaaaatgacaaacagtgctgtggtgagctgcaagttaaatgaggttctggtggttttcatccaagggcccctcctgagtgtctctgggtctctttcttgtgcagtcagaattttctgtcagtgctcttacttctaagcaaagccaattgaatgaatgcaaaattagccaaaaggaaaaagaaaaacaggcaaaatgatttaactattcaatttaattcctcttgtcattctacctcgaggctggagtgtgggatctaagaccacgtctgctggaccccttgggctacttggttctcatgtgtctctccctgagcttgagtgggattccagcgtttactgatacatatcttttgtacagcacagtctctaaatgtaagccaacgactgcagcttttgctcaacaacaatcataaaaacaaaaatcttttgcaacaccagaaaggaaaatgactgcgttggatgtattgaaggatggcttatgcgtttttattccttcaacaaaatatttattttggattttctctgtcctgtttatacatctgggcacttgagataccattgtaaacaaactttatagtcatggcatgtgtttgtgtatgaaaaatggtaagtgtgcttcagagaatggaaatgatatgagagagtgattggggtaacctctttagagtgggagatcaggggcagtctctctgcagatgtgacagtttgacactgggatctgtatggcctgaaggatgaggctgatgagatggacaggggctgggttatgtacaactttgaggctaagattaggaatgtaggtcatacttgaagtgcaactggaggccattgaagtgtttccagcaggaggagatgtgatctgatttccaatccgggcactccggctgctgtatagagactagtctgcaggagctagagtggaaataaaggccagtgaagggtctctggcagtcatcagtgaagtgatctggaaatggggttgtatcagtagagatggagagaggtatggtcaggatatatttgaagttagagtcatcaggaattgttcataggttggccatgggggagcatgtgttggccatgggggagcatgtgttggccatgggggaaggagagaaacaaatgatgctcctaggcattgctctacagccttcagttctgctctggccatgttaagtttgagatgtctattacacatgtacctggagatgtaaaagatgccgttggatctgtgaggcctaagcccagggcaggagtaaaggtaggacatggaggccttggaggattgacatatggatggtatattaagtcatgtgtctaggaagaggctacaaacaggaagagagaagaagagcccatttggactgcatgcccatttcgaagcataaactcgagttagtctggagacttcatagtgcaaagtgcatgtgtagccaagctcttcactgacctgatttcagtgattgctctgaaggctggtcatggggccagtgaccacggaactgctaagtccttggtcagtaggatatttggaggtccccaggactggctggaccaaccacatcctggattgattttcttacaaattgcagacttcctggctgacgtaatctgtgatgacaatcccacaatgccctgattgggtgggagggcggggacattgggagcagctccctcagtgaaatttggacagcttttgacagggccaggatcaacaatataggttaattgtcattcaccagagagagaacttatgggataaaactgagttgagcttatggggtggtgtttcaaaattatcctttttggccctctctgtgtgggctgctgttgtccatctgaaactcatcgttgttgtgttatatatgaactaaaaactgtctttcagctttgctttttctctttgctgagaacttgcagagttcagtgccaagaggaggcctcaggtcattgcaaagacactgctgactcagttttttgtacctaatgaatctttattggcaccgaggtctaaccttgacacagtgtggtgagttatgccttggcagccactcttaggcactgcattcctgtccctgtgaaaccctttataaataatgtgggctggctcacagatgctgccagcacacagagccttcgagtagtcttaaaaaatgggaagtagatgggatggtgcccttaaaatacaaggagcgttcagcgttaagtgttgatgaatatcactctaaaaatactgaacaatttttgtcagtgcagtttattgaaaatgggccatatgagtctatacagtctgttacagtggtattaattttaaaaatttgcattcctccatcatcagtgttttttaaaaaacactttcaggaatgataaacattcttgattcagactctctgccagcacttcctcattttagcttctatgtcacttttctccctgggttttctggcagggaaaattcttcctggtacttagcaaaaatacagttgcatgaagcttacttagggcctttgttttgtcatttaagagacatatgtaggaccccctccttgtgggctgccatgattggggactcaccgtgaaaggtgaccacacatggctcctcccttagctttggttcctcttggtgtgatgtgatcaaggttattgacaccctagtctgtgccacactgtgagctctgcgaattcatcttgttcgccactctgttttccatggcaccatgttgcccaaagcatgggagggacttaatgcatatctattaaatgaatgaggcatggtcagcgggtgcaattagctctgtacaaacttagaataaacaagtcattattatgtggactcgagcatattgaatatcaaatcttgcctcttggaacacaacaaatacattcccaaaaagctgtcataaattgatgtgatcacattcacatcttttattgaaatataaagtgctcgacatcaattgctggtgaggatgtgaagcaataagaactcttgttcattgctggcaggaatgcaaaacggtaacagccactttggaagatgacttggcagtttcttatgggactacacatactcttaccatatgatccagcaattgagctcttttgtatttacccaaatgagttgaaaacgtatgtccaaaacctgcaagcaaatgtttatagcagacttactcacaattgccaaaacttggaagcaaccaaaatattatttaataggtgaatggataggcaaacgatggtactgcagacaatggaatgttattcggtaataaaaagaaatggcctatcaaactatgagaagacctggaggaaattcgaatgcaacctgctaagtgaaagaagccaatgtgaaaagtctacatgctgcatgattccaactatatgccattctggagaaggaaaaactgtggagacagaaaaaagatcagtggtgtccaggggtaggggagaagcagagacgaatagaatagagcacaggaaagttttagggcaatgaaactgctttgtatgatactgtaatgttggacacatgtcaaaacccacaggaagtacaacaccaagagttagccctaatgtaaactatgggctttaattaataatgatggctcatcagttgtaacatatgtgctacattaatgcaagatgtgaagaatatgggaaattgtgtgtgtgaggtggaggtggatgagacaaggtgatatatggggagttctattttcttctcaatttttctgtaaacttaaaatcactccaaaatataaaattaattaaagaaaaggtaaagggctttagaaacagcctgttttgttttaaccactggatttatttaaaaagtattatttatgtcttaatgcagaattcatccagttgtttctttgtgaagaagaatatacaattttgtttaaggaaaggacacctcctcccctctgactgcaaggaggtccggttgtgacattttggcattaacattcagcattcaagtgagtcactttggcaggccactcgacgtctccatgcccaggtttcatcatctgtaaaattaggatgataatgcctgaggatgcttaaaatcagaggcctgcagagggagaacaggggcgcctcaaggcccttgagcaatctcccaggatgagagacctcctagggggagctgcctgggcaaggcatctccctgctggctgtggcttcttctctgaaaaatggtcatgttgttctctccagccctggagctttgtaattcctattatggtacttagcttgggaaattgtctatgaatcaaaaacgcagcaaattggatatcaaccagatgcaagctagaaggccagtattcagttactaaaagtcaaaaggtagagggaaaagtccgggaagcaaataggataattaattttaatggtttatatttgatatttgttggctgtgttctaggacaattttttttcctcccaccttcctttacttcctctcataaacacttcccatgtccttccactcaaccacccttttatgttgcaggatatgtgtattatttactggatctccagtaaataatataaggtacggggagagatgaggtagtatatttagtatttcataactatgcattatgggagaaatgacctcttattaaacgaatgtattgcactagcttagagaaacaaatagaacatggcttcagggtctgtcctcaaaataggtctaggcaagctcccaagttcaagtgggaagtaacacttcccctaggatcatgttgctcaccttcaagtaggaataaattaaactctatgagataattgagttattatttcaaatattctctgaaaacaaaggtctgggagataaacttttgggagagcctgcttaaacgttgaactggcccctgcagtatgaatttgtcaggcatgggtagaggtcagagtgtgtgttttggcatagagatagaataaagtccctggcatgttgacaatgtgatgcccagctcaagtgagtgagctggcaggcgtcctaggctcacgctaggaactccacatagcttaggcctggatgacaaagggtaatttatgtcacgcaagaaaccaatgtctcatatgggagttctccaagatatttcctctggaacacaagttccaggcgacactcagtggaaatcaagggttccatggtcaaacgtatttgagaagtgattcttgctccttcattatagttgcatgacatctattagtgtataattctcagatgtcttgcagtaaaggaatctgcttaactttgttgaagctgaagctggcacttcccaagcacttgttatttgaaggtagtatatataccttttgtttgatgtaaatcatccatgattttctggactagtgaatttccctgaagtagcttttggggcacttctccacttcatggggccatctaaggtttggcaaagagagtcatgctcagacctctattttagagattctgttggcaggtggaggatgtactaggtgaaggacatgtatcaggatgccattataagaataaaaggcaatgacaacaaatcatgaggatgctgggtgtgttttcagcatcctaggccaggagttagcaaactatggcccatgggccaaatgtggttggccccccacctttttttgtaaataatgtttattggaacgcagccataccttttcttttatgtatcatctttgcactgaaactgcagagttggccagcaaagccaaaaatatttaccatttggctttttatagaaatatttgctgacccctgctccaggtagttggtggattgatttcggtcaggccagagtaagagaattatctgtgtttttcagttccagtttcttcaaacagatgaatgaaaaactatatatgcaaacaaaattgcaaatactaaattctaggaatcaattctgacttgaatttttaataaaagtgacagagactgggattgtcaatctgccttttcagctctgaacattgcagagaactgaagacctgttttcattcctggtaggctctgttatccctcttgtggcaggactcaggctgcaggggtatcgagaggccaccttgtcctgagttttgggcacttaagctatcaatcgttacctttggtctgaccctgggctgtgtcacgacccagtaggaatctggctgtagttcttggctcctctgtgctcagtttcctctaggcatgttgatactggcagatgctgtctgccctgtcccttggagagtaactttctacacatatttcttggggcacatgtatttatatatcattcataatgtaaagtcttgtgatgataaaatatgtgccctgaaaagtagagaggggccattcaaccccatcactcccagaagacagatttatatggtccaatcaagacctgggctgcctaacacccagaatgtgttttatttggtttttctatgtctcatccatatggctttaaaaaattcgaaaatgtagcgtttcaatggtgttagagtgtttgagagtctatatagtaaaaatttcaaaaaagaagaagaccttaagaatggttaatatttgtcactgcatttttggtagcaagtgttaaaaaattccatattttcagatagctgcacacaaaacataaaaatgtaatgtttcttagctgtgaaacatgccagtgaaaatgtttaccataatcatgagttgactgttgtttttatggaaggttaagtaccaagcaaagaattccacagcataccagataggtggtcataaatggagtgggcaggttggtgtggaacctgtcaagtgggttgaagacactgcatacctgactaggagctctgggtatcatgcccaggtcaaacaaagcaggctaggctggtgggctgtgtcccctaacattgccagcatgatctgtctggtttttgattctcattgcaaaggaagtatctaagaatgacgaattttaggcccagttcagcttctcaggttttgcttttgagcatatccactttagttttttcatttgaggatcagaaaataccatttactttgtgatttcatgatgggcagatacctgcattacaatcagcgacatcccatgatgtttgcaaaacttcattttttaaacagtgtgaggcacctattgcagctaaagaaagctttaaatttaaaaatgaggcagctgtagatgatttttaaagactaggcttgtggttgaccatgaactgacaggtttggtgaccttgggtggggtctgagcctcaggtttttgtctggtataatgggaatgatagtagctgccttaccagcctcctaggcttgcgaaagttatccagagagagagacaggagaggatctaagagatgcaagctagtttttgaagtgacaggcagctccttctctgaggaagactcatgaagtctggtggaattttatgcatgtgcgtgtgtgtctgtacatgcatacactttactcagcatgcagataggcctgtgtgggttatgaagactaaccatcaacatgagcgttaacagctcctgggagctgagagattatgatatgctcagcatttcccgtaactgatttctcatcttttcaacaacaccacaattagtaggcatggcacccaccataacaaatcaccacacatttagcaggataagatgatgccagtttattgtcatcatctctaggtcagaggtccaggcacagcagagctggttttcctgctcactgtctcacaaggcagaaatcaaagtgtcggcgaggacgaaggtcttgtttgaggctcagggtcttcttccaagctccttcaggttgttggcaggattcattctgttgaggtcataggactggggtccccattttcttgctggcttttggccaggattttgtctcagccctcagaggccgccttcaagtcctagtcatggggctctctcaccgtgtggcagggaatcaatggctcccatttctgcttatataacatcttatataatatcacctaattgaggggtcgctatcccatcatattcacgggccctgcccacactcccgggaggggagtgtgcagcacatattgaccagggccatggggatcttggctgaccctgtaagagaattctgcctaccatacatcctcattctgcatgtgggggaaaattcagagaggttgtatttctagtctagagtcacaaatccagtgccgacaaagcagggatttgattactaccagccttccaggcatggtgcactcccattttatagtatcagaagcattgagtgggcacagctgaacagcggtgtgtgtcaagccttgagtcaactgcagcagagaccagaactccccaaagtgtggaccatgtacaaatgtcagttcaggaactgttgatatcgcaatgagatgggaacagaaattgagtataagtgttaaatatttataagaatattacaatgtgcagccagacacggtggctcatgcctgtaatcccagcactttgggaggctgaggcaagtggatcatgaggtcaggagattgagaccatcctggtcaacatggtgaaacctcgtctctactaaaatacaaaaaattagccaggtgtggtggtgtgcgcctgtagtcccagctacttgggaggctgaggcagaggaattgcttgaacccaggaggcagagattgcagtgagccgagattgcgccactgcactccagcctagcgatagagcgagactccatctccaaatatatatatatgagaatgtgcaacatcaatcacttttgcattttatgaaagtattatactacagagtattggaaaacacacatacacgatcggacaaaacaaaacaaaaaaaccaaaagctggcccttaaccagttatagtgcaaggtgtcctgatgtcaagcagtttttcaatgccactgtcatcatatggggccccagttccttgcactctagagtgagtataggatcgacctggggaatattagaatattgtcacattggcctcctgggttaaaataatagctgaggtctttaataacttcttctggtcagttcatcttgcacattttttcttgctaggccaagcctgaaagcactccaatctaatttccccaggattttgggcaccctctgaatctgaatattcagaaacccccaatgagcatgcctgtgtcattgtttattgagtttatgaagaagctgtcttactggcctgccaagcagtcaaggttgcttttggcaaagtcgtctcaaggttctttgggtggcagatcaccaaaacccacagtaagcagcattatgacaatgaggattggatggtgaagtaacagaggtgcatgatggagtgaggttgggtccagggagtgaccaggatctgaggaagtagccctacccactggcttccttctcctcttagcatgctggctttctctgagcctctgtgcaccaccatcaccgatggctgcccttacttcagatatcccacagagactgatggacatctctaacctccaattctagatagagaagagtatctgaagagaccgactcggttagatgtccacttttgagaacatgattgattagaacattatggcgcctgagcccctgcaggtgggtttttagccagctctcagagagggtttggtatgcgctgggcagaccccagaatgtccattaaaccaaccgatgtgtagaggacacattaatattctctccatgtagggtgtgttgattagcttcctaaaaaataattagtaaagacttttttgacactttcgtagctcaaacattgcctgaaacatggccctgttttcattaagaccaaatatcaaaacaacagggacatacgattttatctttctgaaaaatctctcccttcggaatagaaagaccttgagcaatatctaattattcttgtgcctcttaatttgatagtttgaaaaatgttttgtaggctttaagaacatttatggaaatttcctgtccttgccacagatcaaattgtttaaatgatggacggcaattttatattgagctgtgataatagtatctcatttgctgctgcttaaatgatttcctttcctcttaacacatgtaggtcaagttactccttcagcctaaaaaaattgtgaacaaaaaaggatggcaaatggaagaaagccaattatacaacaattttagacttttgaagtaagaccgttgcatttcccatattgattacttttcacttgattatagtgactctcttcagctgtttattacaatatagaccataactcacagactgtacttgttccaaactaaatataagtgcaaagaagcggaaagaggaaggaggtgaatgaaaagtagcatttttgacatcaatgaataaccatcaagtaaataatcatatttagctttttgaagcgttgtatttgactaataacatattgaactcctcttgtcagagaaactcagatttcttagtatgtaccatctcatgcattctcattattttccatggtagattgaagacaaattttatgctctttctgtctgataggagataaatggggaaatgaaatggttggcagcaactgctgaggtttgtcatctgaaattggatagtaaaacttgtgtttcctcaaacctggctcaatttaccaattcactttgttgaaccattgacatgactcacaaattagaccttctgcttcaaatgaagtggggaccacttcaaacatcctgcagtcctctgtcatgtttgctgaatctttagtcaacagacaattcagtgacttctgggctcaagacgctccactctgtggcctagacaaacaagttctggacttcagagggcttctattccagcagataagatgtgtctataaacctctcaaactgaaggtagaaaatgtgtcatgacatgaggaatacacaagtaaagaagtcatgaggaggaagccattcaacaaatgtgtggaatgcgtgatggagatggggcaccactggctttttcctttcctccttccctttcttcttccctgcctctttctctcctacattcatcctattttcactgagtaatgactgtatgccaggggctgaagaaacccaggtggataatacaggctatctggccggtcacagtggctcatacctgtaatcccagcactttgggaggccaaggtgggcagatcacctgagattgggagtttgagaccagcctgaccaaaatggagaaaccctgtctctactaaaagtacaaaattagctgagcatggtggcacatgcctgtaatcccagctactcgggaggctgaggcaggagaatcacttgaacttgggaggcggaggttgcaatgagccaagatcatgccactgcactccagcctggtgacagagcgagactccatctcaaaataaataaaataaaataaaatacagcctatcctctcagagtttaccacagtaagagagggatgtaccatggaaagatgggaagatgcattcattgttgaacagacactgatggagcaccagtatgcctggattactcttctaagcccaaggtatccagggatagaaggagggaagggtctgttttgcagctgatgtttacaatataatacagatgcagcatctctctgagctcagtacagatttgtcaaatgttgcagtgcaagagatccagaaccccagagtaaggaggcatttttctgctttggagtgttcagcaaagttttcatggagcaggggatatttgattagggtgttgaaggaggagtaggagcttgccaggccaggatgaaatgagtctagtcagagacaccacatgtggaaaagacctgcatgcttattgttggtttgaataacatgcagtgttcaatgatgatggcatgggactaacttttcccattactctacacttcatctagaaaacttcttgaaatgaaagagaagttagggtttctttttgagaattaatatccccagggctagaaaatagtttgctctgaaacttggaaagcaaatgtaaaatacatttttcctctgatcagaaaatgtttaaacccattaggatgcaaagattaggagcttaaattggattcgcaggagatgtgccagctccacatatgtactagattatttttttgaaatgatgtaggcactgtgcccataaagtagagtagggtttctttatacaactgaaaaaccagcagagaaatctttgagaagggcctatgcatttcactttggaaatcactggcttaaatattcagtagacatggttcctgaattttgaaatcagtttttctttactttcctctttttcctcctttgcccagatgcctcttgatgagaaaaaggcagctgtttgcttaactccatgtatatttgcattatcccaaatgattctgcaataatggttaaaatttttagaaatggctacaatgctcataaagagaaaagcaaccttgaatgggaagggtgttccaaattcaaagcagagagcaaagaaaacaagggagactaagcaaacacattttgcacataaatgttgtggcgggaatccaggcacctgccaggtggaagttgttaggagtgataaagtgattattgacttcgaatctatccatcgttgccctctcacatttgataaactgccaagtctaattctcttagtaccagcttaccttttctaataattttctactcccaacagctgtccaatcatatttcttagagatttttttttaaactacaggattaaccaatatttctgtgtgctaaattttgttcactagactcacttgatcctccactaaggaagacttttcagttaaattacaaaaaggcagaccactcctgtgaatggcagttctgctcctagccccgttatgagtatagggatcctctggccatcggcacttaaatgtccctgtcttgtttcagatgccctccaccgtatgggatgagagaagaaagccggcatttagagaaaggaaaactgtagggtctagttctgaccacccattatttaatctcaagaagcagttgtcaaatgtccctagttcagagagagtgcagggctcatgaggaatgaaacccatcagagtggtaaaaacaccatgggggagttaaggcaagagagaagcacagccttacaggggcttgaacgacccctggccacaagctctgcccattaacttagtgcccagtagagctcatcccagatttttggtagtcctccttgccttctcacatgaacttattttaaactggggcaggaccttgccacaccatcatgttttcccagagttttttgggttatgttccttcctcctgcccctttggactttttaacactcgtttgctctttcttggcccctgaccaagaaacgttttctgccatccgcatggcctagagccttgcccaccttgaactctagtattttgtgtgtctgtcctgtgattcaccaccactgtctgcctgtggcttataatattagttatcagcaaagaaaaatgcgctgttggtggctttcattgagtagctgtaccttagcagctgtgacttattagagagcatagattaggtggtttgtcttaatgaagtattggtaaatgagagtaattatataaggaacaagattttattggaatacatagcttgttttgacttattttttaaaagagttattattttaatgcttatttaaaaccacatctgagttacctgtaacattcatcgtaccaagtactcctgtaatctcagcactttggaaggccgaggtgggaggatcgcttgagcccgggagttctagaccagcctaggcaatgtagggacttgtctctacaaaaacaaacaaacaaacaaaaccccaaaacaaatagtagttatttgattacctattcgtctcctttactattttgtgcagtcttcaaagggagatcttactagtctttgcttaataaataatggttgaacttctgagggagagaaagaaagagaaggggagaggggcagagagagagtgaaagagcaggagagtgagcacggaaaggaggagagagagtgagtgagcacagaacagagacagagagggagagaaaacccaggtaagtcactgatcttttctgcttcatgtaaacttgaatttccattatataactggcatatgtagtgtaatcagtttaataatcagcatacgtgtcctgctccaaggtaatatttgggggtagggttcttttttttttttttttttttttttttgaggcggagtctcactctgtcacccaggctgtagtgtagtggcacgatctcggctcactgcaagctccgcctcctgggttcacgccattctcctgcctcagcctcctgagtagctgggactataggcgcttgccaccatgcctggctaattttttgtatttttagtggagacggggtttcattgtgttagccaggatagtctctatctcctgaccttgtgatcctcccgcctcagcctcccaaagtgctgggattacaggtgtgagccactgcgtccggccggcagtagggttctcttatagctatccttcttgctatgttaattaccttgcttacaatccccccaaatagtgaaagcttaattaatagaattgaagtaataacaataagtatacatatatcagtgtctaagggatctgacaggtcaccaaaagagttgttgagtttcgtttgtttgtttcaggcttgagactttacaaaggagcattgtcctcttaaacaaacaaacaaacaaacaaaaaacttgtaaaataatttaatgacacaaaccttaaaaaaaaaaacagtggtatagagtagaactaagttcattttgctggtgggtgggattcgctttgacagtgacagggagccgtggtcgtgcaggcaagtcacctgcatgtgctcagtggtgtggacactgctttaagtgactgccggcgggcctgaggaaccggacaagtcagggccttgacttcgtcataatctctttcccattgtccagctgctgtccccactggaccccagcctctgaccaccctggatcacctttcctctgactcctcttttatttaggatgaatctcagcccttagactgatggtccaggctggtcccagctctcctctccacccttattttatttgctgcccagacaggtgtgccctccattccccaagggcgtgtcggcctttcccacctgggacatctgccttttttcttccgaacctgcatctgaaagttcattcagattctgtctcctctgtgaagtcttcctggcctcagtagtggcaagtcatcactttcttgttcaacccttatatccctataactcagacctcttatttgaagtctggcaaattgcattaggcatagttattatatttattattactagatgtgacaacaaattcctacagtgcagactgcgataagtaatttgtagctcccttcagtgtgtggccgtgtttcttccatatagtagatgcttaataaatattttctgactaattagcttcatgccccttaagattagatgttcttaattaaacttgtatcttcacgtagcatatgagcaatgggaaaatcatttttggaatgaggtgggctataaataaacagtaataaattattataagcctttcaaaatgttgttgcaaatctatgatctttttctccatttggtatttatttaccctagaagtgagaacccttttaattagcagtattcatattttagcttcggattgagctagaattctgctagatgccatcagacttacagttcttagatgccagtagttgaatattcacaatgtaacacgcttctaaggattttaaaaatatgtttaacttacttttatctcaataatatttatttagcgtttcttgttcacagttattgcaaatgacagtaattcatctagttaatctgaaatgggtcgttgtgctaaagacacataaaagatgcaattaagaatccaatccatatataaggaatgcttaaaggagatttcagtctctccacagatttgcctaatcccctggtgagcggatgagaacttttcttctgttcatgttgactggctgtcacagtggcacattctgtggaggtggattgtacccactaagttattggtggccaaggacttattgtacccattaaagaacaccaaacaacattgcactctaatatactagagacacttttttggtaacagttttattgaaatagtcacatagcatataatttttccatttagagtatataattcagtgggtttttttttgtatattcattcagctgtacaaccattaccacaatcagttttagaatatttttctcacccccgactccagaaaaaaaaaaaaaaaaacagtacactttaacatttttccttcaatctcagcattcctcccagccctaggcatccacaaatctttctgtttctatggatttgccttttttggacatttcatgtaaatgaaataatacaatacatggtcttttatgttctttgatttctttcactgagcctaccgttttcaagagtcatctgctacatctcaatattccttttattgctgaatgatattccattgtatggatacattccattttgttgatccattcatcagttcttggacatttgggttgtttccaccttttggctgtaatgattgatgctgctttgaacatttgtgtatatgtttttgtgtggacataggttctcattttccttgggtgtgtatctaggagtcgaattgctgggtcatatggtaactcttgtatttaaccttttgaatgactttccaaagtgaacataccattttacatttctaggaacactttactatgagaaaatagggtgatattttacataagtgggtttctacatttgaaaactgctatattaactcacatttctgaatgtcttccattgttacttttttctaacaacttcatcgagatataatttacatataatacaatttgcttattttaagtacataattcattgattttagtaaatttaccaaattatatatgattttagtaaatttaccaagttgttttatactgtggtcatggatgcacatcacatcgtgtgcattttcctctctccaatttccatcactcaagtaagatctctcctcccattgacatttatttgatctatttgtactcatttaactttgtgatttattagcccaagtagaagctgagccaaagggctcagaaaactttgtggtcatcaaacataaaatcaagaaacttctgtcactttattttttgttcaagtatcaggaggttcacactctgatatcttcaattttgaagtcaagaaatctccaaaagttgaaaggtttttaataacatgtttggtggaaaaacgtggcctgaactgacatgtggatatgtttaatatttatttgttctatttaatatgaataattatttgtctactatagaaatgttaatatttgattatggggtgctggcccagacctctctgtgtatgagttataacaaatatttatcattttacctttctaaaatccaaataatcctgacctagggtagcatgcctggccccaagggcctcagagatggctttgtgggcctggtttggttttcttagccagcgcctcagagtgaacaagccatcaactcctttggactgttaaagggaaacttaaaaacttaaaagccactaaagttcaaatatattttatgaattaacttcagctacgtggaattgctggtattcaactgtcttaactcacaaagtggcgtttttgttgggtttgccatttctctgtgtgtctttttcacagtgaaagaagagggtgggtggcagagaggggagcatggagtattgtgctggaagcaagactccactctggtcatgtcagagccttggagagttgccagagtccctgctgcaggatgtagggtgaggaggggaaaatacgagcaaaacattatgagcccctagaaccatgcacggggtacaggtgagcattgtatagataccagggaatttcagtttctactgtcagtttacttctgtgtaaaatgggtttagtccttcttcattagctctctgtcttttctttaaaaaaaaatcctcaaatcttttatcacttgcatatgttcatacatctgcttatttctttgttattttgaaataaagttataattagggttgacaaaggagaaagagttgaagctgagagagtcaagtgtatgaataacgttccataaaaattcaaaccctgtgtgtaatttcagttcattacctgggcattaaaaacgggagagccagcttatcctttaagctagcttctcatccttggaaatttaaaatgctaagtttggttccagagggtgaaaatgtcattccttgaattcgagaggaatgtgtgagaattagaatggaaaaataacaaaagtgaatttcaggcacatacatttcattcataacccaggcccttgtttgacccagccccctgggactcagaagttcacatgcgtcctatcatgccagtgctggttccctcactgccccatgtttcaagttggagcagtcatctcttgaaagtcttgggcaaagtttagagtcttggcctcaggattttatttctgcacctgggggaggaaggctttttctgaggaccctgaagccaccagtgtcgtattaatcgaaaccagggacttgtgtaaaatgttcagggaccagagtcagggcaatagtcttatttttcattatttgttcttgatttcatttggaataagcttcacatataagtgcatgtggttgactttcccttagagaagtaaataagcccgcttggtcttattacacagggtccttcagaagtcgagtgactcaggtcatttggattttgttttcaaggcccctggtatgttatgaatgaacaaatgagaaaacagttgaaaactgtggtatgttttaaatatatacatttcacaaattgctgctttttaagaaagcatgcctatattatatatgtaattggtctcttcctaagcaaattaaggatacagtagaaagaaattataatgcactgtaggctgtgtggtccaggaaagggatgcaactttaaacaacttctccttccagtgccatggtgtctttatgactgtatctgtaaccccttcaggaaataaggtggaaggtttaagtttaagcctcctttgaattggaggcttgctcaatggctttctgatccttggagaggatcctggagttgccttgagctgggtcttctgggagcttcccagggcagttcttattactaccttcattgctatgagcatgttttcatcttaaagccttctttcaccttgcattttcttcctgctgtggcccaaatcggtttctcaatataggaatctggatgttttatcccaaacttccatccctcccactttcacagctctctgcactttggcccctgctccttcctgtgctctgaagtggttcttacacaggtaccctgtggatcacccagtcgtgtttgatgagagaacaaaaaccctttaggttttattttttaaggaatatctttaggcgtttcaagtaggcaggggtttaataaagggaattaaaggcttatttgatagttagaaaaactgagggagtgagggtcagggaaactgctgtctgagttgacaaatctaggaagtgctgcggttgcaggaagccaccaccaacgatctccggtgtctgcagcacgagtgggtaattcgtgggagtgtgtctgaatgaccaaagatacctgccatctgcacatgcccacatacatgcccatcacttcagctggagaatattggtttcttctctttcagtttgcagacctctcaagaatctgacctggagccctgctcagggcgagggagtcaagagcatgtggtggtaggcctccagccctaccgtagaagacacagcttagatggtgctgagagtcagcaggcattctccaacacacactcttagtcacaagattgaatggacttcacttttaaaaacattctgtgcttgtattgcctggtcttactatgagattttatcatacctgctagcccttctttcgttcagtgttcctcctgagctcagctccttctctggttgttgctggacaccccctggaggcagtaccaggtagtgagtaagggcaccaagctataggttggtgaaaaagtaattacctttgcacccacctaatagttccatcactctgccttttcccttattctctgtatcctgttggcctccaagtcctgtatattcctcttcctaaataactttcagatgttttgtcttcaatctttctcgttattgtcttggatcaccttttgctcatttgagaacatctagataacatcaataatcaataatatttggtctccagcctcctttctcactagctccctgcccccgacacaggctcccctccacataatcttcatatgccaagccactcatgattgcctgaacatgtcatgccttcttttgccactgtacttgcagttccctcatcctggaaggcccttcctttgttttctgggctggctcttgtctttcaggtctcagtgtagatgagaaggcttcttgtaccatacgtgaggagcctccttgtaccccgtaagcctggtctagttgctcccttggtggtatgtaggattccttgcttagctcctgttagagcctttatcatgttgtgttgcagttgtctactggtttctttcccatcctggactctaatgtccttgaagacaacagctgtgtcttataaaccttatattcccagatgaacacagtgcctggcacccagtagggtgagtaatagatattttttaatttgtccaactgcattttgagcactagccatattctcagtgctgctttgagcacaaagtgctcagtcctttgttagggggtggggtgggggtgacatccttgaggaggagtcatttgagctgcagagtgaccaatgaggggcagtcaaacatacaaggatctgggacaagaatatccttggtcaagagaacagcaggatgacagagacaagttggtagtggtctggggccagaaagatggctgggggtcaggatctgagggtactgggccagatcaaaggaccttttgggtcatagtcatgattagtgggaagtcactggtgggtttcaaacagggagtgctgccatcagaattgttcttaaaaggctttttctggcaaccatgtgagattgccagaaaaagaatgggatccagggcactgagtgccaactggacacttgttaggatgctgagggtttccagagaagagatggccgtggctttgctagggatataacaggggagagggtgacaaaagtagtgaaacatggggtgtattttggagggagagcccacaggaattgctcatggattaaggtatttgtggaataaatgtcattaaagcaagtggtctctctgcctcagtctctgttccaggtttatcctttttaatttttttcagcactgccaccagattacttttaaaggtgaattaaagttcaggtctgatcacgtgggtcttatggcccatgagacctcccgctgcacacaggccacagtactccttagcctagctcaacacccttgcctatctgagtcccacttgcctgcccttttgcactcttcccccttcccattccacacctgcagctctgcagacaggagagactaggcagagggaggctcccaccctggagcctttgctgctccttcgccgtcacctctctcagtcacctggctaacttccactcctttaaccccagcttactgttgcatcatttatgagcattcctgcactggtgctctatgcccttcgctttcatagtgctataacctctcttccctttggtttccctttggtgtaaagttaggatggtatctgtgctttgttttatagagcagttgtgaggatttgctggattcaatgactaaagcacttaggacagcttggcacataggtcaggcagtgtgaagctcaataattgctgttatcatcttgtgtggccctcctattgtagcccacgccacattatctagttatttgcctcttctcccaactgaactgtgtgagagtgccgttatcttcattgcgtcagcccttagtgtaattcttcccacataattaatcatcatcatcagcagcagcagcaagataacattagtggacatttactcaatgccaagaacattggctcagagaggtattataaagttgctggagtcaggatttgaattcaggttgttggacctcggggctgttccctggaccaacacgatatattccttcccaaactgaagttgcctggtaaacatttggttggatagttggaaggaaagaacaacaagggaattggaacagatttttctctgcatcaaatttatataaaaatccatcttgagaaggtaaagtctgaaaggacatggaaattgttagtgttatttcattttcgaggagaaagaaaaattttcttccctggccatagttggggcctgggggcaaggagctgcctgccacactcaccatcctgtccagtgtctcacaggtgccatctgtcacaggagcttgctttggcaaacagcttaatttctgtgtttgtgccattctgaggacatcagtcaaacccttccataaaggcctttgcctcattccgttttcagcctcactgatcacagattttacctctggaactgaaagagtggtggattctgaaaacccgcccttaaggagcagatgcacagccttgtgtttttgaacacaagatttggagtccttttcttggcagcagaattaactttcacataacctccatgtaactgtgaacttggggagttgttccaagttctccctatatgagagccaaccgtgggaggcagtgattctgggaagtttccttgtttcaatcaagctgttttatgctggaaaatcttgtctcttcctctaccctgtcttaataatattttacacttgtgtggaatcctttgggaaatttttgtatgtatattctcaccagattcacacactgaggtacagactaaaggttttattatttgtgttcatcagattagaaaaccaggactcagagaagttaagacttgcccagagtcagtgagtaggaagacctggattcaaactcttgtctttgatttctgagacctgttctgactctactgtaacaaaatgtaccccaaacttcttgaggcctaagactcagttatctatttattggggttcagtttttggtgatgttcttgttacctaataggttctcaacaagtacttgctaaactaaacagaagtgacagaaaagtgatacaaccaggaatggaaactctctgcaggacagacttccttaccagtaccaacaccttgttatgttgactgtgacttatctggggcagatgtccctgtcttccttggctagttgggcaataccttcaatactctgccatggtgagttctagtcaacaccttctgagtaagccctggaaacgtataattaagggctggaacagaattttattcaccacaatcagaggccttggtgataggaaatttcctttcattttggagaacaaatggtcatccttcaggtcagcggtccccaacctttttggcatcagggatcggtttcatgaaagacagtttttgcatgggggagtgagggatagctttgggatgaggctgttccacctcagataatcaggcattagttagattctcttaaggagcgtgcagcctggatcccttgcatgcgcagttcacaatagagttcatgctcctatgagaatctaatgctgatgatctcacaggaggctgagctcaggcagtgatgctcgcaggccctccactcacctcctgctgtgcagcccagttcctaacaggccaccgaccagtactggtccatgctgggggttggggactcatgcctcagatgatgtaatgtcatagtccccattcattgtggactatccccttgggaagttaaagatagttccattgcccacaaaagaaatagtgcagttacctcagaactgaagggtcctgcggggactttttaagtttcatggttaaatagccttgattttgataatcaactctaaaacattcccaggagagctatgtaagcagaagaacatcatttaaaatacttggtcatttggaaaaattacttgggctcaaatcgaaggttgtctcttcttcatacctctccctgagctgccttggtccttgggcagccctttgaacaaagtttggctgtttccatcttcagcagctttgcaaatgttgcactttggcaaatgcaggcttagatgtagaatgcgatggctttggtttgcaaattggccattcacactgataacgggtattaatttaatcagcctcaaattgataacaggtatctcttgtggaaacaaagataatttgttattgattgtgatcatgtcttctgatgtaaactctaggcttattttgtcttgtaaaaggccagtgtagccttatacaatctgaaggagataggaaaggggaggagtgaaggaagggaagaaagctccccacatacatgcacgatgtgttttctctattgttctgttacctgctttctctagaaactttatagattagcttttataatccactttgaaatgtttgccatttttaaagcagaagcaatttttgcagctttcaggcagaaggtcattttatacgaaatgttcattcatgtgcaacaaagcttatttcttctacaggaacaaagaaataatgaaggctccttaaaagctgtgtttctccaaagaaatgatcaccttgatagttggtgatttatatgtgccatttctattggaatcgaaaagtaaaaaacatttgtatcaataaggattactgaatattattaaggtttcagctatgactctaactgcagttgcagcattgcagggtggcagggaaaggtgtgttggctttcttcttgtctaattgtgtccatttctgcaggttattcatttcgccttggtttattatctgatggtcatccagtcattgttgtggcctctgtgtaggtcccagagcactagctgtttccagaatatttctcttaattgctgtttccagaacattttcttacctccaaaactttgtgtgaaatgttcctgttggctggaacgttctttcagcacttctctttctcctgcatccttcctgttctccttcagagctcagcttaaatgtcatgtcttctgggaagcttccttggcttcctgacagcattctttgtcacttgtcccttctcattgaaatagctattttccttgtgtgtccctcactattctgtaaaccatcttacgtttttttcatggatcactggtggtacctctccgatactttgggaaatactcgtctaattgctctagctacaaagcagcaaagattaatctacactgttaacggagtgataaacaactctatcccaaggacagaggggaaggaatctcaacaccagaaggaatgaaaatgtaaatctgaacaacttactttatttctccaatgtaacagttcttaaatggatgatttctgacccttggtacaagacaagagtttgaaataagtacgggaaacaaatcaatctcattttgcctgggttcctggaaacatcttttgatgtgctcagtgcccttaatgagggtagagatttttcattttaatccgtgatggattgagtttgaaatttgtgactgcagagaggacttagatctcctctgtcttcacttctgtagactgtcagcatgtcaagttcaagccctgctgtgtaacacgctgctaggatcgcattagtcccaggtacacactgatggacaaatggtgtaactccaactcttgcccttaaaacaaaagccagccgggtgcggtggctcacatctgtgatcccagcactttgggaggccgaggcaggcggatcacgaggtcaggagatggagaccatcctggctaacacagtgaaatcctgtctctactaaaaatacaaaaaattagccaggcatggtagcgggcacctgtagtcccagccactcgggaggccgaggcaggagaatggtgtgaacccgggaggggagcttgcagtgagccgagatcacctgggcaatagagtgagactccgtctcaaaaacaaaaaacaaaaaaacaaaaaaacaaaagccactgaatctagggtaacagttcaaccatgccgctctgggtatggttgtgatagtaattactactatttcttaattcctctgtttggccatttttctacacattgaactcttgttgattcaaaggaaaagtcatgtgatctctaactctggtattaatgacaattcaataactaactccaagttaacccttcgtgtagcccaaatccatgttcatgattatggatttgagttccccccatttgagcttaaaccttatttgagaaagaattatgtattcattccagaaaaaaaggcaataaaaagcctggtatgagtattaaatgtgttgttgcaaaacattacatgaaaaccactaaatatattaagtgctttgaaatctttattaaattccaacaccccattttaacagtattttacaacccaaaggtttttagctttagcataagaaataaaaataactttttacattgctcttccttatggtttttatatttctgttttgttttgaggattttcatccataattgtccctaccgcccattttagggatttttatttgaaattttctttatttgtacacaatttgttcattgtgataaaatcaggagtccagcaattaagttacgttggtagtgtagtaacattttccattaccttcccgcctctcaccgcacaattctttctctcttttctccccttgttaagccaaaatggccaggaacaaaaacataaaatacatgaagacaaaaaaatcattttctttttctgatccaatttttacttagacgtggtgtccggttttccgcttctggcccatgacggaaagtttgacctctaccatgtctttaacgctagtcctgatttaagtgtcgcggggaggaaacgggacactgtgcattctgtaatgttgtgcggatatacatagggtcattgtaacaagaaataagatgtgattttaaatgaaatgctttaatatccccgctattccccttggcagcttcgccttcaccaaagctgtaaatactatccatggtctatggcttctagcattgtctatttatacaaatggctcttgtttgtatttatttcactaaaagggatgagttatatagaaatataaaaagccagtgaaatgtgcatcaactcatgaattacaaccttttagcttataggtgcttttttccaagtcgagcatgtgtattccagtatattgttatcatttttattgagtaaggaaaagctttggcattaaacaagggataaaagatttgtggacaaaactgctgttttctcttacctcacagctcagttccataggctggagtcttcaaagccatttttgtttccagtgttcacgtttaattaaaaaccacattcacaattctataatcccatctgttgacctaaaaaaggaattcatataaaagaaaattaacattattattaaaagtacactgcctttataataggtataatagagtaacagttttccccaggctcagtggcagtttcttatataataactaaaatattagcaaatttaatggatttttcttacctgcagatttgttttaaaaacgtatttcattggacttagatgattataatgacatttgctaagaaaagagatgtcaataataggctgttactttctattggcaagcatcagaatttgaagttctatggtcttgactttgttagatgatgaatcagtgtattttaattttattaactggagaaacttggccaggtgcagtgactcacgcctgtaatcccagcactttgggaggcccaggtgggcagatcacctgaggtcaggagttcgagaccagcctagccaacatggtgaaaccccatctctgctaaaaaatacaaaaattagccgggagtgatggcgcatgcctgtaatcccagctactcaggaggctgaggcaggagaatagcttgaacccaggaggcggagcttgcagtgagccgagatcacgccattgcactccaacctgggtgacagagcgagactccgtctcaaaaacaaaacaaagcaaagcaaaacaaaacacagtagaaacttctgtccccatgactcagctttttttatttttattttttgagatagggtcttgttctgttgcccaggctggagtgcagtagtataatcttggctcactgcagcctctgcctcccaggctcaagtgatcctcccacctgagtttcaccgctagctgggactacaggtgggtgccaccacgcctggctaatttttgtattttttgtagagatggggatttgccatgttgcccaggctgattttgaagtcctgggctcatacgatccgccccccttggcctcccaaagtgctgggattataccacacccagcctgttttaggtaaatctatgggagatggttttcttcttaaataacatttcttttaatttgtttacctttataagagtactttcagaggaaagattactgtcctttgttctttccacaagacacatatttcttgatgatgtgccatttttcatgactgtcgtacacagcagctgagcctgttttgggagggcatcttctgagttctctcagaaaatgtaggcctgtctcctattggcatcagagggcaggttgggacaacccggtgggtgctgcatgcagggcgtatccattcaaagagctcccttctgggatacctatttgcttcataagaaacaaccattacttgtagctgctggttgattgtcatttcttgaatcatgtttcctaaagctttctagtgagaatgatggaaaaaatatcttcatggatggagaaggaaatatgtggggtaaattaagtttaaaaaaagacatgcagtgcttgcttcggcagcacatgtactaaaatgagagcaatccagagattagcaaggatgacacgcaaattcgcggagttccctattagaaaaaaaaaaggcaggaggcaaatttaacttgaacgtgaacataaaaacttgctagcaggtcaaattctcatgtatttacttcactcagcacagaatgcagtgttctggctgctcttagtagttaatacaatattatcagatgctttccagtgtttaccttcttgtgttgttacctactttgtattgcagtgtttatggttgaaatatactttatgttttgttatataggaatatgttacatagtttgcatgactgtacagtatacatatatatacatatacatacacacatatgtaaataaaatatatatgaaatacatttcatggatactgtttcatggtgatttcaacttgcctattattttcatcctgttctcttttttgttggtcctacatgactttattattattttttcctttccaattctttactttttttcagtattatctgtcttggtaattgtgtagttttactttatcttttgatcatttaaacattttatcaactttttttctctagattctcagtgcgtagacaccatcaaaaatccattttttatgtgttgcagtaaataaatgctcaaatgcatgacttgttttgataatgtaagtattcagacatgcataatatttaatacacattctgtaaagctcaatatgtaactgatttcatgatacatgcacagaaattctaaatctgttacaaagattaagagaatatgctctcagaaacacatagttttctttctttttatatatcactgcctgtcactcatctgtcaggatccacagtgtgtttgcagattgtaccacatgatcccagaaggctttcaagcttcattgactaggatgattttaggaagagagtgacccaatgaacgcttggggcccacttacctgatctttgtagattgttcctcttcttacttttctgtttctcatcccctccatcttatgtcttttttttctgtaaagaattttatgtcttaaagtgacagtattttaggtaggaatacataagttttgtgttttgtttttgagacagagtctcactctgtcgcccaggctggaatgcagtggtgtgatctcggctcactgcagcctctgcctcctgggttcaagtgattctcctgcctcagcctcctgaatagctgagactacaggcatgtgccaccacgcctggctaatttttgtgttttttgttgagatggggtttttgccacgttgaccaggctggtctctaattccttacctcaggtgatctgcccgcctctgcctcccaaagtgctaggattactagtgtgaacccaccatgcctggcctaggtacatggattttacaaagttaaataagagttgagaaaccttggaggtttaatcaagcatcaggagtgaggtgaggaatgggatgaatggtatttttagccagtggttctcaaactttagtggcatcagaattacctgcagggcttgttagaccagattgctggtcctcacctccagaacttttgattcggtgggactgggatgggcatttctacaatttcccaggtgaaactgatcctgccagtgtgggtctgcactttgggaagcactgctctagggtcaccactttttgtattttcaggtgaggaagctgaggctcagacaggggaagggtcctgcgcaagatttcacacctgtagtgagttagcatccgggctagaatgaggaccaggtctcctggctctggcctctgatgttctctggggattgttctttgaccagtgaaggaaaaaacccttcctgaccttctgatcaactgaagatagtctgggaaatcacatttccacccttcccaaatctctgtctgtgggcagcactgtctctggctggcctgtctctttctttgtatgtcctgtggcgaaagtgggctttggtactctactgctgcttaaagttacccgaatgtatttcagcctcttcacttccatatccagtttaataattattcatgggacatttgtccatcaatttgtgaccgtttagagattaatattaatgccatcatttttcacacgtggcctattaaactcaggcctatattatgtcaagaaaaagcaagttaaagacagcataggatacaagagtgaccacaggagaaatagaagtggtcaaatttttgcttggatctaagattttgcttttagtttgatataatttcagtgaaatattatttcaccaaatgagagttttctgtaatatcctctagcctatattttcaaggtgggaaatatcttattgtaggcaaaatcaaattaaagtaaaaatgattttgattgttgactaattatctaaatgaaggcattatgaaatgggtttcataagaatattaatgtgttgaatttcgctggctgagaagaataacaagaattgtgttgttgtgggtcctgagtattagtttaatttaagtgattgctttattgggttgcagattgtcacagtggcattgatggaccataaaatgcaaataactgtcacctgataattacatattagaactgggtacagaaagaattgaccttgaatgattgagggaattaaaataagtactcttttccaaaatattggggaagaaagctagcccacttaaagttggactcaattcaaggcaataaatcttgactaagggcgttctatacctaaggaatgcactatgctaggtgggttttggatctgcattgggcctcaaggaccagtgtctgaattgttaggtaaatggatgcagaacacgtgtgcatttataaatgtgtacataacaataaatatttattggaagaattattgattgaatgatggaggcagaaacccagtgttgacactgatgtgattattttcagtttcatgggagcaaaggcatcagatcacaatgtatgaaccacgatataatatgtcacttttggtcaatggagaaatggggttcaggccacaattctgatccttaatgctgtcttctgttttttttttttttttttagcgtctggtggaggctgcagaagaagcacacctgaaacatgaatttgatgcagacttacaggtaactgattatagtttgagttaaattgttttgtgtgtttcctgccaaaggacaagtaccaggtataccaggaatactgatttttcagtgattgggagggagaggcttttgagaggatggtactgagttggaatctttgacaggattcttaagcaatccgcaaccaccttctaacagtgacagttataatgggtgatgtcaaacactcacatgtgtgtaatcagatttcaataaactattccccaatttagggggagttaaatcggtcaactgacaataatcaccagatctctcaatggtgaattgataagatagcagaatacatccaaatcccacttggctggctgcattttggaatgcaagtgactgaaagcaatactgtgatggatctatccttgaattgattgttaataacatttaaaaattgaatcattcactgatttgagattcaaatatccatttcattaatttcttgcagtagatcttgtacctgatcctgacatgactatgtctgatagagaaggattttgatgtcgatgtgtatagaaaacatagtaaagggcaacaagttaattaaataatacttggaggttccagctgggtgtggtggctcatgcctgtaatcctagcactttgggagactgaggcaggtgcatcgcttgaggccaggagttcgagaccagcctggccaacatggtgaaaccccgtctctactaaaaatacaaaaattagctgggcgtggtagcgcacgcctgtaatcccagctacttgggaaactgaggcaggagaattgcttgaacctgggcagcagacgttgcagtgagctgagattgagccattgcactgcagcctgggtgacagagtgagagtctgtctcaaataaataagtaagtaagtaagtaagtaagtaaaacttggagattcctttgggtctccctgaaagaacttttatctaaattggcactttgagttttgtgacctttcctcaccactaggaaaacagaaggagcaaatcttaaagtttgagctttgctagacatatttcttttagtggcatgtggtcacaatttggaaatagtgttgactttcctatattcccatttatatggggaatagaaaggcagacataaatcattaagcacaaaaaaagatggcagtaccaaagctgaccaccggctgcatgtctctctggaagatgtgtccttgtcatcaccctcatctgtgtcttttgctttgtgggtacaacaatgcatattcaagtggggtgatcaaggaaagtttaattaaggaaatattttcaaatgtatactcggggttaagtgaaaccaacatgcagtggtgttcagatagaccaaaaggcaatggtggcataccccagagctggccatacttatgacctgaagagaggaaaactagggtttccagaactcagggaagatggctacatggaaaaaggatttgatagaggagtatagacacccatggtgagctggaaagggtgaaatttgggataatgatacccaagtactctcttgctttcttatttcttgccagtactcaccgttggctgaatccagctgttggtatggttgatgcagttcagttcagtcattgagctgggtgaggaaggttgaagaatggttctggaggggcaaacaaaaaatatcaagtccatcatcagcagtctttttaggcataatactcaacatttgaaacaaatagagccagaggtatagctaagcataagaggggaatgaggagaagctctgaggatggttggaaacattggaagaggagtcggcagctggcccagctctttgagcgaagctgctgagaagggacagaagatagtgagaagaaccttggatatagcaagaagtaccttaccttcctaaagccatactcagttctcacaaagatctaggggccatttactggccacatttgtcttctttgagcctgattgtcagagaatttggacttgtagagtgggccagaagggatttaatggcagcatcaggaagcactttggcaggtgtgaagattataaggacctcttgagtgcaatgcccagggaaactgtgtcacttttctcagaagttcctgaaggcttttcaggaatattctgattttaagtgacagaaactcaactcatatcaacttagcttgtaacaatgaataaaataagaatccatgagtccgcttgataataaataaacagatagatagattaaaaaatagacaaatgggccaggctgggtggctcacacctgtagtcccagcacgttgggaggccaaggcgggtgtatcaggagtttgagaccagcttggccaacatggtgaaaccctgtctctactaaaaatacaaaaattagccgggcatggtggcaggtgccggtaatcccagctactcagtaggctgagacaggagaatcgcttgaagctgggaggtggatgttggagtcagccgagatcacgccagtgcactccagcctgggcaacaaagagcgaaactccgtcttaaaaaaaaaaaaagacaaatgagggggaatgtcttagaaggcaactaatgcatatagaaaaatgattgagttagaaaattatggtaattaactgaggcaagaatcttcagtggatgctaaaattagttggcaaaagtttggtgaagaacaggacacttatagtctcaaactatttgcccacaagttactcatcaattacaaagggaaaaatagcaattttattgtggagaaacctgatagacaccaccttaaacaaataatcgaagttaatgtcaccaataatgagacaaagtgacatcaagtgcctccagatgtgatgactcagaaaaatataacacagttatgtagaattcttgcccaaaatgtgtagcctgactgtaatcatgataaaacatcagacaaatctagactgaggaacattctacagagtaactgtctggactcgtcttcaaaaatgccaagatcaagaaggagaaagaaatgttgaggatttgctcctaattcaaagagatgaggacacatgactactacatgcaatgtgtgatcctgaactggatcctgaactagaaaacaaagttttaatatggactgtgcattagaaaacaatgctgtattaatgttggattgttggatcttcatccctatactgtgattatgttaaggaatgtcctcattctttgattttttctggcttcattggttcaacaggaaggagtgattgtgcgggagagagtgagaaacattattggaagtgatgactgctttgtaaaatctgttatttatggctcatgtggtcagttttactgagagacaagggttggtgggatggggcatgggaggggatgatgtggttgacttttggggattacttatccttcagcagatgaaaaatgttttgtggttttagttcagccaacatagagacattcttttttgtccatctgaagctattattattttccaagagtgttctgatttcctatttccgaagttttacagtaaaattctggtgtagcacaagcaattccctctgtcaaagagggtgctgtgattgtgaatgcagcattggcatctctcttgaaaaaatgaggcaccaagaaaataagtctctagtttttgttctcttgggaacaaggaaagggagctaaagttttcctccccagtcacctgttctggacatgtacaacaaaagcatcagagggtaccattgtggtctgaacataagagtagatgttgaaatactctgtcaatatgacaatgccattcacactggtgctccgacctcagtgaactcctctatgggtcaaagtaaaccacatgcactttggtggagacctgtgaaagagaggcctttgataaactggctgtgcatggaaggatttgtcttggcttagatgaaggttttgaagctactgaagcttctatgctattaagtgcaagtatattaacagcttgggtgtcagccccattgctattactgaggtggcaggtctgtgtactggctctgaatttattactatgatggtccgttagagctgatcaattgttaatctgggttctgctgacctctcagcaacccctggcagataattgtttttatcaaaaaaatttcagactaccatctgctcactgtgaaataacgctgagaaggaacctaccctattagctcaggaggagtacagggagctggaagtctgttttcatactgaaaaataaaaagtgattttgcaaaatttcctaacctgtgtagttttaactcatatatatcttagcttccgtcttcccaaaacagaaaagagatgatggatctgccccttctctcgctttagactggagacgttgcatcattgcaacattcatgtgcttcaaagtgaagaatttgcttttcgttggtaaaataatcaaaagttagaaaaagaaagttacaactcctttattattacaattttattttccatttaaattccccttgccatcttttcagaggtttaacttttccccgtgaccttatggcttggacatctacagccccctctgtaatgtccttactatggcattagattgttagttgttaacaaaaactgtattggggcaagaggcaaaatgcagctcctgaaggatagcatgtgtgaacaaaccaaaatgcagaatcctccatagaaaacagatgtgcttggccttcattggcggggtggctttctttctttctttctttctttcttttttttttttgagacagagtcttgatctgtcacccagaccggagtgcagtggtgcgatctcagctcactataacctgcgcctcccagcttcaagtgattctcatgcctcagcttccccagtagctgggattacaggtgtgcaccatgacacccagctacttcttgtattttttgtggataccgggtttcaccatgttggttaggctgttctcgagctcctgggctcaagtgacctgcctgacttggcctcccaaagtgctgggattataggtatgagccaccatgcccagcctggcagggtaactttcttgtggacactggtgtcagttcagccctctggcttgtccctctttctggtggcctgtgggttctagattggccttctcttggtgtagttctttattccctgatatcttcattgggtcaattttcagtcataattgacaatagaggccttattataatagcatctctctccttttttactttatgctgcgaattaacataggcttttcttaaaagattgatagttccaatgagaacagagttttaaaaaatactaccctatgtctcagttattacatgtaattattttagtgtttcatcctcattattttgatggcaaaacccaattccaggtggagaagcaggagaccctagctttgaatacctagccattgatgaatttccagaaaattaagtctatacatgttctagtacaattcagaatgcgttccccctcttacatactctttctttttgagtttttccactggcagtaaagaagaaaaaaaaaatgtccttttgacagtttactaaaaacctgcttatctttgaaccacaaacatattttctttgaaagctgtctcaaataagtgccagttgcacagagcgggtgcacagagagagaaaaaaatatggttttgaattgtgtatcctgcagaagctttttctattacaaagttttctatgatagtttttctttgttgttttgtaagtaatagggaaaaagagaagtgtggtgacattcagagggataacaggtatggaagggaaaggagctggcagcacacttcctcctggtcctcaccaagctggaagagcctaccttgcaaatgtagtggcctgatttcaaaggtggggtgggggctttggagtggagggggaataaagactgttggtgggaaacctctgagataagatgacttccgatacttcctagagcagcttactctacctgcttacctgttacaatgggagctttgtgttgaaggaaacccaggaaaggagagaaagggcagctcaggagccccagcactcagtgtagaacttctttcaccatccactaggaaaaggaagcctttctaggaaaaaggattagcaaggacagtgggagagtgatgtcaacaagatggctggctagaagaagcccttagtgcttgtcccccgccaccctgcaaagacagccaaagcaaagaataaactgctggattttgatgaaaataactaaacagggctgaagtgcatcaaaggagtaacagaagccctgtagaccacagaagctcaggatggacgcatagagaagggaagcgccttgcttctgctaccccatccccaaggtggggtcagttcaaaaccaggagttacttctccctgtggaaaaaaggtgagcaagaagactgccggaagcacccatcgtcgacgtggagacttgtagtgctctccactggggactcctaccgacctcacaggtgctcaggtcagctgagggagctggctggtgtccacacagctgcactttccccagagaagcagctgacactgtgtcctgtcccctgtgacccatgtgggtactgcaccgtctttgaacttgaaccactgctggagtgtgtgtctggctctggtgcagttagccacagcaccctgtcgtccctgaggctttgttgccactgaaccacccttgcctgctggcccaccatccctaagctgagctgctgctacatgctaccccaggggccaagctggtgtgtagctgctctacctacccctcccagtcactatcgtgcttcgcccctcagagcttaagcagaagcagcaccctgcatcctggggaattggtgccttgtctgcccagagcagtaaggcttcctgtgcctgagctaaagaggtacatcaactcgtggggaaatggagccatagccagactgagcagccacacatccctgggctgatctgacgtggtatcccacgtcccagggaaacagggcgttggttgagctgggacaccttgccctactggctgaagaactgtagtaccctgcttccctagaactggactgtccttgcagagtatgagacacccgtcttcttggggagtggggtcatcactgtgctgttccctgccttccaggatgcaagcagcagctaggctttgccattttgggtaccttgttgctgctgcatgtgtccatacagggtctaggatgcttctgtgtctcaccatctgggggtccagagttaccactatgaggtaggcatctcattcactggggcctgaattgccactgtgcctgttggcactggttcccaaattgcagctttaccttgctccctgggctcaaatcgtcagagcaccccttcttcctcagagaaaggccagttctgtgtcctgtcccctggggtcagagttacaactacaacccagctccccggagcggccttagctgcttggttgtgccccagaatcacagatcctggtgtgtaggcaatctgcctgcaaccctgccttggagagtgaacattttttttttttttattattatactctaagttttagggtacatgtgcacattgtgcaggttacatatgtatacatgtgccatgctggtgcgctgcacccactaacgtgtcatctagcattaggtatatctcccaatgctatccctcctccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccatccatgtccctacaaaggacatgaactcatcattttttatggctgtatagtattccatggtgtatatgtgccacattttcttaatccagtctatcattgttggacatttgggttggttccaagtctttgctattgtgaatagtgccgcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccaactttgttgttttggcttaggattgacttggcgatgcgggttcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcacccatgatttgactctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagcttttggatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgacttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatttttatttctgtcttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggctaggtagatcttcctccatccttttattttgagcctatgtgtgtctctgcacgtgagatgggtttcctgaatacagcacactgatgggtcttgactctttatccaacttcccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccaggtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtagttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcattggctcctgaggcttctgcattcttcacgtagttctcgagccttggttttcagctccatcagctcctttaagcacttctctctattggttattctagttatacattcttctaaatttttttcaaagttttcaacttctttgcctttggtttgaatgtcctcccatagctcagagtaatttgatcatctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgttttttaagccggtctgaaaagtgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgtgtcgctcacgctgggagctgtagaccggagctgttcctattcggccatcttggctcctccgagagtgaaccttcaccttagaactcaggtgccaaaataagctcatgaaaccctgagcccacgactcctcttccatggatattctgagcacctgtttcctggaactcagcactgttgcagctgcttgagggctgtgtcagacctgacatcaagaaatatcttctcatctaagactcaccattgtgtggaaagaaagaagaggaggacatcaaaagtccttgtcaccaaggaccctgacagcctttgctaccaccaccactgccccaaactcctacagcctagtctaccagacacccacagtcatttctgacattgatcacagctgaagaagcttcacagaggatatacaactgcttctactaggagcttagagtcaccatgccctaccaaattggcacagtaagacccatctgcaagtgaaagtctttccctataaaagccagtctgtaaagtttggaagaggtgattgtttcaccagatgtgcagacatcaatgcaaggaacaagaaacatgaaaaagcaaggaaacaggacattgccaaagtaacacaataattctctagtaacttactccaagaaaaggaaatttatgaattttctaaaaaggaattcagaataatgattgtgaggaaactctgtgagatttgagataagataggcaattcagtgaaatcagaaaaaaaattcatgatctgaatgataatctcaacggagataaatatcattaaaaagaaccaaataaaaatcttggagctgaagaattcaatgaatgaaataaaaactataatagaaaacttcaacatcagactagatcaagcagaagaaagaaactctgaacttgatgataggtcttttgaaattacctagtcaacggaaaaaaaagaaaaatgaatgaaagattgaagacagtctgcagaacttatgaaatgccatcaagtgaacaaagattcatattaggagaattgcagaaggataagggacagaggtaggaagaggaagcttatgaaataatgaaataattgcagaaaacctccagattcttggaagagatttggacatccagatctgtgaaactcaaaagtccccaaacaagttcaacccaaagtggttctctctgaggtacattataattaaactatcaaaagtcaatgacaaagagataattttaaaagaacaagagaaaagtgtcaggtcacatataagggaaatcatcgttagaatgtcagtgaatttcttaagagaaacgttgcaagccaggagagaaagggatgaaaattttaaagtactgaaaggaaaaagaatgtcagccaagaatactatacccattaaaggtgtccttcaggaataaaggagaaacaaaagtctttcctaggcaagcaaacgttgagagaatttatcaccactaaacccgtcttagaagaaatacttaagagagttcttcaagtagaaacaaaaggatgtgaattactaatgtaacaacatatgaaagtataaaattcaatggtaaaggtcaagtccagaatacttcattgttgatatgatactctgtaaatcgtatatatctctagtataaaggtcaaaagtcaaaacagtcaaaaataatgatagctaccattaattaagaaatgcttaatataaaaagacgtaaattctgacatcaaaaatataaattgttgggagagggcaaaagtcaagagtgtttgtatgagaatgaaattaagttgttatcagtgtaaaatatcctattataactgtatgatgttttgcataaaccatatggcactacaaagcaaaacctatagcatatataccaatgataaagagaaaagaataaaaacttagcactacagaaacttactagattacaaagataaaaaacaagagagggagaagggaacaaaggatctgtgaaacaaccagaatacagttaataaaatggcagtaataattctttacctatcaataattacgatgaatgtaaatggattaaattctccaaccaaaagacatagagtggctaaattgattaaaaaaacaaggtccaactatatgctacccacaagaaacccactttagccttaaggacacacataggctgaaagtaaaggaatggaagaagatattgcatgcaaatggcaaccaaaaaaaagagcagggctggctatacttatatctaataaaatagattttaagtatgaaactgtcacaaaagacaaatagggtcactatttaatgataaagggctcaattcatcaagaggacataatgtctgtaaatatatatgcacccaatctgagagcacctaagacaaatattaattgacattaagggagaaatagacagcaatacaataatagtaagggactttaatatcccactttcaacaatggacagatcaagcagatgaaaattaataaggaaatactgtaattgaactgcacttcagaaaaaaatggacttaacaaatatatacacaactttccatccaacagcagcagaatatacattcttctctagtgcacgtggaacattctccaggacgaaccatatggtaagccacaaagtaagtcttaacaaacttaagaagattggaatcatatcaagtattatttatgaccacaagtatatgaaactacgaatcaacaataggaagatttttggaaaagtcaataatatgtggaaattaaacaacatgctcctgaacaacccagtgggtcaaagaagaaatcaagaggaaaatatcttagcaatatcttggccaggcacagtggctcacacctataatcccagcactttgggagatggagatggacagatcacttgaagagttcgagaccagcttgggcaacaagtgagacctgtctctgcaaaaaataaaaaaaagtagccggtcttggtggcacgtacctgtagtttcagctattcaggaggctgaggtggaagggtggcttaaacctgggaggcagaggtttcaatgagccaagattatgccactgcactccagcctgggtgacagagccggaccctatctcaaacacacacacacacacacacacacacacacacacacacacacgcacacacaataaaaatatcttgagacaaaaggtagtgaagacataacataccaaaacctatgggatacaacaaaagtggttctggaagggaagttcataactgtaaatgcctacattaaaaaataagaaatatttcaaataataagaagaaagattttaaataagtagcccaacattacacctcaaggaactagaaaaagaagaacaagttaaacccaaagttaacagaaggaaggaaataataaaaatcagaacagaaataaatcaaatgagggatagaaaaaccatagaaaaaattaactgaattgtttattttttgaaaacttaaacaaaattaacaaacccttagctagactaagaaaagagagaagactcaaatatatgaaatcagaaatgaaagtggagacattataacagaagcctcagaaataaaaagcttcataagtaactattaagaacaattatatgccaagaaattttgataacctagaggaaatggataaattctttctaaaaccaaggttttgccaaggttgaatcaggaagaaatgcaaagcccgcatagagcaataacaaagagattgaagtagtaattaaaagcctcctaaaaaataaaagcccaggaccagatggctttacggctgaattatactacattttcaaacaagaattactacccaaacttcttaaactcatccagaaaatagagctggagggaatacttcctaacatgttttctgaagccagcatcaccttggtacctaaaccaaagacaccacggtaaagaaaactacacgtcaggtcagtatcaatatctctgatgaatattgatgtaaaaaatcatcaataatattttagcaactcaaattcaagaacaaatcaagaagattatacatcatgatcgagagagatgtatccctggccatgtaagactagcatatacaaattaatcaatgtgatactttcattaacagacaaaaaccacacgatcatataaactgatgcagaaaaagcattcaacaaagttcaacatcctttcttgatgaaaactcttaacagtttaggtatagatggaaggtttctcagcataataaagttcatttatgaaaaaccgacagctggcatcataatcaatgaggagaaactgaaagcttttcttttaagatctgctgtaaggtaagaatgcccacacttgccactactattcaacatagtactggaagtattagcaagagcagttagacaaaaaagaaataaaaagctttcagatgggaacaaaagaagtaaaattatcacgaattacagatgacatgatcctttatgtagaaaaccccaaagactccaccaaaaagctgttagatctcaataaagttgcaggatgtaaaataaagatacaaaaatttcttgtatttctatatacaaataacaacctagatgaaaaattcaagaaaataatctcatttctaatagcatcaaaaataaaacaagatgaaatacttaagaataaattttaccaagaaagtaaaagacatacactgaaaactataaaacattgatgaaacaaattgaagagtacactgaaaactataaaacattgatgaaagaaattgaagaggacacaaatagaaagatatttcatgctcatgaattggaagaattaatattgttaaaatgtctatactatactatactaaaatgtctatactatactatactatactgtactgtactatactatactaaaaagcaatatgtatagatccaatgcaatccctatcaaaatcccaatggcattcttcacataaatgtaaaaaccctaaaatttatgtggaaccacattaaaccctgaatagccaaaatactactcagtaaaaaaaaaaaaaaaaaaaaaagttggaggcttcacatttcctgttaaaattatattacgaagcataacaatcaaaacaacatgttactggcaaaaagcagacacatagacttgtagaataggatagagagcccagaaataaatccaaacatatgtggtcaactagtttctgagaagggcagcaaaaagacacaatgggggaaagaatagtctcattaataaatggtgctgggaaaactggatttccatgtgcaaaagaatgaaattggacccttatcttatatacaaaaatcaactcaaaatggatgaaagacctaaatgtaaaacctgaaaccataaaactgctagaagaaaatatagggggtaaactccttgacggtgaccttgacagtgatttcttggatgtcacaccaaaagctcaggctacaaaagcaaaaataaataaatgggactacatcaaactaaatagcttctgcacagcaatggaaacaattaacaaaaatattgggaaaaatattcacaaatcatgtatctgctaagggttaatatccaaaatttataaagaactcatacaactcaatagcaaaaaaaaaaatgacccaattagcaatgtgcaaaggacattagtatacatttctccaaatatgacataaaaatggcccacggatacacagaaaggggctcagcatcactaatcatcagagaaatacaaattaaaactgtgcaatatcacttcacacctgttaggataactgttgtcaaaaagacaaaaagacaagtgttggtgaggctgtggagaaaaggaaactcttgtatgctgtcagtgggaatatagattggtgtagccattatgaaaaacagtatggaggttactaaacaaattgaaaatagaatgactgtatgacccagaaattgctcttctgggtatatactcaaaggaaatgaaatcaccacctcagaaagatacctgcagtcacatgttaattgcgccattttccacaatagccatgatagagaaacaacctaggtgcccatcagtggactaatggataaagaaactgtgtgcatatatatatgtatatagtgtgtatgtgtgtatatatatgtacactatatatatttcagattgaagaatactccattgtgtatatacacacacattgtacaatgtgtgtacacatatatacaatggaatattattcaaccttaaaaaaggaggaggtcttaacatttgctacaacatggacaaatggggaggacattatgctaagtgaaataagccaaacacagaaagaaaaatatttcatgatctcacttatgtgtggaatctaaaaaaacaaaaagtggttagatatatagagatagagaataaaacattcattaccaggttcacggtgggagagaggaaatgggagttgtaggtcaaagaatacaaaatagcaaatatgtaggaagtacaagttgatctaatgtgcaacatgagaactatagttaatagtagtgtattgtattccggactttggttaagtgagtagatagattatagctgcttttgtcactgggaagggggatgggtaactacgtgagctgatggatatattaatttgttccactgtagtcaccattttactgtatatatatattatactttaaatatatgcaataacatttattttttaaaaaaggacagtggaacagcaaacagcagagcagagctatcacctacttctacagaatttttctgctgtaaagtagggcttttgccttggggaaaactatattgtaaacaagagcagtggaagggtttagcagaactacttcttgagtggaggaaatgactattctcactgggggttttcctgagttcttaccaagctccaatctgtcagtctccactttgagtaaggtgttgagcttctagctgtggggcgatgggaaaaagcaaggaaaacccaggcccagaatcagaattggtgtttttcatagagatagggaattggcttttgtgcagtaaacaaaataggggtcacatctgtaggagaaataaatgaaaagagatggaactttcacatttttatgttaaaataaccacccccacagtcatctaactgatgaaagcatgcctattgcttttgttttttaatgtgtatcagcttggcaggtggacacagtgtcttcttcatcttaagatcttagattagatgtttcttagttaggacttgccacatgtcatttattcataagactgatgtataaatagtttccaaggaatccttaagtgtgataatttaaaaatcaaagctacttctcagttgttacacacacacacatctgatccaaacacacactatcatttcatttgagtaggcattataacttgtgaataaggccagtgttatgactttgagctttgtgttaaccagttatttggtggtcacatgttatgctcatgaccttgactattggtcaaatgagagtggaagaaggggcagtgggcagaaccttagcttgatccaatagggagagccttggcctggaggttgagaaatttaggatctagtagtttcattcccagctggaccatttacatgctcagagatctgctgctgtggcttctttgctcatccgtaaaaggatgcacttataacatctaggtgatttctaagatctcatccacctcacatactatgattcattcagccaatagttgttaatggcctcctgtgtatcaggcactgtactgtgaatatggccctgagctggacagagagatgctgtctttcttctcctagaacttactgtctaatgggagggacagatattaaagatgtgatgatgtaagtaatcatttaaataatttaaatcaaatttcaattgtgataagtgacatgaaagagaagtacaaggtattatcacagtgcttgacaaggagacctcacctagtttgggagttcagggtaccttggagaaaatccccaaaggtcaagtctggattgagtggagcttctaagagctccactcaatatctccaagcacagagaacacataatatcgtaattttccacaaatgcaaaattaaaattgcctaacagaccaggcaaaaccaaaatggagtcagtcatgctaaatgccacgtaatcaaactgaaactttaaggaagcagacagataccctgaaagaacagttttttccctgaaaacagaacattccagtctacctgagtcagcataaatagaaagacccatctgctttaactattaccgaaaaagtaacctgtagtaaccagatgttaaccagttcctcttttttctattgttctgtctcctttttctcatcttacaaaacctactgttctgccattgcccagtgagagctctcattctgttttgtagaatggagactagcctcatccatgaattattaataagagccaagtcaatctataaccaaatttgttgtaattttgtcttttggcaactctaatgacactttatttttgcttcttcgatgatgcttattacttcctatcttgttaatttttttcacataagtgtccatttgttgcttaatttaacatttattcagaactaagtccagttgtaggttatgggactcccacaaactgagaggggaccctaactctccaggaaattagataggcatgtaagcaaatggctataatataacatgaacaggagctaaccagttaagaaaatgttgtgagctccatgagggtaggattgattgttctgcaacctttattcatttatgtattcttccaacaaatacagatatgcttcattttattgtgctttgctctattgcccatcacagatactgtgtttttacaaattaaagctttatagcaaccctgagttgaacaagtttactggtgccgttttttccaacagcacatgctcacgtcatgtctttgtgtcacactttggtaattctcacaatatttcagactttttcactattgctatatgtgttatggtaatctgtgatcagtgatctttggacgttactattgtaattattttggggcaccatgaaccacacccatataaaatgacaaacttaattgataaatattgcatgtgttggactgtcccaccaaccagccattccctcatctctctccctctcttcagacctatttcctgagacacaagaatattgaaattaggccaattaataaccctacagtggcctctaagtgttcaagcgaaaggaagagtcacatgtctctcactttaaatcaaaagctggaagtgattaagcttagtgaggaaggcatgttgaaagcagagatgggccgaaagctaggcctcttgcaccaagcagttagctaagttgtgagagcaaaggaaaagccttgaaggaaattacaagtgctacttcagtgaacacagccttattgctgatatggagaaattttagtggtctagatagatcagacctgtcacaatacttccttaagccaaagcctaatttggagcaaggcccttactcttttcagttctatgaaggctgagagaagtgagaaagctaccaaagaaaagcttgaagctagcagagttggttcatgaggcttaaggaaggaagccatctgtataacataaaagtgcaaggtgaagcagcaagtgctgatgtagaaagtacagcaagttattcagaatgtttaagatctaagataattgatgaaggtggctatagaaaacatataaggctgatgcaacaaccttatattggaagaagatgctatctaggattctcctagttgaagaggagaagtcggctgggtgtggtggctcacacctgtaatcctagcactttgggaggcgaaggtggacagatcacaaggtcaggagtttgagaccagcctggccaacatggtgaaaccccatctctactaaaaatacacacaaaaaaatagccaggcgtggtggcttgcatgtgtaataccagctactcaggaggctgaggcaggagaattgcttgaacccgggaggtggaggatgcagtgcgccgagattgcgccactgctctccagcctgggcaacagagcaaggctctgtcccaggaaaaagaaaaaaaaaagagagaggagaattcagtgcctggattcagagcttcaaagctcgggctgactctcttattaggggctaatgcaactggtgaccttaagttgaagccaatgcttacttaccattccaagaaccctagggcccttaagagttatgctaaatctaccatacgtgtgctctataaatggaacaacaaagcctggatgaccgcacatctgtttgccgcatggtttactgaatattttaagcctattatttagacatactgctcagaaaaaggattcctttcaaaatgttacatctcattgacaactcacatggcaacctaagagctttgctggggatgtacaaagagattaatgttgttttcatgcctgctaacgcaacatccgttctacagtccacggatcagggagtaatttcaactttcaagtcttattatttaagaaatgcagttagtaaggctgtagccaccataaatagtgatccgtctggtctggacaaagtaaattgaaaagcttttggaaaggattcaccattctagatgccactaagaatacttctgattcatgaaaggaggtaaaactatcagcattaacaagaatttgtcagagtctaagcctcatggatgtctttgaggggttcaagacttgagtgaaggaagttactgtagatgtggtagaaatagcaagaggactagaattagaaacggaacctgaaaatgtgactgatttgctgcaatctcatgataaaagtttaatgaatgagaagctgattcttatggatgaacaaagtggcttcttgaggtggaaactactcccagtaaagatgctgtaaacattgttgaaccaacaaggagggatttagaatgttttataaaggtagttgataaggcagcagcagggtttaaaaggattgactccagttttcgaagttctgctgtgggtaaaatgctatcaaacaacattgcatgctactgagaaatcttttgtgaaaggaggagtgaattgttgaagcaaacttcattattgtcttattttaagaaattgccacagtcactccaacctttagcaaccatcaccctgatcagtcagcagccatcaacatggagtcaagaccctccaccagcagaaagattacaactcactaaaggctcagatgatcattagcattttgtatcagtaaagtattttaaaattaaggtacacacattgatttttagacataatgctattgcacacttaatagactgtggtatagtataaacgtaacttttatgtgtactgagaaacaaaaaaattcatgtgatttgctttattgtaatatttgctttatcatggtgttatggaactaaacctacagtatctctgaggtatgcccatattcactgaatacctgttgtaatccagacgtcatgctaaacaaaggggatagaaagatccaagtgaaacaaaaaacaaaaaagagccaggatatcacctgtttgatgttcatttacacaaactgctgcttaactacacttgtgatgagtgttattttttatttcactttgtaaaatttgcatacagtacaatgtgtaggtcggaaaacttgaagtttgacttcataaggagagttcctttctgccctctttgaattcagcttccttctgtccttcacagtaaaccattcttgtgattgctaacatcataaattagttttatatattcttgaactttataaaaaatagaatagtatagtacgtagtcttttgtgtctggtttcttttattgatcataatgtctgatattcgtccacagtgttggatgaattctttcttcttttctgatgtaaacattggatactgtacatttcttctaaatggtgctttcactgcattctcctctctctcattttaatatatcctgttttcattatctttcagttcaaaatgttttctaattttccttgttaatgctcctttaacctgtggtattaaagtcttcaaatatgattgtggatttgtttatctgtttagttctgatggatttttgttcatgtattttgaaactctttttattaggtgttacacatttaggattgctttgtcttctggttaaggttatcattttatcttttagattttatcttttatcattaagaaatattcatattagtgtgaatattcctggttttgcagcagtagcttttatatggtgtatcttttttctgtacctttacttataacctgtctgtaattctggtcttgttctttttttttttagtctgacaacctctgccttttagttgaatggtttagtcatttacactttatgtaattattcatataattggatttgccttcttatatactttctctctgtttttgttgttgttgttgttcatttcttttcctgtcttcttttgagttaattgaatgtgctttagcacatcacttaatttctctattgtctttaaatctaccttaatttttggtattatcatttatcttttatatatgttataaatctcataatgtaacatttttgttttgcttttgattttgctttaaatggctatcttctaaagaaattaatgtaaagacaataatatatttacctacatatttaccatttctgacactcttcattccttcatatagagttgagtttccatttgttatttctcttcagcttaaagaccccttttagcaatttttaatttttgctttgcaagtctggtagcaataccactcagcttttgtttatctaaaaatatcttcgttttaacctcattttggaaggataattttgctggaaatagaattgtgaattgacagctaattctttttcttttagcattttaaggatgtaattccattctcttctgatctttagtgtttctgatgatatatccgccaacatttgtatctttgtatctttgttctcctgtattcagtgagtcatttttctcttctgctttcaagagttttctcattatgtttgattttcagtgtactacacagtgtgataaggatgtttctagatgcatatatatatctatatatatctatatatatagatatctatatatatatatatctgcttgctctgcttggagtttgctgacattttaaaatattctaactatatttggaaatttttaaataattatttcttcaaaatgttacctgcccctttctctttatatttccttctggaacttaaatgatatctatgttacattgcttaatatcctcactgtggctcttttcatttgtttccaacctgtaatttatctacaagtttattaactttttcttctgtactctccaatcttccattaaaatcatttagtgactgttttatttcatatattgtatttttagttcctggattttcattaaatcttttttttattttctatttctttgctgaaattctccatctatacactgattatgtttttttttaagtctttgaatatactgacaataacagttttaaattccttctctggtaatttcgccatctggttcctttctgtttcttttgactgctttttctttttaagtcactttttttttttttgcctcttcacttgtctagtaatttcttatagtatgctagacattgtgttatatgttttactgatttgtatacatttacttataagattcatccatgtaatgtaagtttaaatcaattaaatttatactaagaaatagtatagtttaaatcaattaaatttatattaggaaacaattattaaagagatgaaaaggagagaatgatatactacatagcagggcagcctccagtttgatcttgtgcattctaacattatatcagcagtgagaacaacattgacttattcattccaaaagaactacacaaggccatcttctagataaatgaaagagaaaaatgcatttctgttatagaatcttgaaatgtaaacattgtttctgaaaaccttataactttgacagcttaattgtattagtaccatccctttctaaatctatattaatgtattgatattgacaagtttaaagacaaaaagtgcaactttacagtaatgataattgataaggttttgtttgaacagtcattttattttgcaatttagagggagaaaataccattatttgcttcttccaaagttgtcttttatttgcctgtgcaaagttaccacgttagtgaccctctttttttctttgccgcttatgtgtttagaaactctggtctttttattcctaattgcatgaataatgaacaacttggaaaaactcctatatcttttccccattgccctaatttttcttgttacaacatttttttttctattgtgactataagtcttaatttgtgggtaatggtggctacagaagtctgaactgttcatttataaagtgaattctttcctaccaaagtccttggctcttttattattcttttaactttttttttttttttttccaactgggctttctcagagcctggggatatttattttaaataaatagttgtttcaaacacatttgttttaaataattcattttaaacacaatatgtcaccaatttcaattttattaaatatttcaatgaacaaatacttctgaagtttcgttttattgtttttacatacacagtgtgattgcggtgtttcagacgtcaaaaactttgtaaagggggcatttggggacaccagagcgttcttggcatatccgaaattatgctagacaaacccttcatggttctgttaattataatattcagagtcccacagtacatttccataaaacttagtgtttctttcattaagatggctgactgcagaaatcattggcagaccccagaaattacctcaggatctttctccagaaaattctctgacagtaaaggggaatgcccttaggttgttgattattcactaagaatcttgtgatccagggatttgccaactactgtttaatttttaaattaaaccttgaatctggtggcaatcccgaaagtagacaactcaccataaattttccactcttatttatgtctgttaatttacctgataggaattagaattaattcttttctactttcaagttattttttgatgtagattttcataatatacatatctccaagcatatgcctgtggcatggtaatcctaatttcttccaattaaaaattattttatgactaacaactttaggatatttctccttgttggtaataatactaataggatatagtaacaatgataagagtaatagacaccattattgataatgtgttaagtacaggcagtggcataagtccttcacagacattatttcatttattcttctccctataatcctgtggggtagatactattatctctgttttacatatggagaaactaaagattgagaggccaagtgatggacccaagttacagacaacagtggatggatgaatcacacctaagtctttctggcttcaaagaccagtaagccatattgcctcagaggaccataggttgtaacattgacctcatttttcactggacaaaatcttgtgaagaaataaattgaagatgaaacttagggattatttgaaagatctgtcaagtaattcaaaaataaattttctagaatggtaaattctgacccagaaatgcgtgaaacccaaaaaaacccctctaaattagatataataacttagtaaaaatgattaaacattgctttattattattacagatgtatacataaggcgaacagtttgtcatttggcaattggatctattctccacatagcacgtgtaatcttttaaaatacaaatatggttaagctacttagttgttgacacttgcgtgttgcttacacttagaataaaatattaactcccaggtcacttgcaaagctctgcacacctgcccaagattatgcagtggattggcagctacctccaatgttttcccttggtgtctgctctgctcctgtctcattcccttccatttttggagcccccaataggattctttttgtcccttttctgtctcctccagcaaaatataagctctgtgagagtaggcacctgacatctagtagcatgtccacaaatgtttgttagaatctgttacatccataatggtgacacagttaaaagccacaggtgattggttatcatcagagttgtgaattgttagtaattcatgaagttgtcatctgtttatttcaattagaaaaaaagctgattctttctttaaaaaatacttatagcttaatcataggagattcaattattgccgtaaaattcaaacacattttcatatactgacaggagaccattagtgaaacagctggcttttgttgttacttataataaattcatcagtttgctggttttcctcatctagatgatatttttctgccacttaatatgcaattataaatatataactatacaattaattatgaacaaggtaattgattatatttaatggctgttaaattaatacttataaggttattacacagatctatgcttataaagaaaacattttttaaattggatacaaaaaattggaagggaaacatactcatacaactcaagttgccactgtcaggcaggtgtccacccgtctccacagtcccatactcagagctatagacatggtatgtctttggcaggcagtctcttaaaaaatacaggtaggaactcagagggaggcataatcggcttctaaggatgagtgcttcatagcaaaaattgtgtgtgttgaggttctgcctgaatatttgtgtcaatcagaaagtatacttctaacgttatcatcttggaatacctttaaaagccatgagagtcagtctttcatggaaaatcctagatctgacatttcacttgttcacagcaaaataaaacaacaacagcacaaacaattgggaacacaaagcaaaacaaaacagactttcccatgctggtaggtattaatggaaggtaaaataataattttcttgtttggagtattttctttagtagccagagattctgatgttttactaatcaactgtgtgaacttgggcaagtcatatgttctttcagactacgagttgggactagtttattttctttcctgatctagaattatctgagtctttaagattctgatcttttacatggaaaggatagcaactatttttctgcaggttgtatgctcattcttttaggaaatctagcaacttctacagatatagcattatcctaagggaaataatgtctgagaataaaattacctattatctccctaccccctcaaataaatataaactttctactttaaaactgaagcaggtaaattccaaggaaagattgattggatcattcacacacagatcctgcaaataattttattattttagatgacaggggttcatgtttgttgtggtgtgtgtgtgtatctgtgtgtgtgggggggggggtgggggggttactcctgtcacccaggctggagtgcagtggtgtgatcatggctcactacagcccggacctcccaggctcaggtgatcctcccatctcagcctcctaaatagctgggactataggcatatgccaccacacccaggtaatttttacatttgtaataggagacagggttttgtcattttgcccaggctggtcttgagctcctgggctcaagtgatccatccgccttggcctcccgaagttccgaaattacaggcatgagccactgcacccagccaagggttcttttgaataatataaaaggactttttttgggtaattttaagaacttaactttcaaaccgtaatgcctgttttactctagacgttagtttgctgtctagttgaagatattaatactcagaaccagattaagcctttgctttgacttacttggaagtaattctgtcctgcatatgaatgtattcataatctatccttcttcctcagaagtttcagtttcaccatgaaatgtttttgtgtgtgtattttaaagccttttgtcttgttctacttgagattggctgaaatgtagaggtcactctgattaagaggaggaaggctgggccagaggaaaaggaggaattatagcttaaaggcgatattttttgaaatccaggtcaagaagaatgatgagccacaacacagcttttgtctggtcagaatgcctcttcgattacaaggaaataaaagatgattccttatgtctgcctctgctgtttgctgattaatattctggatgaggtagatattcacctttgaggaaatgtcttctgaaaacagaaagacacagatttgaatcttggctttttttctcactggtggtgagactgggtatatttcttacatgcctagtttgtatagttaggaagaggataccctccctacagggtgtcaggctcccacaggccagttgatctacatgaagtattaatatttggtatactgtttggtagagatgatgatcccagtttggggtaacctttattattattgtcgttattattttgccccatacccttgaaatacaaagatgttgattatgtttataattgcatatttaacctctacctcctttgtagactgtggcctccagggaccacgtctgctttcagccctgtcagcagagcttaagcacacatctggcactcagtaactatttgaaggactgaatgactcaaggaaaaagtggaggatcatctcaagagttagatatgcagtaggatgagagttaaaatacaatttgccaaagaggaaaagtgacaatgccgccagcagaattgggagtcacttccgcagtaggaaggctgttcagtctcggaacttgagccatgtcaagcctctttggaccctggtggcccacaggatggggtgtcctgtgtccacagaggggctgtgcttaaacccttggtcacacttataccctcctgggtgtgggtggcagatagaagcccccatcttactagtcagagagaacaaaagacctggaacagtttccctgtgcagtcagccagttttgggcgctaggccagctgactgctcagtttcatttcttgttgttttacacaagtacctttatatatgagtagagaaacacgaacaagagactgctgtgaggacacattttatactattgttccaatttcattaatggccttgaaggatatccctcttatgattgccacaagtatcctgctttcattattaaataccagttatttattatattctatacttctttttggctctgtgtgccaactttttctgggacctcctgagttaaaagtgacatttaactctagggcaggtagtctgagaaaatgctgtcccactgaagtttccaggagcacctccatgctcttagacatatcttagcacttacagatgtctggaatctaggcctttattcattcagctttaattttttgttttatgagatggagtcttgctctgtcacccaggctggagtgcagtggcatgatcttggttcactgcaacctccgtctcctggattcaagcaattcttctgtctcagcctcctgagtagctgggactacaggtgcgcgccaccatgcctggctaatttttgtatttttagtagagacggggtttcaccatgttggtcaagctggtctcaaactcctgacctcaggtgatccacccgccaaggcttcccaaagtgctgggattacaggcgtgagctactgcacccggcctattcagtttttgtttgtttgtttgtttgtttgttttcagatggagtctcgctctgtcgcccaggctggagttgagtagtgcaatctcagctcattgcaccctccgcctcctgagttcaagtgattctcctgcctcagcctcctgagtagctgggtctacaggcacacgccactatgcccagctaatttttgtatttttagtagagatggggtttcactatgttggccaggatggtcccgatctctttacctcgtgatccacccaccttggcctcccaaagtgctgggagtacaggcatgagccaccgcaccttgtccctattcagcttttaaagacaacattactgtcagattaaaatcagcaaaattctctttggtttagtgtcgtctatattggactttcacaggtctcatatgccccaacttcatctgcaggttttgacctcagatctcagtgacatctcctgccaggtccacttccagtctcaggttattatttgagaggagttacagaaccttggctcagattcacaaggtgtgccttacactttagactgttaggcagcatttgggggttatgaccatcaaattgaatcctcagaccaatctcaggggaggagatgtactattattgcccctacttcataaatgaccaaactgacacccagagaagttaaataaattaccaaaagtcacaggggaggaagtgctgcacctgggatgcaaaattagctgagtttgttgttgtttgttttttctgtgaccagtgggtaaacgttaggatttctggaaagcagcttttgttgatgaatatttgccacatttttctttgatctggtagtgtggagtgatgggaagttgtaataaatttggaaaacagactatcaaaggtacaggttgaattgagtcaggtaggcggcttttctgttttcttcctctattgggttacagcatggtgtcctgtagtatcaatgctattgcatctgtatttcctagtcaccctctacaatatccatgatgctctttcctggaagttttgctctgagatgaagcaagaggcacccgtggtcagatagatgctggggcagtgaatgtgtttgtggtgtgtgggaacatatctataattggcagcatttctataccaagggccttgtgtgcttcttactgtagaagacaaatctttccttgggtgaatatctttgtttgtttattgttttcttggatgtgcttgcaaaagaaatgttctagaatattttccctgaggaggaaagattctagaatatttttcctgagacttgtgacagtcggaggtgcctgatagagtgaatcagacactgttcttgtgtttgcttttgctccctctgcccttttttctattatctttcagcttaatagactaaagaggggaaagaggcagagcaggtgacacctgctcctgagccaggagggcctcaggggtcccttgggagtgtctgcggatgggattctatatacccttccagtgtggcagcaaccagctctggatttgaaaagttcacctggactccacagaggggtggggcagcggttgttgtcatatttgctttttctgggagaggtaactgtttcctgctgcacggttatcatgttgagggttgggaagcagggcatgttgacgataagaatttaatgaatgcatatgagaagaggagattcaagccactgagcagtgtattgccctaggcgacttcacgtttcaggatggtgagatatttaagggagtatatttcagatcatcatggaagaaaagatgtgcaagaagcactgggataagagcccttgtccttccctgtgtttccaacagcaggtgggcagtccaccacaccgagagccttatgaatcacctctcagttttgtccattgtccttgttcttataattcatttgtagctttaaaaatatgattaggtctgcccttgtgctcattattccatgtggcagagaggacgtgttttaatatatccttcgcttctaattgtagtgtctgcatgtcagggttcactggttggagaaaacgagccctgcttttgtaaagcagttaattgaacctggtaacgatgattgcctgcagtcccctggggtggttctggtccctgggcttcacccctcatggtggtttccagcggctaatgtgctgtgacactaaagatttttcaaaaggtaacagcaatagcaaattggagtttgtgtactacaggccctaattgcagtagtgttagtaaccttttctgagtttgtatccgtctctggtgctagggacgtttgaagagcatgtttccaattttgaaatgtttaagaaaatgtttaaggaaacagacaaaggaccagtatgaaggatatagaaagaaccccttccatatcaataacaacaatatcaaaataaaaactcatcagtatcaatctgctgcaaagaaacagtagatatataggcaacagatacgaagagtgagttgacaggagtggaattccatggacaaagaaaagatgctcaatctcattagtaatcagggaaaagtaaattaaggcagcaccattttaacaatcagttggcaaaataataatgatgatgatgatgatgatgatatcaaatgttggtaagggcctggggaaatgaggttcttgctggtatagccacactgcagatccattttgcagaagattttaaaactaaaaatgcacagaccctacgaaccagcaactccacgccttgcaatctgcctacagaaacactaactaacacatgtgcaccagaatgcggtgttgtttgatttagcaaaaattgactaactgcctaaatgtttgcctgtgtgggaaaagctaaagcaactgtggcctatccgtggaatgggacagcaggcagaaacgttattccttctagaatgaagcaattctacaggtaatggctgggatgatgcccagagaatattgttaactttaaaaggcagaggcaggattcagaattatttgtacaatatgatataatgcaagttaaaagggaaactgatcatatatattttgcatgaatagctaaatacgtctatcatgagagaggaaaaagtctgttgatgacatctgggaagggcctggagttagcagtgggatcaaaggggatatgtgccttatctgggatgcttagatttgtgtaagaaaattatttgggggtaatcaaaattgaatttaaaacatttttaagataaaaagaagaaatgaattagagggtaaatattcattggtgtctacaacttgtttataatagcttgcaacctggcattttttaatttaagcctcaggatcctacctggcgttttggggaaagtcaactgagacctgtgtgcctccctctcctttgcaccctcagcccctagtaccgtgcctggcacagagctggtactgattcgctatgctctgaattcatattgagcttggagagcaatgcttatgtggagggctttgttgactgtgggctgcaggcatgtatcagtgatcagttatcatcatctgccttgtagtcagaagtgtgcccctggcttctgattctggagagtggactctgtacataggccctggttttgaataagcctctctggtttttctgagtaaaaagtgccttagcctgtgtcagagtggggattccatcctttccagcttgatgcttttctctgacctacctggagcgttaggaactaggcccacctcatgggtctgtgacatgcccgggagcacaggctccatattcaggagggtgccatgctgggtttaatgctcttctgttgccatcttgaaattcttattttttttttttttttgagacagggtctgactctgtcactcaggctggagtgcagtggcgtgatcacggctcactgcagcctcaaacccctgtggtcaagggagcacagctcagccttccaagtagctggtactatagctgcacaccaccatgacatgctaatgttttccgggtttttgtttgtttgtttgttgggtagtgtctgtgtgtgtgtgtgtttgtagagacagggtctcactttgttgcccaggcaggtttaataatttttgaacaaggggccctgtattttcattttgtactgggcctatagattatgtaaccagtcttggttagagtgagctatgggaccttcccacagccaggctgcaaaaagaggcaggagcccctggggtgcaggtgcagctgtgaggagaagctcctagctcctggttccatgaaaagcaaaaagtgctaatgttgattgaggtacaaaaggagctctttatgacagaatggactttcgtgtttttcaaaggaggccacagaatctgttggtgtttttgccctgaggacaataaccactccctccttttgtgcctggatgtacattagctgatcacatttcctgatgggcctgagcctctctgaaggaaggctttactacatgactcctggagatgacgaggcttttatcctctgctgaataactctgttttgcattccagtcagatgctgagctgcagatggagccaggacctgggggtgggctctgtactctggggatggagcaagtggccaggaggcaacacctggtctactgtggtccactgcacttagatttctccgcactgcctctcctatccttgccattctctccctgcatcctcccatccccacatcctgtatttcccatatctgcatctctcacatcctcttcatctctgcatccccactttcctgcattctccatattcctgcatcgtctgcatacctgcatccccaaatctttccgattaccacgtttctgcatccctgtgtctctgcatcccatctgctttgctcacagagctggacgtgggggtacagaaaaaagagagaaggacccctgacctgttctgtctcctccttgaagcagcctcagctagtgaaggaacatggatttagaagtcagaaagagctgggcgcggtggctcacgcctgtaatcccagaactttgggaggctgaggcaggtgtatcgcctgaggtcaggagttcgagaccagcctggccagtgtggtgaaaccccgcctttactaaaaatacaaaaaaattagccaggcgtggtggcaggcacctgtaatcccagctactcaggaagcttaggcaggagaatagcttgaaccgggaggtggcagttgcagtgagccgagatcgtgccattgcactccagcccgggtgacaagagtgaaactccatctcaaaacaaacaaacaaacaaacaaagaagtcagaaagatttaatttcaaaggccaggtagccatttaatagctgcgcaaattcttaggcaagttactaactcctctgatacacaggttaaggataaaatgagagaggaatctaaagcaccaggcttaaaattgtttaagcatcttcccactctgctgttcatctccttttctggaatttcccatgtatccctgttgtcctctctccaaccctcagctctaccccacctgaacacctgaggataccagaaatggccaaggcagagtgggttcgggttttcctctgaaatttaggtaaatcagtgaactcacctctctctcatgatcacttttgggggagctcagatgttgcttgtgtcagtgaaccagcactgagttccagactctgaagcactaggccctgggtcaggccctaaggctagagaagggatgagttccctgccccggagcatcccactgctctgccttctaacagcagactaaagcttttggaggtctggctcaatgagtgatcttgctgcccttccacagacgtagaggggacgtacacagatgggccctttggtagcccagatttcatcagggcagttaaaatcagcatactcctagcctcagagacagtagccacctgcatggcacgttggaaattggttagtttagataagagttgagttgttccttctggtcagacagttgaatttcatgactataactcaggtgtgtgtcctggagaatttttcagatagacgtcatctctggcttacatagtggtcaagagaagaggggaggggcccctctgtatcatagattagctggttggagacagctggtagacacattattattttattctgaaggcacaggatatttgcaaagtttacttcaggcaccaaacactaatttgaaatatatatatgtttaagaatgccataaaatagcagtaatttttatagctctaagttatgttgttgttctttagccttccgtctttgttataaactgcactttagagatgtgtcataatatttgcctttccactccttttaatgggttgggatattttggaatcaattacacagtgcttttgtttctcacattaaatttaccaccagttattcccttaaatattttgaatactgaaaataatttcttaggtgacattaattatgatgcacctccctactgagctattcttccctggcaatattaatgatagtgtttcagcattcctgactggctctgtcattaatccttcataaataccagccccaattagtgtgcacaagtgaaatcagttgagcagtgaaatgtgtgtgccacaaatagaggatagatgctgtgtctgtcccttgaggaacaactgaacttgtcagctgtcaaatctgaattcttaatagttcttgtgtaaaaatgcattctttgattttttttttcattttacaaagtaatttgtaaccacagttggtggtgatgtctgtttgtaaagtcttatcctttgatttctttgcattctgttaaatcagaaaatcctttctagattcaaagataatatgctgttaatgtgtctgcttgtactgtttctacctttgtgtcttccttgacccttccttgtttttctttctcttctctctccttctctcttccttcccttctttctccctcccttcctctctcttctacccaccattctttcctttctttatgttctgcgtaccctttctgtgttttggactgcattaccagaaggcaggaacgagactgtttacttgagtatgtttacttgggcgtgaactgggatgccctctgcctggtcatttggtgttgtagagtgccagaaagccctgcacatgtaggttatctgtgcgtatctgttgatgaataaaatttttcataaaacacaatttttgaaatgtgttaacagagagcagtatttaaattagcaaacatctcggacacatgtgcttcttctccttgggtctcccatccagaaaatggccgttcatttggttaagatgtgccgggagggcctcagcatcatgcttggtgtgcactcccagttagggacccaggattatttattttcaaattaagatacttttaaaaatgaaagaggaggtattgatgattactcggacaagagctggaagccagaactaccctaggcaaatggtaggatctccagatacaatataggacacacagttaaatcttaaatgtaaatttaactgtgcctcctgtatttttatttgctgaatctggcaaccttatttgtagtcataaacacatgagccatgctccctgccagtgcggagcgtctagtctagtaagcataactccaggttactgtcctcaggcactatgctgatgatctaacatgtcacaacaggattcacaggttaataacatccccaaggtcagacaggtaggacatggtatggggaacaagggatcaggacctggaccagaaatccagctgcctacaaagcccttgttttctctgtgataccctcctccctgaccagcattgtggcagcaaggagcttcttttgcgggcttttaagagattctgcagggaagttaagagccctcaacatgatttctccactgctagattttccaggcagcaggaggcaaccagctgttttcactgtatcaaacccaaaacatgtcaggcagaaaaaatgtcaagtcattttgaaaaatgtctgaagcataatgtgcttgacaggggtgaaatagcattggccatagtcacgtaattactacctcagtgtttgtttaccatgcagccctttcttcttccacttgaattaaatcaatctgagcaacaatgtggctttataaaacccagggctcggctgcacacaacagttagactttctcaggttcttcgtaagcgtgaaacttgccaggttgactaagcaacttaacagtttcttccatgttcatatctttagactaaactcagacagacttattgaattaaagtaaatgaaggtcacctatttttttctgcaaacaataaatgttaagataggatgaggcactgggggccgagatctgatttgaatttaagctgcagccagacaccataatgtgaccatccactagatgtcgctgatgattcgcaccagtgcagctgcaagtccatttatggatgttaaaaaaagtctttaaaaatgttgggccagagttaaaaaatctggaactttgatatatttctttttttttttttcaccttttacttttaaatatcttctttgtgtccacccaaatgggccttatttctgctatcaacgatctctttctacctttcaaaatttagcaaaaaacaaattaaagagggtaacaaaaatctgccttatttaaaccatctcactctttgtgtatgttgcctttcttccaatatttttgtgaaactcctcagatgtcatttccttgatgcattgggttagtctgtattaacataatttatctagttactgtagtgttcctacatccgatgaagttgattttcctttttacagatttatgcttgatttattgtgaggaaggaaaaatctgtcttaccattggggctttgcccttgacactagtagagatcagatgcctgttgtagcccaaggagggtgaatctttggtcagcccttatggcttaaagacccaagctggtgggatgtacctggaggaagatgcgatggtttgggatggggattataaagccagccctctctggtatatggaataaattctcagttgggcaacaacaaaagcagaaagactggcagctgctatagatttccactcttaatgagctacatttttttcccccagagcatggctaatatgggataggatcctcaaatttaaaaaaggaatgttaaaagggagcaagattagctttaatcaactaaaaaaaaatcataaaactaaattgcagaaaaacttgagacccatggaaagttctcttgtaaatattataatggcaagcagtttttttcctttcctttccatttcttttctccttgtttcctttatttctttctttcttctctcgtaattttcaaatggcaaaccacctgatttggggaggagggactgggtaggtgagtgtgtctgtgattgtgaatttcggctagatcctgttttcacaggagaatgctggtatttgtagtaccctctttaagagtggtcataagcttctcagctgtggctgaggagccgttcagtgagagttgaaaagactggtagatttcctaggggttatatcatgatggtgctctgtagacaactggactgcgaatagcactttgccagactctactcaagtcccatgcctacccttggtacccagcaatatgaagccccctaaaatgtgaagtacttgtcttttgccacagatttttctcggatgttggaatagcattcacttgaggtaatttctgtttcattttatttttgaggtaatttttaaatagccttctatggatttcattatactgcagaaaatttaacatccgtgaaataagaataacgtaatcataagagggttagatttcccagtcattgggaagaaaaggctctaattccctgatgataatctgacaatctgtttagagcaatagggaatgaatgccctataaatgtgtacttgactatattggagatggaaattggaaaaaatgcagcatcaaaacacaaaacactttctgagttccaccatagtatgaattaatcatatttaatgctaattatgtccttgctgcgcaactactttctatgtaaattgtgggaaaatgtgaaaacatttacaagccccaagcaagttttacaatgagcttatatatgcggatttgttatttatttgctaggtgtctctttcaatccaaattattctgtgcagatttatcaaaatgttgtgttgctattttttactttcaaaaacattactgatatgttccctccccttcaatcaaagtgttaaaaatattgaggttgggtcagtaatacagctttcattgagttgttgagcttgttcagaattctctatgcggatattatgaagattgcccatggattatttggcttttgtgatttataactctttgtctccagaactgacagttggaatttataccatcaagtaaccagttttatatctttgattaaagttttcaactcaacacatgcagaaattggcttaatcctggacgtgatttggttgcttgatgggttttgggtattctggatcctttggatatgtctagggtctcccctgcactaagctccaaaccacttgtatccatgagtctcttccagacctgcaatgactttgacttttagactacagttaatgccttaaatatatgaagattctgtcattggagggttcctctacattttttgattattaaggaaatttgcttgacaactaattctttagtgcaataactgataacagttgacccttaaacaacacaggggcttaggggcgctgactcctgcacagtaaataatttgagtataatttttgactccccaaaaacttaactactactagtctccttttgaccagaagccttaccaataaacataaacagtcgattaacacatattttgtgtgttatatgtagtatataccatattcttagaatagattagctagagaaaagaaaatgtactaagaaaaatcataaggggcctggtgcggtggctcacggctgtaatcccagcactttgggaggctgaggtgggtggatcatgaggtcaggggattgagaccatcctggctaacatggtgaaaccccgtctctactaaaaatacaaaaattagccaggtgcaatggcaggcgcctgtaatcccagctactcaggaggctgaggcaggaaaatcgcttgaatccaggtggccgaggttgcagtgagctgagattgtgtacagcctgggtgacagagtgagactccgtctcaaaaaaaaaaaaagaaaaaagaaaaatcataaagaagataaaatataatatagaatatatttgctattaaatgaaagtggatcaatcataaaggttttcatcctcattgtcttcacattgagtaggctgattaggaggaagaggaaggcttgttcttgctgtcttgggtgtggcagaggtggaagaaaatccacatataagtggacctgctcagttcaaacccacgttgtttaagggtcaactgtatatatgtatatttttaaaattttatggttatgaaaatatggctttatttttatttattttagacagtctcgctgtgttgcccaggctggagtgcaatggcgtgatcttggctcactgcaacctccatctcctgggcggattcttgtgccttagcctccagagtagctgggattataagtggtgccatcatgcctggctaatttttgtatttttagtagagacggggtttcagctgtgttggccaggatggtctcgaactcctgtcctcaagtgaaccacctgcctcagcctcccaaagtgccgggattacaggcatgagccaccacacctggccgactttatagctatattaaaatatacatttctagctttatcaaaatatgaacttataaaatgcattgataaaattggttgtttaaacctaatgtccattcacagaggctccttagataaatttcagccatcaaaaccataagggtctatctgtggctgtaatggtggaaaaaatatacatgactgtgttttcaggcaacacgaaaaaaatcaaaactgcagaatgctttgtatttttgtggtctcattttcataaatgtgtgtgttcatagatatacatctaaaagcctgtaaatcatcagaataataggattatagctatctcaacattctgatccttctgaaccttctaatttttatattatttttattatcagaaaataaactcttttctgtctgggataaacaatgatcttgttattattattatttcagatctctcgactcactgtgtgttttcagatggtgttatcaatatataactagagcaaaaaaatgcagatgtgtttctgtaatgaggtgaattctagaatacaatgtttttctccaaaatattttaattcattttaaagaaagaggaaacgaaaaacatgctctttccctaattatctgtgattttttttcccttgaaagcaaaagtactgacatcgcattctaagtgttcagtgccagcggacccagttgatgtgtttctccccacccaggcttggttaggattctgttaaggtattattgaaacactacaaacacattaagaatgtgaggctttcagcatatgcatattgctgctgctctgtatatagatttttttcttttctaaatccctgcaggcattaattttaagaaagcctactggattcagtgtattttaattaaaatacaaaatgaatatggagtaaaggttggcactttggtcagtttccctaatatgctgtctgcattgtatcttctgagttccaatctccatgtgtttaaatgaagacccaggatgactgggtcttggtttgatgtcatggtctttttcaccatgccttttgcgtgggtcaaaaaaaaattaagtggtggaattatttttttaaaaaattcaaaagttttaaatttgggtaggctaacacattttaatcagaatattatggagatgatgttatgattccaagcaaaaaatgaacacacatctacttgccaaatgaataataaaatgactctgttgagctcaacattccaacgctggaggttggaagagggaggagtgcagctagctcatttgggaccatgagtgttgcttattgcagctatgactggagggggatttatgtacttgtccaatgtctaggtctctttccagtgtagactctatcaggatggagacagcatctgttgccttctttgttgatgtaactacagggataagccagtatctgcagctaaatagacatttgataaataaatattgaatacatgaatgtattctggaaatagagctttcatcttcagatatgtctgtcaagaaatagctttcctttgatcaaatattcttttggcttttgtaaaattaaaatttgaattgtacaaagtaacacctgaatccatcctccttggacaacattagaacatgactgatatttctggttccagcaaaggagtatctccattaccccttgcttctccctcttgtaactaaaaacatttagatatcacataacaaatgagcgtaggaagactttgaaagatgggagaagacagacggcctgcggacctttgcacttgaggaagagcatggctgtgggtcctctgagtttccttgttacttctcacacattatgaacagagtgctccagaagcctgccacctggacctctaatgggtacagactgcaagaaaagcctgttcctcctagacaaaggacgaggaaaagggtggcctaatagcataaaatcttttgggtgatattcacccagtagcagccaaggaccaatggaaatactaattatccaaccccctgaaatgatcttcgcatgctcctaactagcagaagcaagcagcattgcttccattcccccacctggtggtgtcagcggaaatgagcaaggagctaatcgttccttgcctgatggaagcagcagcgctccggttctcccactgggtggtgtttgcatggctgagcaggaacccaatcttccatttcctccttggtggaagtaggcagtgctcctgttcccctgtcagagtactgtcagtgggggccactagtgaaacgagcctccactcctgcccagcatcagcaagactgaacaaggcaatgcaagttgggggtagtcagctttctgttttcttccattctagtggtgagctgtgcttacactcccacccagcatcatcaagactgaatacggcgatgaaagtttgggctatcaacattccttctcctatgccgatgaggagctggacctccacacccacccagcagcagtgagactaaatgggatgttgtaaagcagagctagctatcattttgattttggcccactcccagtcccccaccagtgtcagtgggacccatctggcatcagtgagactcatcaaggttgtcttgttcagggcttttgggtggtcccagttaactaacctccccaaggacgatatttcttctttggtttgatttgcatcagaggtgagtcttaggtgctgccatctgatgcgcaggcagcttattctggcagtcctctgacagcatgctcagcagtagcaggctggtggcctgggccagacacagtcaggggtcaggcccacccaaccaggagggtctccatctggagaccattctcagagttgaggggattcttccccctttcttatgcttgtattcagtccaggccagtttccaagtgtttctttcataaagaaagtttaagctattctagtaagggtaagcttcgttttaaggtttatgaaagttgcatctgtgctaggcggccttatctttagggtaaccaggatttataggtccagttgtcatagagacccactaatccctgggctaggttggaaatccccaggccaggtttcatcatacttctaatggacatgtagtgtaagcccagcaggatgtttgattaggcctatggctgacattaatcctataaccacagtatgccttttatagtatactacaaagttgatgggaggtagggctactcagtctccccagccccagtgtgagtgggactcagtgggtttccactctacctagcatcaatgaagtggaacaaggtagtgggaaacaaccagtcagcactccactcccctgccctttggggtcagtaactcagaatggtcctagttctgcagggagagaagcaactttcgtatgcattctgcaccaacaaagattgtgtcatctctccgatcctgcgtgcctctggtgttagtggagtcccatggggagctgagcttttacctgaactcagctctaatggggagctgagcttacacccctgcaactcaggtgatgtgaattgtagccccatgttcactgggaagatgtcagcagggctgaggggagagctgaacttccaccccatttaaatgcaataaggcagtgtgactcagtgctccacttttgctaaggtagtgttgacagggcccagtgggaagctaacgtacactcccacccagcccttctgccacaccttggcagggggaatgcctgcaaaatgaagagatgaaatagaatccagagtcccataatgtaatatccaaaatgtccaggatataataaaaatcactcaccataccaagaatccagagaaatcataactttaataagaaaagacaatccacatgaatcagtaatgaatcagatgttggaattatctaacaagaattttagagaagctattatataaacacttcaagaagcaattacaaattctctgcaaacaaatgaaaattagaaaatcttagccaaaaacagaagtaatttaaaagagaaccaagtggaaattatagaaatgaaaaatacagtcaccaaaattaagaaaaaacctcacgggttacacttactagtagagtgggaacgacagaggatagaatcagtgaaattgagaacagatcaacagaaattatcctagaatttacttagtttgaaaaacagagagacctaaaggatctttggaataataacaaaagaactagattcacatcatctgagatccagaaggagagaagagaatgagaccaaaaaataatggctaaacaaacatattaaaaaaaactcatcatcactggtcattagaaaaatgcaaatcaaaaccacaatgagataacatctcacgccagttagaatggcatttattaaaaagtcagaaaacaacagatgctgttgaggctgtggagaaataggaacacttttacactgttggtgggagtgtaaattaattcaaccattgtggaagacagtgtggttattcctcagggatctagaaccagaaataccatttgacccagcaatgccattactgggtatatacccaaaggattgtaaatcattctactataaagtcacatgcacacatatgtttattgcagcactatttacaatagcaaagacgtggaaccaacccaaatgcccatcaatgatagactggctaaagaaaatgtggcacatatacaccatggaatactatgcagccataaaaaagaatagagtccatgtcctttgcagggacatggttgaagctggaagccatcattctcagcaaactaacacaagaacagaaaaccaaacactgcgtgttctcactcataagtgggagttgaacaatgagaatacatagacacagggagggcaacatcacaccctggggcctgtcgggggtggggagcaaggggagggagagcattaggacaaatatgtaaggcatgcggggcttaaaacctagatgacgggttgatacatgcagcaaaccaccatggcacatgtatacctatgaaaggtatacacatcagaagaaacaagacaattatacttaaagagtgaagaggttaaagggacctaaatgcaagtaaggcttctgcacttcattagaagtggtagaacatctgttacagtaggctccaataaattatgcgtacatattgtcacacctagagcaaccactatttcaaattggtaattctcctttttggcatttttcaaatcatggtaatacacttgtattccttccaaaatgggtagtattggcttgtgaggattttacctaaatggttacatactctacatggcattctgcaatttgcttttttattcaatagttttttcaatgagccgtcgtaacgactgtgtttgctatgaatgcaccacttcatttttctgtccctttattgagagacctttttcaagacattttcccagacttaagccattacaggcaatgcacaatgggcatgcttgttgaaggctccttcattccatgtgtgtgtttttggttttgaatttttctaagtaaaataaaaccccttgggtattttcccgtgtgttgtttccttggctcattctggcccatctgttaagtcaggttcttgcagctcccacttaggtgggaatagcttttctggaaatgtgagctctaagagactcagatgcattcctgcattatggtaggccttcagccaaggggtgccgatattgccagtcactcctcctagacctcaaggatgttcaagaaatcttttcataatgtccaaggagccctgattacacactgatccatatctttgaggatgcctgggaccacaaggaaattcacttttttaccatcttcctttcttcactctctttattcattgcagcatggatgaacatgaactcttgcatttttctggtcaaacatgatggttaggaaaccaagtggatggtgaccagaggtgccaacactgcagtcaggtaacaaggaagacagacactcattggctgagagtgtttgcagttggtgcactgtcacatggcagggggtgggcagacagtatggatgcttagcagttctttgatgaggtaggaggatgatgcatagatagagatatttacacagtgtatatatgagttctgtagaggcttgtttaatgcagatattagaaacaactagagttataaaaaaaactaaagtttctctgaagatgaaggcttgttaactccatgaaaagggttatagaagtgcagaagagtcactcctttataattactataatgctctttgcatgaggaaaactggttggtttctaagtgaatctttcttatagctcccttgtgggctacttcctaagtatgaaataattcattttaaaatgatatgtgaagtatgtaaaataattgtaatataattacatagtgaaataatttagaagctgatatgtaaggggttttagttactaatttgtgtttcatgatatgccttaggatgggtgatttacctttaccaaccaaaataaggaccacgaagacttttacaaataattgtcagttccaaaaaccttcctgaaaaagtgttgctttgggaaatcaagatgacctttcatggcagattttagagcaactccctgggcgatggaaaagctctttgagaaatcaaagtgtaattaatgcacatttctttgtttaaaggaacgactgaattgaattattattaaaagcatataaggtggcctgtcttttgtagctagggcatttagatgactaaattatgacaaagggagtattgtatttatcagctattatcattctaaatttgcataaaagtaatcataatagtgagagacattaagtgcattaattatccattaaaggggtaatttaacaatcattaagggaggcactaatagattggtgatcatctttacaaatgatgtacttgatctaagctttatataacaccaaaagattaatctgccatttttactttggtagaatatacattttgttttagttttctggtagcttctggtaagaattgaatattggaatgaatgagcaagcatacattttgtacctcctataactctgcagaaggtatgtgggaatacaagtgcccaatcagtcgaccaggtgtggattgatcaccttggctggatggatttcatttccacctgccattttgagaaaccttgccattgtctcaagagcagcagctgtaaaagcagcctcactgctctcctcagtgtccctatcccattgatcctatggcagttgggggtgcccacctcccatcttcgggttatcacagctagcagcctagagccacgtttgtccagctaatctcatgtcttattttgaaatattttgtctcctttgaggttactgtgcttgcaaattaaggaaacccactcaagctagcctacataaaggagggtgtgtgtgtgtgtgtgtgtgtgtttgtgtgtgaagatagagaattagctcatggatctcaagggcagcagaataatcaggcctcctgagggcttcgggcagggaagaagagagttcttagcaaccaaggcagtctctgtcacccacaagcacttatggctttcctgtcagcctctttgcagacctggtttctctgctgtgccagaaagtgactcctgccccctgaatttctgtgtctttttgaggccagtgctggcagtccatgggctggagggtttgagtcccactcccagatttttaggagggagaaacagtgggtggctgtgttttcgtggtgctaccacgcctggttcaagaagccatggccaggggacaggcttgtgtcataaagcatggcttgggggaggcagtcacagaggaggcttgcccttgacctctaggaaatacactttcctcatgatgggagactgagtcctcctcacacatcaggaaagggggaaccagctctcactgttttccttccatcccgtctgccctctttccccctccctgccccacaactgtctgcagtgcttctccaatgtgacatttatattgtgtcaccatcacatttaataagctgaggttgttttgatactctgatacccacaaatccaagtgtcctgcttgtggtcaggtgttactctgacgttgcctggccagcctagcattcagtcacctatggaccatcccagcacccagcagggctggcttgtgccctcaccctttccttacccacacctttacccactccttgactgggatgccctgatctctctcctctctagtaaaggaggtccagcccagcccagtggacctggggttagccctgtaatgcatgaatggttatacctaccttaaaggattagtataaatgccacccagctctgacctttctcctgtgggctgacagctgtgttaggagggatataagcagtagtagttgtttttctttaaggctcagatgaaacccaccctctggaggaagcccaccctaaccatgttcttttctatcttcaaactgcttttattagcaaacaactattctgtaagatgtactggttgtcctgagctccctttctgaattgcagacttttcaagggtaggaatggtgtcttctatttctttttaaaaaaattatttttatttttattatactttaagttttagggtacatgtacacaacatgcagcttagttacatatgtatacatgtgccatgctggtgtgccgcacccattaactcgtcatttaacattaggtatatctcctaatgctatccctccctgctcccctccgcccacaacaggccctggtgtgcgatattccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagcattccatggtgtatatgtgccacattttcttaatccagtctatcattgttggacatttggcttggttccaagtctttgctatcgtgaatagtgccaccgtaaacatacgtgtgcatgtgtctttatagcagcatgatttatagtcctttgggtaaatacccagtaatgggatggctgggtcaaatggtatttctagttctagatccctgaggaatcgccacactgacttccacaatggttgaactagtttacagtcccaccaacagtgtaaaagtgttcctatttctccacatcttctccagcacctgttgtttcctggctctttaatgattgccattctaactggtgtgagatggtatctcattgtggttttgatttgcatttctctggtggccagtgatgatgagcattttctcatgtgtcttttggctacataaatgtcttcttttgagaagtgtgtgttcatatccttcacccactttttgttggggttgtttgtttttttcttgtaaatttttggagttcattgtagattctggatattagccctttgtcagatgagtagattgcaaaaattttctcccattccgtaggttgcctgttcactctgatggtagtttcttttgctgtgcagaagctgtttagtttaattatatcccatttgtcaattttggcttttgttgccattgcttttggtgttttagacatgaagtccttgcccatgcctatgtcctgaatggtattgcctaggttttcttgtagggtttttatggttttaggtctaacatttaaaaatgtctttaatccatcttgaattaatttttgtataaggtgtataattcattgcactcaacactcatttcttcatcattaaacaaatgtgttctagttcaattcaaaaaacatttctaagtgccttttatgtgccaggtatcattcattgaaaagattatccgttacccaacaggggcccatgggctgaatgaataatgacgaatgatatatttgattggcatggaaatgacacagaaactgtcatattcaagtctctacttatgcattgttttatactggctgttgaacaaagaaaaccacaaagacctgttccctttgctcaaatatgcttaaataatttaaaactttttttagagatggaggtcttacgactgtgttgcccaggctggtcttgaactcctgggttcaagcaatcctcctgcctctgcctcctaagtagcaaggactatagatgtgtaccaccgtgtccagctcatacgcttaaattgttgatatggacttaagtagtggctatatctagtggtctctataggataattcacagtacccattccatctgccttctcccttgcctcattccccttgatctctcagcctcccttgcatctctgaatgctcatgtggcctagttttggccaatgagacattggcagaagcttctagagaatgcttcttccatcacataaaagcatacattttataaagagggccctttactccttctcccttcctttggcctggagcacagatgctgtgcttggaggtgtagcagccattctgctactatgaagatgaaagccacagactaaagatggtgggcttggaagatggaatctggtacatcaatgatgtgcttcaacagctccactttcccttaactgtccacttgtgaacatcattatccttgagaaaaacaaagatcttacttgtttaagccatggtggggtggcttttctgctccttgcagctgaacgcgccgtcaatgggctgatattcatgtagcagcatcaaatctttagctgaagagtgataagaattcatgctgtgtggttcatgtagcttaattcagtagttccctaagtcagcctttactcatccattaatccaatcaaccatctaggtgtccattcaatatgtgtgaacaggcgaagggccctgcctatgtacagcactcagccaggtcttctgagaaacagagggtcctgtcgtacccgtcgccagcctcttcatgagtcgctatttgagatgagggtcagagactaaatggggacagaactcaagattttggttgcttatgaaacccattccaccatatagtagcctcttgggaatttatgccccacatctccctgggtctgccttgtctgtagaaatggctgttaatacctacctagaagagggggctaaatggaacttttaaaggtgtaatgtactggaaactcctggctcacagtaggtgctgaataaagttaatggagaaagtagcaaagggaaactcttgcagaacaacaccttgaataaacttctcttattttattggtgaaagagacaacatatagtcgggggatatggggcagctttatatgccagaagcagcctctggggaattcaggctagaccaggaattcttccatacagccagccatttgccttttcctgtggttgtttagttttgtcatatgaagtgtatgcatgtctgtgtgtggtgggtgggcgggcacagtaatgaggcaaaattcactttaggcagcgtcttagattgtggtacatttgttgcaaaacttatgattggcaggttgcagtttctgtatatttggatccccatgtaaaattgctccttgtccatagctgttaattcttttgggcttcttcactaggaagaattagagagttggcagggggacagggcctcctggattgggtatgctttcttcctctcacctgacatgtccaccaagtgttttcctggtggagcagacagatccttggccgacgaccctggcatttgctctgcttcccatctgcagacatgccggtggggatttggcattccttcctcactgggtcggctacattgtgttcagccttcacattcgtctcttgccatgtcttgtcttgaatgcagatagaaaaacttgggaaggaaaacaagtttcacggtttcttcctttgatttgagtcatcggtcatagatcaaagtgaccgcaaagtcatctttgctttgtagagttctattgcaaaacatgctgctgttttgttttgttgggaagggcatggggaggatttggcttttatttactctgattctctttgcttctggacttcctcattgtgttgctcaacatttgcagcgaacttgaaagcaccaggggatggccactatatcccagcaaggcaaggaaggagtggagacccgggccacattttgtttatcaaaggcaatgggtatgacaccgcatttcccccttatctatttccttcttcttttcagcacttcccagtgaatttccttggttgaaaatattaaccaaggtgcccagctgtctcctagccagaggggacctgtgatccaaacctggcctgttagagtctcccaggaatttaatttgaggaaaatgtcccagacacctttttttctagcatcttccttaccacattaatgagcaattcctgcttacttggaaattcagggtggccctagtcccttatttctcaagtcttggttctccagccttgttgattctgtgaggtcccctgtgtgttttcaaaacattccctgttagtttaagttgccataatcagtgtcttttgcttgcaaccaaagaaccctggtgatgcagtgggccttttcataaagtggtcttgtgatgtggtgggccttttcataaactgctctatttttggtttcttgtacttttctctcattttgcccatggatggctacctcctgatctgataaagaaatcaaggaggccacataacatgcattagggccatatcatgtcaaacatctcctctctagaggcacactcagagctgccagcagcatgtagctctcacttttctcagttttaagttaatggttagtctgaattttgaggccctcagagctgtctacttctgaataacatgactataggagcttatgagtccttactcagaacttggctcatcactcagtactacttttaggatttccttattagaaaaccaaattccttttactattgctttagagataaacatccgctttcttggagaagactctgcctttgcaagtgcagctaaaattctacaccctccatgaagccgtcttctcatttctaccctctcccaacccccttaaacagagtgagcctcttcctgccatgagggagtctcagtctgatttaaatgtactggagaatgcagactccagagcccacctgtaacaggcaggtagcagatgcatgtcaagtcaaccaggtgtccaatgacaaatggtagtgattatgagcctcggctcagggatataggcaggggatggggctgggacaacccccctctaaggtgggccaccatggctctgcttcagccattggcaccctgtggaaagctaggtccactgttgccacagctggaaacccagatttggaaacgaaccatctcatttctttaaaaaatgttggcaatgaattgaaagttaaaacgctgatacttcactactcaggccgagcaaaacatgcctgcaacatgagttcagcctggagtcttgagaattcttaaccttgaatactcttaggaaaccatttctgagctgtattaattcatagataaaagcaacttgtaagagagcattcatagaaagaataaataaatttgtttttgtacatatatatgttcatacacttattctatgtatactttttatttctatgtatacacacacacacacacacacacacacacacacactcatgtgaagaaggagaaaatggagcattcatatctttattgccagtgattatatctaggaggggaggaggtagggagtgttggagacttccaatttttgcatcacatttctgtaatgtgtgagtttttagttatagacataccttattttggtagtcaggaaaaacagaaaggatccatccaacaaaaacagaaaggaggggatgggccagcagttctgtgcttatgcggttacttccagccactcccttgttctaggagggtagatgtttataagacctctcatgaacttgtctcagagctccctgaaagaggaactgctttgttcctgtggtctctccagtgcctgtcctaaaagatgccctagcatataggtgactgttggagtgtggactgagtggcctgaaagaatggatgaagcaggtgtacatagctttggcaatgaggaatccaggagtaggttggactgcctgtgggttccatccacacatgttcatagaagaagagaacatgttttcggggagatgtcttttcgtgttttgctggaagatgtctttcctaacctgtacttttacaagaggcttcaatttcaacaaccttcatgtctcctaacgaatatgctgtctttctttaacatccatatgtgatagaatcagtgcctttatgtgttcaggttctcagttttcaaatgttggccaatttggtcaagaactttcatgggggaaaatccatagagcatagagagggaggacctccctctgcacagatgggtctactgaaacctcccaagggatttgcttagataaggacccacaggtggtgaagggcagagggaagaaaagaagtaaggtgtctgggcccacagataaagctccttcccacactatgctgctgccttttctttaaaaactttcagaaaagaacaatggataatataacaaacatcaagattaccacccagaattgatgggtattcaccttttatcatttttgctttttttgtgtcctttttttcccttaaggagtactgcctctttttgatcaaatcatatttggggtatagtgctaatgatgggattcctaaatgacatttaagcaagcctcatgatgatggtgtctaatccctctcagaatctagcctgaggatgtcgttttcatctcctgacagcgctggcagtgcacgatatctgacatatctgccccagcatgcccttccctggcctcccctccctccccactgaattctctgcacctctgactctcctggaatttctgaggcagttggtatatggggcaccaagtgagtgtctctgaactctccagctctccgacaaggcctcttccaaattgtgcatccttcaaggtgggatcccggaggcgggtatcctagaaggagcgttttttaagtgaggcattgacatcttgttaactacataataggcacttttttcagccaacaaaactgtccatgttttcaaatgttgtggaccaggcgttatgagctcagcttcctttgatcagtgttacacaacttttctgagtgctaatctgtttcaattcaaaatagatgaaaaccaccacatgcatggcagctgcaggtttttgcttttcttaaaaattatctattttaaggaaagaaaatctgagaaattatattgtgatgggtgaaagtattaacgatgaatttgttgccaagaagattaaaattgagaatgtatgaaaagaaaaaagaagaaaaatcctggaagagcaagttgtctgaggcaaacatcaggagtttcaaggctatttcaggactggttcaagcctaagaacctcaaatgtctgtgagaggaagtttccagaaactaaactctttccagtgttttgtttttgtgtcagtcaaatgttgtatacacagggcttggaggccagaccacagaagtggtctcatgtgatgtggcagggcctttgtggcctcagagccaggcagagcttttgtttatttagattcttgttggccttgaatgatggcaggaggacagtcatctgttgctcctgctgacattcaggcagggactgcttggttctgttaggccacagttacacgtcaaagcaaatacaggccagagatcctgactttcctgttcttttgaaagtgatgctttggcagtgggggaagaaagctgcaaggattagtcttgtcttgacgtgtattgctgtgagccaacctttgggctcttttagatgacatttctggccattccaggatggtaattttaatcttgtcctttgtcttggtaatggatttatgttcttcaataatactttgggagagagttccagaaagaactaacaatagaaaaacccgtatttagtgatgatatcagtgggaagtgacagaaaactccacacaaagtagcacaaccacgagggaatttacgaaaagtttcaaggagacatctggcttcaggtaaggatgaatccaggggctcagacgacaccagaatcctacttttctgcatccatagttcagtctcgtcttcctgggctggtccattctcaagcaagctgaggtgctgcagtgccagcctcacatccttccagatccaagcccagtgggaaagaagaatctgcctccctggcagctcaacataaaggtctccaaactgaggctcattgcctctgaatggcctgaaaaattagctaagacctatgcccagctcagagctaatgggagtaagtaggtgagtactggctgctgaggcctggatcaagagcagcaggaggagccatctcctctagttctgtgttttagaccctgtttgatccaggaatccaaacaatgtcgtcaggacccaagcactctcactctgtctctgtttcttcctcccctgggttatattcccatcagttcccccaaacgaaagtaggagagacctggtttcacccaaaacactggaggatgaaacagaggtggggtgagggatgccagaaggcccaaatctgtaagtgtcccttacaaaaaagtgtcaatgtgctaacaagtggaaaaacgagtcagcagccttcatgttctcattagtgtcctattgtctccacctctgtgggcaccaataccccatgattaaaccactctagacctctattgtgtttgtgaacccagtggacccagctgtctctattgtccagaactctggtctttgtgacaggtgcttcacttatgcattattatatcattacaatgtcttattttcacaactgcaaggcaaattgcagaagaacatttggcaggagagccataaatcgtttgtgcagagataggttcatcttctgttattttgtgtctcttcatgtcttggattgactcaagatgaatcaaaaaatgagtactctggaacaatataagactttgtcttgaatttatttattttagaatggttaatgtcattcaatcaaccctcagtgaaagacaagaagtagcaaactactttttaatgtcatcattgaactgtagttttgaatctccagttctgtaggttaggttgcaataatatggagtaaagaagctggatccaagaatcaatacgtgttctgctactaatcacactccattaatacctcttatagagtgaatggacaaaccacaagagagagagcgctctggcttcatttgatacaaacaacataaaaggaagagaattgctcttgttgactaatattgaagaattggctaaatacaggaatttatctctatgtgtagctgaatacttagggcaagacaagtttactccatttaagaacatagtgtgttcacttcatgtttacaatgaaaaatatttgctaatttggtgttttaagttttgtttcaagtgtggttttctttatattaattaaaatataacctcatttgccaattttaagtcattctgtgatatggtttggatctgtgttcccacccaaatctcatgttgaattgtaatccccattgttggaggtggggcctggtgggaggtgattggatcatgggggaggtttctcatggtttaacaccatcccccttggtgctgttgttgagatagttctcatgggatctggttgtttacaagtgtgtggcacctccacctacctttttgtccctgctctgccatgtaagatgcctcactccccttttgccttccaccatgattgtaagtttcccaaggcctctccagaagcagaagccactgtgcttcctgtacagcctgtagagaagcaaggaccatttaaacctcttttcttataacttacccagtgtcaggtatttatagcaatgtgagaatagactgataccctttgtatctaaataaatatatgtccacaatctctactatttgtcccgtcttttggatattttttatataaatgtaataattggaaacaccagttgtttttggaagaaataattataatatttaagcaatgtaatacttttctcacccgttgtaagctaagtcaatctacaaatcaggttcatggttcacagtttgccactgattggctctggggaactaggtgagtctctgcctgtattaatttcctaggaccttcataacacagtgccacagactcagtggcttaaaaacaacaggaatttattatttcatggttctaaacgatagaattcacattcacaggtacctagggttaggacttccacatatctttttgaggggacacaatttagcctacaacatattgccttttggcctccaaaaattcatatccttcctatgtgcaaaacacattcaatcccaacatctcttcacatcttaatccattccagcatcgactcttaagtccaaaatctctgctctagtttgaatgtttgtcccctatgaatctcatattgaaatttgatccccattgttggaggtgaggcctaatgggaagtgttggggccataggagaggatccctcatgaatagattaatgccctccctggttcaggggaggggatgagttctcattattagttctggtgagtgctggttgttaaaaagcgcctggcacctccccggccctctctctcttgcttcctctctcagcatgtggtcactgcacacgctggctccccttcaccttccaccatagtggaaggagcctgaggaacctcttctttataaattacccagccttgggtattcctttatagcaacactaaaggaactaagacaatctcatgtaattataatcaactcaaaaggtcccacatctcatcttctaactcatttattcaggtgtcagggagactcagggtgtggtgcatcctgggacaaaattcctctccatttgtggatctgagaaacaagttatctgcttttgaaatacaatggtggaactggcataggatagacattcctactccaaatgggaggaattggaaggaataaaagagtcatggataccaagtaggttcgcaacccagcagaacaaactctactaggctttaaggcctgagaatcattctctgtggttcaaggctccaccttctgggtaccaggtggcaacctcaacctcttggccctgccttctctggcttatgaatctgtgcccctgacgtcagattcattcttccttcattttatcctatgtctgtccctttctgctgatataataatcttttttttttttttttttttttttttttttttgagacagcctcttgctctgtcaccaggctggaggctggagtgcagtggcgcaatcttggctcactgcaagctctgcctaccgggttcaagagattttcctgcctcagcctcccaagtagctgggactacaggcacacaccaccacgctcagctaatttttgtatttttaaaaccttgttagtcttctacaaatgtcaagtggattcatgccattagacagaaagattcttcacagatttttcctggataatcccatctctattccgggcttctctttaggtgattgattgggttcacgagtcacatgcctaatctctccataggaagtgtgtacagttacgctcttggtgttctctccagagtgtgctatcgcattttttgctaactggatagactgaaaaatttcaaaatcacgaagtgtggatttctttttgattaacaattccatcctcagtttatcactttcctctcacatatcactataagcagcaaggaaaaactaggccacaccttctgcactttgctttcaaatcatcttcaaggtcatcacttataagttctgctttctacccagtggtagaagataactcagccaagttttctaccatttgataccaaggcaaattttataccactctgtatctcaataaatacatacacacaagctctaggattacctccagtgccctttcctcctgcatcctccagtgtctaacaactttcctccagtgtccaataacatgttcataatttccttttaatgcctcactagaagtacctttaaacttccttttactagcgacattctgttcatgaaaatatattgtattagtctgttctcaggctgctaataaagacatacctgagactgggtaacttatcaaggaaagaggtttaatggacctccagttcagcatggctggagaggcctcacaatcatggcagaaggcaaaggagaaacaaaggaacatcttacatggtggcaggcaagagagcttgtgcaggggaactcccatttataaaaccatcagatctcatgagacttactcactgccatgggaacagtatgggggaaattgccccccatgattcagttatctccacctggctctgcccttgacacatggagattattacaatttaaggtgagatttaggtggggacacagccaaaccatatcacatgtgtcttctgtaagatgatagtagctctttctacagttttctttctgaactcgcactggaattgtctttaatgtctgtatttctcccagcagtctctttaaagcaacctaggctttttctgtcttgaatctcaaaattattccattacccaatccaaagccactgccacatgtttaggtacttgtcacagcagcacttcacttcctagtaccaaaatctgtattaatttcccagggcttctgtaacaaaataccacaaagttgtggcttaaaacaacaggaatttatttcatggttctggaggcttgatgtctgaaattgagatgtcagcagggcgatgctccctctgaagttcttgggaagaattatcccttgcctcttctggcttctggtggttgctggctgtccttggcatgccttggcttcctgctgcatcactctaatttctgcctccctctccatgtggtcatcttccctcggtgttcgtctgtgtttctatgtcttctttttttctttctttctttccctctctttttctttctctctctctttctcctctttctttctgacagggtccctctctgtcacccaagctggagtgcagtggcatgatcacagctgtctgtagcctcagcctcctgggcttaagcagtctccctacctcagcttcccaagctgctgggaccataagtatgcaccaccacacccagctaattttttgtattttttgtacagatgaggtctttctgtgttgtccatgctagccttgaatttctaggctcaagttatctgccctccttaacctcctgaagtgctgggattacaggcatgagccactgtgcccagcctccttttcttataaggacagcggttatattggatttagggctcaccataatctactatgacctttaattgactttttacatctgcagagacccagtttccaagtaaggtcacaatcacaggtacctgtgggtaggacttcaacatatcttttggggggacttaattcgacctgaaacaccatccctctcaggactttctgcttccacatttatacaaacgagatctttttggttgccattaacagaaacacagctcaaactagcttaggcaaaacgagcctgttttggctctcataagtgaaatattcatgggtagttcagatttcaggcagggcccagtccaaggattcaaacaatgtcttgctcttgctctctctcttgctctctcaattccttcttcctctgtcttggtgttactgttaggtaagttgtgtccatgtggttgtccccaccagttcctcaactgcttatatgccagagaaaaggacctgtgttgtaataatatttgcacaaaagtcctgggccctcccattattagttcgagctgtgcaaagtacctgtccccacatgttggggagatcgattttattgtgtggtttatgcataagtcacatattctctactggatccagaggtgcaatcagtgacacccaaaccacatgagctgaaatcatggaaattagtgtatagttagtaaaagaaggggagagccttctgggcaggctagcactgatgtccttctaatttgttaggtggaaaggttgaactagcatgtctctaatatcagtactaacagtcctatgaatctgcacacaccctccactgattcttggccaagtaattatatgtggtagccctaactgatcagtaaaacactatttcataagatgtttctttttaaatttattttttgaggactcaactttagtaaagtataatttgcatcaataaaattcatacactttaagtgtacaatttgatgaattttgacagatgcattcctttatgtagccaacatcaaaatcattacaaacgacatttccctccctcacccccaaaagttctcttgtaccccggtgtagtcagtctcctcaccccattgcctcactcctggcaaccactgattggcttttattattataactttgcatatggtatttcaaaaattatcatttataattgacacataataattgtacatatttagggggtaccatgtgatgtttcaatacatgtgcacaatgtacagtgattaaatctcggtaatcagtacatccatcacctcaaacatgtatcatttcttcatattggaaatgttcaaaatcctctcttccagctatttaaaaatatacaataaattgttagttatagacaccctacagtgctatgaaacattagaacttattcctactatatggttgtatgtttgtatccattaaccaacctttggctatccacctccctctttccccacctctaataaccattattctactctctgcttatatgggatcaacttttttagcttctacatatgggtgagaatacacagcatttgtctttctgtgcctggcttatttcatttaacataatgtccttcaggctcatccatgttgcagcaagtgacggaatttctttcttatttaaggctgacttgtatataaatgtgtatacattccacatttgctctgttcattcatctgttgatgaacatgagttgcttccctatcttggctattgcgaatagtgctgtgataaacatgggggcgcagatatctcttcaacatactgacttcctttcctttggatatatacccagtagggggattgctggatcatatgatagctctattttgagttttttttgaagaacctccatactgttttccataatgtctgtactaatttacattcccaccaacactgtataagaattcccctttctctgcctcctcaccaacatttgctttttttgtctttttgatgataaccatcctgaggtgagatgatattgtggttttgatttgtattttcctgttgattagcgatgttgagcattttttaacatatttggacatttgtatgccagattattttgagagatgtccactcagatcatttgcccatttttaatcagattatttgtttttctaatgttgtatgagttttttgtataataatccattttagacgagtagtttgcagatattttttttcccattttggaggttgtcttttcactctattgattgttttcctttgctgtgcagaagtattttagtttgatataattccatttgtctatttttgcttctgttgtctgtgcttttaaggtctttgccataaaatctttgccagatcaatgtcctgaagcatttctcctatggtttcttctactcatttcataatttcattttaagatttaagtctttaattcattttgagttgatttttttctatgtggtgagagatatgggtttagtttcattcttctacaaatgtatatccagtatttccagcaccatttattaaagaggctgtcctttcgctagtgaatgttgttggcacctttgtgggaaatcagctggctccatataactggatttatttctgggctctctattctgttccattggtctatgtgtctgtttttatgccagtactatgttatattttgaagtcagatagtatgaagcctccagctttgttctttttgctcaggattgctttggatattcagactcttatatggttctatccaaattttaggatttattttctgtttctgtgaagaatgtcattagtattttgatagagattgcattgaatctgtagattgctttgggtagtatggtcattttaacaaagtaattcttcggtatattcatgaggctgggatgtctttccatttttgtgtgtgtgtgtcttcctgatttctttcatcagtgttcatagacttccttgtagagatcttttgtcttgttggttaaatttattcttaagtattttatttatttttggtaccaattgtaaataggattgctttcttgatttcttttttagctagtttgttgttggtgtgtaggaatactactgatttttatattaatatattgattttgtatcctgcaactttaccgaaattgtttgtccgttctaagagttttggtggagtctttaggttgtttttctatatataagatcatctgcaaacagattcttttgagaatttttgcctctgtattcattagggatattggcctatagttttctttttttggttggtgttgtgtccttgtctggtattgtaacagggtaatgttggcctcatagagtgagtttggaagtgctacctcctcttcatttcttggaaataatttgagaagaattggcattagtttttctttaaaagttgagcagtgaaaccactcggtcccgggcttttctttattgggaggtttttaactacaactttaacctcttggttcattattggtctgtttgagttttctatttcttcttggcaaaatctttataagttgtatgtgtccaggaatttatccatttcctctgggttttccagttttttggcctatagttgcttatagtggtctgtaatgattgtttgtatttctgtagtatcagctgtaattctttttttgtttctcattttgcttacttgggtctttttttttaattagtctacctaatggtttattaattttgtttatcttttcaaaaagccaacttttcattttgttgatctttttttgttctgttggtctcaattttatttctttctttccatgtactaatttggggtttggtttgtttttctagttcattgaggtgtataattaggttatttgaaatctttctagtttttttgatgtatgcatttattgttataaacttccctcttaatactgcctttgctgtatcctataggttttggtatgttgtgtttctgttttaatttgtttcaataaatttttcaatctctttcttaattccttcattgacccatttgttgttcaagagcatgttgtttaatttacatgcatttgtatagttctgaaagttcttgttactgatttctagttttattacattgtcattagaaaatatagttgatattattttgatttttaaaaacttgttgagacttgttttgcgatctaacatatggtcagtcctggagaatgtcacgtgtgctgatgaaaagaatgtgtcttctgcagctgttggatgaaattttctgtaaatgtccataggtgtgtttggtctataacacagcttatattggattttttttattgattttctgtatagatgatctgtccagtactgagagtggggtttggaagtccccagattttattgtattggaatctatatatcttttgagatctaataatatttgctttacatgtaaatatatgtgcacacaaccatatatacatgtgctctggtgttgggtacatatatatttacaatttttatatcctctcactgaatgatccctttgtcattacataatgactttctttgtctcttcttacagcctttgacttaaaggtctttttaaaatatgtaagtataggtactcctgctcacgtttagtttctatttgtatggatatcatttttctattcctttattttaagtctttgggtctttacatgcaaagtaaatttcctgtaggcagcatatagttgggttgtatttttgtatccattctgccagcctatatcttttaactgggaaatttaattcatttacatttaaggttattatttgtaggtgagaacttactcctgtcattttgttaattggtttttgataagtttttgatatcctttgttcctttctttctctcattgcttatcattgcagtttggtagttttctgtagtgataatgtttgattcttttctcttacttctatgtgtatttgctccaccagtgaattttgtagtttcatgtgttttcattatgatagttattgacatttcacttcaatgtgtagcactcctgtaagcattgctttgtaagattgatctagtgatgatgaatttcctcagtttttggttgtctgagaaaactttatttctctttcatttctgaaatacagcttttgggtatattttctttgctggcagttttttttttttcccttttactactttgaatatatcatcgaattatttcctggcctgtaaggtttctgctgagaaatctactgatagtctagtaagggttcctttgtatgtgatttgatgtttttctcttgctgtgtttagcattctctctttgtctcagacttttgacaatttgactacagtgtgcctcagagaggacctttttggttgaatctgttggaggtttctgagcttcctggatctggatgtttatctctctcccaagatttaggacgttttaaactgttatttccttaaatacattttctttttttattttattttattattattatactcttaagttttagggtacatgtgcacaatgtgcaggttagttacatatgtatacatgtgccatgctggtgtgctgcacccattaactcgtcatttagcattaggtatatctcctaatgctatccctcccaacttcccccaccccacaacaggccccagagtgtgatgttccccttcctgtgtccatatgttctcattgttcaattcccacctatgagtgagaacatgcggtgtttggtttttcgtccttgcgatagtttactgagaatgatgatttccaatttcatccatgtccctacaaaggacatgaacacatcatttttatggctgcatagtattccatggtgtatatgtgccacattttcttaatccagtctatcattgttggacatttgggttggttccaagtctttgctattgtggatagtgctgcaataaacatatgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctacataaatgtcttcttttgagaagtgtctgttcatatccttcgcccactttctgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctgtttagtttaattgtatcccatttgtcaattttggcttttgttgctattgcttttggtgttttagacatgaagtccttgcccatgcctatgtcctgaatggtaatgcctaggttttcttgtagggtttttatggttttaggtctaacatttaagtctttaatccatcttgaattaattttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcaggctcttttttggttccatatgaactttaaagtagtttttttccaattctgtgaagaaagttattggtagcttgaaggggatggcattgaatctataagttaccttgggcagtatggccattttcacgatattgattcttcctacccatgagcatggaatgttcttccatttgtttgtatcctcatttatttcattgagcagtggtttgtagttctccttgaagaggtccttcacatcccttctaagttggaatcctaggtattttattctctttgaagcaattgtgaatgggagttcactcatgatttggctctctgtttgtccattattggtgtataagaatgcttgtgatttttgtacattgattttgtatcctgagactttgctgaagttgcttatcagcttaaggagattttgggctgaggcaatggggttttctagatatacaatcatgtcatctgcaaacagggacaatttgacttcctgttttcctaattgaataccctttatttccttgttctgcctaattgccctggccagaacttccaacactatgttgaataggagtggtgagagagggcatccctgtcttgtgccagttttcaaagggaatgcttccagtttttgcccattcagtgtgatatcggctgtgggtttgtcatagatagctcttattattttgagatacgtcccatcagtacctaatttcttgagagtttttagcatgaagagttgttgaattttgtcaaaggccttttctgcatctattgagataatcatgttgtttttgtctttggttctgtttatatgctggattacatttattgatttgcgtatattgaaccagccttgcatcccagggatgaagcccacttgatcatggtggataagctttttgatgtgctgctggatttggtttggcagtatttgattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttgattggtaagctattgattattgccacaatttcagctcctgttattggtctattcagagattcaacttcttcctggtttagtcttgggagggtgtacgtgtcgaggaatttatccatttcttctagattttctagtttatttgcatagaggtgtttgtagtattctctcatgatagtttgtatttctgtggaatcggtggtgatatcccctttatcgttttttattgcatctatttgattcttctctctttttttctttattagtcttggtagtgatctatcagttttgttgatcctttcaaaaaaccagctcctggattgattaattttttgaagggttttttgtgtctctgtttccttcagttctgctctgattttagttatttcttgccttctgctagcttttgaatgtgtttgcttttgcttttctagttcttttaattgtgatgttagggtgtcaattttggatccttcctgctttctgttgtgggcatttagtgctataaatttccctctacacactgctttgaatgcgtcccagagattctggtatgttgtgtctttgttctggttggtttcaaagaacatctttatttctgccttcatttcgttatgtaccctgtagtcattcaggagcaggttgttcagtttccatgtagttgagtggttttgagtgagtttcttaatcttgagttctagtttgattgcactgtggtctgagagacagcttgttataatttctgttcttttacatttgctgaggagagctttacttcccagtatgtggtccattttggaataggtgtggtgtggtgctgaaaaaaatgtatattctgttgatttgtggtggagtgttctgtagatgtctattaggtccacttggtgcagagctgagttcaattcctgtgtatccttgttaactttgtctcgctgatctgtctaatgttgacagtggggtgttaacatctcccattactattgtgtgggagtctaagtctctttgtatgtcactcaggacttgctttatgaatctgggtgctcctgtattgggggcatatatatttaggatagttagctcttcttgttgaattgatccctttaccattatgcaatggccttctttgtctcttttgatctttgttggtttaaagtctgttttatcagagactaggattgcaacccctgcctttttttgttttccatttgcttggtagatcttcctccatccttttattttgaacccatgtgtgtctctgcatgtgagatgggtttcctgaatacagcacactgatgggtcttgactctttatccaatttgccagtctgtgtcttttaattggagcatttagtccatttgcatttaaagttaatattgttgtgtttgaatttgatcctgtcattatgacgttagctggtgattttgctcattagttgatgcagtttcttcctagtctcgatgttctttacattttggcatgattttgcagcggctggtaccggttgttcctttccatgtttagtgcttccttcaggagctcttttagggcaggcctggtggtgacaaaatctctcagcatttgcttgtctttaaagtattttatttctccttcacttctgaagcttagtttggctggatatgaaattctgggttgaaaattcttttctttaagaatgttgaatattggcccccactctcttctggcttgtagagtttccgccgagagatccgctgttagtctgatgggcttccctttgtgggtaacccgacctttctctctggctgcccttaacattttttccttcatttcaactttggtgagtctgacaattacgtgtcttggagttgctcttctcgaggagtatctttgtggcattctctgtatttcctgaatctgaatgttggcttgccttgctagattggggaagttctcctggataatatcctgcagagtgttttccaacttggttccattcttcccgtcactttcaggtacagcaatcacgtagatttggtcttttcacatagtgccatatttcttggaggctttgttcatttctttttattcttttttctgtaaacttctcatcttgcttcatttcattcatttcatcttccatcactgataccctttcttccagttgatcgcatcggctcctgaggcttctgcattcttcacagttctcgagccttggctttcagctccatcagctcctttaagcacttctctattggttattctagttatacattcgtctaagtttttaatcaaagtttttaacttttttgcctttggtttgaatttcctcctgtagctcggagtagtttgatcgtctgaagccttcttctctgaactcttcaaagtcattctccatccagctttgttccgttgctggtgaggaactgcgttcttttggaggaggagaggcgctctgctttttagagtttccagtttttctgctctgttttttccccatctttgtggttttatctacttttggtctttgatgatggcgatgtacagatgggattttggtgtggatgtcctttctgtttgttagttttccttctaccatacaggaccctcagctgcaggtctgttggagtttgctagaggtgcactccagaccctgtttgccttggtaccagcagcggtggctgcagaacagcagtttttcatgaaccacgaatgctgctgtctgatcgttcctctggaagttttgtctcagaggagtacccagccgtgtgaggtgtcagtctgcccctactggggggtgcctcctagttaggctgcttgggggtcaggggtcagggacccacttgaggaggcagtctgccccttctcatatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttccctaagcaagcctgggcaatggcgagcgcccctcccccagcctcgctgccaccttgcagtttgatctcagagtgctgtgctagcaatcagcaagactccgtgggcgtaggaccctccgagccaagtgcgggatataatctcctggtgtgccgttttttaagcccgtcggaaaagggcagtattagggtgggagtgacccaattttccaagtgccgtctgtcacccctttctttgactaggaaggggaactccctgacccctcgcgcttcctgagtgaggcaatgcctcgccgtgcttcggctagcgcacggtgcgctgcacgcactgtcctgcgcccactgtctggcactccctagtgagatgaacccggtacctcagatggaaatgcagaaatcacccctcttctgcgtcgcttacgctgggagctgtagaccggagctgttcctatttggccatcttctccttaaatacattttctatgccttttcccatctcttctcctttttgaacttccataatgtgaacatttgttcactttatggtatcccataagtcctgtaggctttcttctttctttaatttcttttcttttcttctcctttttttttggtctgcctgggttatttcaaaagatctgtcttcacattcagacattgtttttctgcttcatctagtctgtcgttaacaaattcagttgcatttttatttcattcattgaattcttcatttccaagatttttttaatgaaatctaaatcattgttgaatgtttccttcagatcatgtattgttttcctgattttattgaatttcctgtttgattactttatatctcactgagtttccttaagatcattatttttgaatttgagggacagagagctagcaaacaagcacattcacattactttattacagtaattgctataattgttatttttattagttattgttaatctcttactgtgcctaatttataaattaaactttattatatgtacgtaggtgtaggaaaaaacatagtgtatacagggttcagtaccattgcggtttcaggcatccactgggagtcttggaacgtatctctgtggataagagtggtctactgtactcttggtttatgttctgggaggtaaactgctcacttatgaccacatccaagtgcatacactccattttggaaccctctagcacacagccatgcgtacaggttggtgcaaaagtaattggcattgaaagaaatggccaaaaccgcaattacttttgcatcaacctagagatgtactacttttctattgttgcataactcgttaacattaataactgattcattatttcccaattctataagtcagaagtctgggtgggcttggctgatttttctgccctggatctcacaaggctgaaggtaaggtgctggctgggctcttaatctggagatctggaaagattgacttcctagttcattgaggctgttggaagaattcagtttcatatggttatgagactgaggtcccccctgccttgctggttgtccttgtcccttgcatgtggtcccctccaccttcaaaaccaccaaccgtgtgttgagtccttcttgtgttttgaatctctctgactttctcttctgccaccagccagggaaaactctgcttttgaatcgggttcacatctccgtattttaaggtcaactgactcaagactttaatttcatctgcaaaatacccctagattagtgtttgaataatcaagggataggaatcttggatgggaccattttcagaattctgactaccacagtgagtgttgtataaatttttttttgatgtttaatcaaggagagaattggaaaaaagtactaaaagaagtctcaaattaatttttacactgttaaattcaggattctttctatatgatatcactgttaatgctggttataccacccattgttgtaaagaaacccacaagctaacagagaaaaggaaaacaaaacagtaattatgctgatgttgttgccttttttatttttggaaggaaggaaaatttgctgatccgagccaagtttttcccctcaatggctggcgctgctcagtaacattgcaagtgttattcatatattgtgtttatttttttcaggggcctgggcaacaaagttacttacttttttaaaaaagaaaaatggacttaaacatgtggaaaagttcaaaagaagaagcttagtatgactgatataaaatagttgtaaaaagtgaccaatctcattataatgttgtgatttctaggctgcgttgagttttgttagttgcctaacactgtataattataagtatagctagaaaagtgggtgtccttcaaaactttgggacagttggttgggattttgtaggcaatccagtgttgaaaggtttgcttcatcattttgtggtgttatctttgggttgagaaacaaagatcatttaaaaagaaaagttcagatggtcctgctgggttctgctgtgctgtggcttatagcctacttgctggaagtaccattcagttctcaatactaagaatcaactttaagtaacttttaaacttaaaagttaaatattttttggtatgtcgtctttgagtgagaagaccagggtgggattttttccatatcagacaaacaacaataggggtcctggctggcaaaaggatacacatcattgcgtcagatgatttgtctccaggaaaataagttcaaagcaaagcatcaaatgctgtctgaatgtgagtctaaccaactgggactggtaagaggcaccaactctgtgtgctgcccttgacagcccacatgggctcccttctgtgctgtgaactgtaaagtgtgaccagggaactgggaagagtcttggaaatacatcaatgctgcctgaacccacttaggctcatggaagtggaaaggacacagtaaaagagaaagagaagctcagggattgccaagtaacagatattgagtcagcaatgatgggtctcaagtcttagcttgattgagacttgggcaagccattgtgagacttagggcaagttgcctcgcctcatctctgtgagtctggtgtcctcatctgcaaaatggagataatatctgtcatttagagcaacatgggtgaatctggagacattatattgagtgaaataagccaggcacataaggaaaaatactgcatgatttcagtcatatatggaatgtaaaaagttgttctcatagaagtagagggagaatagtggttaccagaggatgggagggtacaggggaaggaggagtggggagagattggttgataggtacgaactacagttaggaagaataaatgcttgtgttccattgcatagtaggatgattagaattaagaatgacatattctatatttcaaagtagctggaagagaggttttgaaagttcttatcacaaagaaatgatgaatgtttgaggtgatggatatggtaattatgctgattttgtcattacacagtgtatgcatgtgtcaaaacatcacatcatattgtgtaaatatgtacaattatgatgtgtcaattgtacatttaaaaaattgaaacaaaaaatggagatgataataatagaagtactgcctaggtctttggatgtttctatgaagtgatacataaaaagcatgtagcaggttctcttggaggtggctggcaagatggccaaatacaaacaactccagtctgcagcccccagcgagatcaacgtagaaggcgggtgatttctgcatttccaactgaggtaccaagtcatctcattgggactggttggacagtgggtgcagcccgtggagggtgagctgaagcagagtagggctttgcctcacctgggaagtgcaaggggttggggagctccctcccctagccaagggaagccatgagggactgtgccgtgaggaatggtgcattccagccagatactatgcttttcccacagtctttgcgacctgcagaccaggagattccctcgggtgcctaggccaccagggccctgggtttcaagcacaaaatggggcagccgtttggtcagacactgagctagctgcagtttttttcatgtccccgtggcgcctggaatgccagcaagacagaaccgtttcccccctctggaaagtgggctgaagtcagggagccaagtggtctagctcagcagatcccacccccacggagtccagcaagctaaggtccactggattgaaattcttgctgctagcacagcagtctgaagtctacctgggatgctcaagcttggtggggggaggtgcgtctgccattactgaggcttgagtaggtggtttacccctcacagtgtaaacaaagctgctgggaagttcgaactgggtggagcccactgcagctcagcaaagccactgtagccggactgcctctcttgcctcctttctgggtacgacatctctgaaagaaaggcagcagccccggttaggggcttatagatcaaactcccatctccctggtaaagagcacctgggggatggggtggctgtgggtacagcttcagcagacttaaatgttcccgcctgccggctcttaagagaacagcccatctcccagcacagtgcttgagctctgctaagggacagactgcctcctgaagtgggtccctgaaccctattccccctgattgggagacacctcccagcaagggtcaatagacacctcatacaggagagctctgactggcatctggtgggtgcccctctgggacgaagcttgcagaggaaggaacaggcagcagtctttgctgttgtgcagcctctgctggtgatacccaggcaaacagggtctggagtgcacctccagcaaactccagcagaccttttgcagagggacctgactgttagaaggaaaaccaacagaaaggaatagcatcaatatcaacaaaaaggatgttcacacaaaaacctcatccgaatgtctgtcaccagcatcaaagaccaaaggttgataaatccatgaagatgaggaaaaaccagtgcaaaaaggctgaaaattccaaaaaccagaatgcctcttctcctccaaaggatcacaacgccttgacagcaagggaacaaaactggatggagaatgagtttgatgaactgacagaagtaggcttcagaaggtgggtaatgacaaactcctctgagctaaaggagcatgttctaacccgatacaaggaagctaagacccttgaaaaaaggttagaggaattgctaactagactaaccagtttagagaataacataaatgacctgatggagctgaaaaacacagcacgagaacttcatgaagcatacacaagtatcaatagccaagccgatcaagcggaagaaaggatatcagagattgaagatcaacttaatgagataaagtgtgaagacaagattagagaaaaaagaatgaaaaagaaggcaaaaagcctccaagaaatatgggactatgtgaaaagaccaaacttacttttgactgatgtacctgaaagtgatggggagaatggaaccaagttggaaaacactcttcaggatattatgccggagaatttccccaatctagcaagacaggctaacattcaaatttaggaaatacagagaacatcacaaagatactcctcaagaagagcaaccccaagacacacaaatgtcaaattcaccaaggttgaaatgaaggaaaaaatgttaagggcagccagagagaaaggttgggttacccacaaaaggaagcccatcagaataacagcagatctctctgcagaaaccctataagccagaagagagtgggggccaatattcaacattcttaaagaaaagaattttcaacccagaatttcatatccagccaaactaagcttcataagtgaaggagaaataaaatcctttacagagaagcaaatggtgagagattttgtcatcaccaggcttcccttccacgagctcctgaaggaagcactaaatatggaaaggaggaaaaactggtaccagccactggaaaaacatacccagttgtaaagactatcaagtctatgaagaaactgcatcaattaatgggtaaaataaccagctagaatcataatgaaaggatcaaattcctacataacaataataaccttaaatgtaaatgggctaaatgccccaattaaaagacacagactggcaaattgggtagagtcaagacccttcagtgtgctgtattcaaaggcacccataggctcaaaataaagggatggaggaatatttaccaagcaaatggaaagcatgaaaaaagcagaggttgcaatcctagtctctgataaaacagactttaaaccaacaaagatcaaaaaagacaaataagggcattacataatggtaaagggatcaatgcaacaagaagagctaagtatcctaaatatatatgcacccaatacaggagcatttagattcataaagcgagttcttagagacctacaaagagacttagactcccacacaataataatgagagactttaacataccactgtcaatattagatcaatgagacagaaaattaacaaggatattcaggacttgaactcagttctggaacaagcagacctaatagacatctacagaactctccaccccaaataaacagaatgtacatccttctcagcaccacatcacacttattctaaaattgactatgtaattggaagtaaaacactcctcagcaaatgcaaaagaacagaaatcagtttctcagaccacagtgcaatcaaattagaattcaggattaagaaactcactcaaaaccacacaactacatggaaactgaataacctgctcctgaatgactactgggtaaataacgaaatcaaggcagaaatatataagttctttgaaaccaataagaacaaagacacatcgtaccagaatctctgggacacatttaaagcagtgtgtagagggaaatttatagcactaaatgcccacaggagaaagcaggaaagacctaaaatcaacaccctaacatcacaataaaaagaactagagaaacaagagcaaacaaattcaaaagctagcagaagacaagaaataactaagatcagagcagaactgaaggagatagagatacgaaaactcttcaaaataatcagtgaatccaggagctgtttttttaaaagattaacaaaatagctagaccactagccagactaataaataagaaaagagagaagaatcgagtagacataataaaaaataataaaggggatatcaccgctgatcccacagaaatataaactaccatcagagaatattataaacacctctacacaaataaactagaaaatctagaagaaatgcataaactcctggacacatacaccctcacaagactaaaccaggaagaagtcgaatccctaaacagagtagtaacaagttctgaaattgaggcagtaatagactaccaacgaaaaaaagtcctggaccagatgaattcacagctgaattctaccagaggtacaaagaggagttggtaccattccttctgaaataactccaaatgatagaaaaaaagggactcctccctaacatattttgtgaggccagcatcatcctgataccaaaacctggcagagacacaagaaaaaaagaaaatttcaggccagtatccctgatgaacatcgatgcaaaaatcctcaataaaatactggcaaaccaaatccagcagtacatcaaaaagcttgtccaacacgatcaagttggcttcatccctgggatgcaaggctggttcaacatacacaaatcaataaatgtaatccatcacataaacagaaccaatgacaaaaaccacatgattatctcatagatgcagaaaaggccttcgataaaattcaacaccccttcatgctaaaaactttcaataaactaggtgttgatggaatgtatctcaaagtaataagagctatttatgacaaaccacagccaatatcatactgaatgggcaaaaactggaagcattccctttgaaaaccaacacaaccctctctcaccactcctattcaacatagtattggaagttctggctagggcagtcaggcaagagaaagaaataaagggtattcaaataggaagagaagaagtcaaattgtgtctgtttgcagatgacatgattgtatatttagaaaaccccatcatctcagcccaaaatctccttaagctgataagcaacttcagcaaagtctcaggatacaaaatcaatgtgcaaaaatcataaacatttctgtacaccaataatagataaacagagagccaaatcatgagtgaactcccattcacaattgctacaaagagaataaaacacctaggtatacgacttataagggatatgaaagacctcttcaaggagaactacaaaccactgctcaaggaaataaaagaggacacaaatagaaaaacattccttgctcatggataggaagaatcagtatcgtgaaaacggccataatgcccaaagtaatttatagattcagcgctgtccccatcaagctaccgttgacttttttcctagaattagaaaaaactactttaaattttgtgtggaaccaaaaaagagcccgtatagccaagtcaatcctaagcaaaaagaataaagctggaggcatcatgctaccttacttcaaactatactacaagactacagtaaccaaaacagcatggtactggtaccaaaacagatatatagaccaatgaaacagaacagaggcctccgaaataatgccgcacatctagaaccatctgatctttgacaaacctgacaaaaataagcaatggggaaaggattccctatttaataaatggtgttgggaaaacttgccagccatatgcagaaaactgaaactggatcccttccttacaccttataaaaaaattaactcaggatggattaaagacttaaacagaaaacctaaaaccataaaaaccctagaagaaaacctaggcaataccattcaggacataggcatgggcaaagacgtcatgactaaaacaccagaagcaatggcaacaaaagccaaaattgagaaatgagatctaattaaactaaacagcttctgcacagcaaaagaaactaccatcagagtgaacaggcaacctacagaatgggagaaaagttttgtaatgtatccatctgacaaaggactaatatccagaatctacaaggaacataaacaaatttacaaggaagaaacaaacaaccccattaaaaagtggatgaaggaaatcaacagacacttctcaaaagaagacatttatgcggccaacaaacatatgaaaaaaagctcatcatcactgatcattagagaaatgcaaatcagaaccacaatgagataccatctcaccccatgacgatggtgccatttagaatggcgattattaaaaagtcgggaaacaacagatgctggagaggatatggagaaataggaatgcttttacactattggtaggagtgtaaattagttcaaccattgtggaagacagtgtggttattcctcagggatctagaaccagaaataccatttgacccagccatcccattactgggtatatacccaaaggattatgaatcattctactatacagacatatgcacgcatatgtttattgcagcactattcacaatagcaaagacttggaaccaacccaaatgcccatcagtgatggacaggataaagaaaatgtagcacatatacaccatggaatactatgcagccattaaaaaggatgagttcatgtcctttgcggggacatggttgaagctggaaaccatcattctcagcaaactaacacgggaactgaaaaccaaacactgcatgttctcactcatcagtgggagctgaacaatgagaacacatggacacagggaggggaacatcacataccggggcctgtcagggggtgggggcctaggggagggatttcattaggagaaatacctaatgtagatgatgggttgatgggtgcagcaaaccactatggcacgtgtgtacctgtgtaacaaaccttcatgttctgcacatgtatcccagaacttaaagtataataataactttaaaaagcatatagtagaccacctggcatgcaagtacttagcaaattttggctataattgaagaaggagcttcattaaaaaaggaagaaggaaagattaagagagagagaaataagagaaagaaggggaagagggaaaatgagaccatcaggaacaaacagaagaaggaggctggtctaggtcccaggattccatgcacttagaaaaataaggcaagtttgaattgaactttttcatttttcaagtgaagttgagttctcggatatacactctgctgcatacttccctccacaatgctgagttttaatatcatttggttgaagctttgagatactgggccgaaatagcttccagaatgcctctgtaatccagtggtgatattagtgaggcctaggaaatcattttatagccactagtctttttatttgtaaatttattctacactgaaggtgttagcatcaaacttttcaccctgactgagcacagactcttgggagaactgaaatctaagtaagagattaccttgcacattgcgtcaagtcagggatgaatgaagcaacttaggcgacagaaattatcctggtggagcctgagacctgagactaaaggctgagggtgtgctttggtctcaccaccaagctttgctggtgaattctctaccaccatagctgtcccttttgtgagttgcaaaggaaagaatgttctctgtgtgcaacaaatagtcctgatttaatctggggcagaaaatcccctagctttgccagtgatctgcttgttggagaataaaataattgaattatctccctgggcaaaagcaaatggcatggaaagtctcaattgcagcaagaggaaaaataagaataagggactgttttgctttgttttattttgagcttttggtactgaattccatttatttagaacaaatgaagaaatcttcttttaagaaagttagtcaacatacttgggaggtctcatcagtttctttgggttcttcttgggatgatgggagagctgctgaagttcccttcccccaagatcaactattagtctctgcctataatgctgtctacaatcagccttgccctaagagtcaaactgcttgccaagttatgcgtccctctcccagctttattgagacataattgacaaataaacaaataaacattgtatatatttaaggtatacaaagtgatgttttgatatacatatacattacaaataacatatccatcttctcacatggttaccatttgtgtgtgtgtgtgtgtgtgtgtgtgtgacagagagagaggaaaacactgaagatctactctcaacaaatttcaggtattcagtgcattagtattaactattattgccatgctgtaaattaggtctgcagaactcactcatcatataactgtaagtgtgtatcctttgaccaacatctcccccttttctccactctcagcccctggcaaccatcattctgtgttactgtaagtttgatttttttttttttttttagatttcacatataagtgagatcatgcagtatttgtctttctgtgcctggcttgtgaaacttagcataatgtcctcctggttcgtccgtgttatctcaaatggtagcatttccttctttttaaaggctgaataatattcatatatatgaatattatattaattatattaatatataatattcctgcgtgtgtgtgtgtatatatatatatcacatatatcacattttttttatccattcacctgccaatgcacatttaggttgttttcatatcttggccactgtgaataatgctgcaatgattgtgggtgtgcagctgtctctttgagatagtgatttactcccttttgatatacacccagaaatgagattgctggatcatatggtagttctagttctgtttttttgaggaaccaccacactgttttccatagtggctgtactaacttacattcccaccaacagtatacaagggtcccttttctccccctccatgccaacacttgttaccttttgactttttgataatagccattctaacgggtatgagatgttacttctttgtggttttgatttgcatttccctggtgattagtgatgttgatcacctttccatatacctgatgaccatttgtatgtgttctttgttcaaacgtctgttcaggtcatttgcccatttttaaactaggttgtttgttttcttgctattgagttgatatgagtttcttatctatcttgggtattaaccccttattgaatatatggtttacaaataattttgtatggatttgaaggcagtttcacaaatttctaagacatcaataactttattttatgttaaagatccaagtggttagtgtgatagaccatggacacctgttccatatctggttgtaaagaaacagtagataccatggtagtttcatggctggataccctcatcagtgggtggagagaggaggcttgggctttgtagggaaggtcagcagagaccagcctaaggcatgactcatactagtcactgtggagatatttgttgaccagtaaatactatcaagataacttgggcttgtgggaatgataccaacagataattctcatggggtattagctcatatgtaaagtgatgagatgggtatctggcatagagtacctataacctaagaggaaagaactatcctttttttttttcagatggggtaaatgaggcccataatgaattagcagcttggccaaggtcgttgcgggaaaacttagtaagtcgccaagcagtgattggaagccatgcattgcgaatctaggacatggatatttatcctccggagcagactgcctcccgttacagtgtatttaaaacttaacagtcatcacttcctccaccccagcctgcttctcttcttgtgtttccccaagaacagccccagcacccactcattgacacaaaccagaaatttggggagcatctttgacttgccatctccctgggcccccacattaatcattcccagagttttctccattgtcaaatccccattctctcctcacctgtccatttctctccacctccaagtctgctatcttgatttaagtcatcatgatctcctccctgaatctctgcctccctctcctggcttgtcctctggctccaggtgtctgtcttccaaccacatcttcacacggagatcagatttctcctagagaaatttttggacttcacatttgaccctctctgaggttaaaactccttggtggatcctcagtccatggctggagcagtttttcccgtggtgtaccctcttgtacttgatcatttatgggtggtagagaggagttagggcaggatattcacttgggatattgaactaacagttgctttctttcaattaacccctctgacaacctcaggaggaaagtcttaattcactattaatatgtcttcaacattttcctcatttttgcttatctccatttttaaccaagacagagcaggcaactatagttagctagaatgccactacttatttttattctatttttatgatttctttttactttatggctcatgatacaagttttccattttctgggaatgctacaaagttatcttttagaaggagtatatttaaatttaaaaataacagcataataaaaaatttaattaatgactagagcaagtgatataatacagtagccctctttgtatctgcagtttcagttatctgaggtgaaccatggtctgaaaatattacatggcaaattccagaaataattcataagtttaaaactgcagccaggcgcagtggctcacacctgtaattccagcagtttgagaggccaaggcgggaagatcatgaggtcaggagattgagaccatcctcgctaacacggtgaaaccctgtctctactaaaaatacaaaaaattagccaggtgtggtggcaggcgcctgtagtcccagctattagggaggctgaggcaggagaatggtgtgaacctgggaggcggagcttgcagtgagccaagattgcaccactgcactccagcctgggcaacagagcgagactctgtctcaaaaaaatatatatataaatatgtgtgtgtatatatatatatatatattgcttgtcattctgagcagtgtgatgaatctcgcatcttcaatgtgcatcttccctttgtcaggtgtatccacgctgtctacactactcacccattagtcaggcggctcaattatcagatctgctgttgtggtatggcagtgcttatgttcagataacccttattttacttaataatgcttttctaataattacttattacttattgttaatctcttacattgcctaatttataaattaaactttatcattgatatgtatatatataaaaaacccatctcatatataggtgatatgatttggctatatccccacccagatctcaccttgaattgtagttactgtaactacatgtgttaccataacacatgtgttgtgggagggacccagtgggaggcaactgaatcatggagcggttacctccatgctgttctcttgatagtgagttttcatgagatctgatggttttataagaagcttttccccctttgctcggcacttctccttcctgcagccatgtgaagaaggacatgtttgcttccccttccactgtgattgtaagtttcctgaggcctctccagccaagctgaactgtgagtcaattaaacctctttcctttataaattacccagtctcaggtatgtctttattagcagcgtgagaatgaactaatacaatagggttcagtactgttcatgatttcagacattgactgggagtcttgggacatatcccctgagaatgatggaagactacttcacagcgaaaattgatcatagcagaagaaatatggaagttttggaaaccgtaattataggcctttctggaacctgcttcctgcttgtgttgccagccttaactcttccatattttccttattttaaattgctactgaaaatgatgaagtcctgagcttggcagtggctcccacctttttctccctcccttcttggagacatcagaaaccgataggagagaaggctacacattagtctgtgtgtcctgcagccatagaaatgtcatgacagacacaattttactatacagtttcatggaaagaagttatttaagcacttatcaaatatgtggccaaacacttgaaagcaaatgattaaatgatgtatttaaatattttatagtaaagcatgctcagtgggcagctattagtcaaatttttacaggtattcatttaagcaaaatcataccatcttttgaatctgggaaatccagctctacttagtagcctgttttacccttttggagttgattctgtaaaaatccaggagaatttcttctcctctcaatctttagccaaaatatgagaattgtaggaaattgctcatccccaaactccatgtgcctgcacatgctcacacaagtcgaatctgtaataggacttaaaactctcctgtcccagcactttgggagtctgaggcaggaggctcaattgagcccaggagtttgagaccagcctgggcaacatagtgagaccctgtctctacaaaaaaaaagaaggaaagaaaacttcctcctgaatgctaaaggtgtgctacaggtgttcctcctcaaataattgcactgaaatcactgaccctcaggatgtatttctttgatttttcatcatgccttttcctgggggtctgcagggaacataccattgttgagatggttgcttggtacagagccatgtggatctgcagcccctcaccctacaccccacagtcgcaagttctttacttcttagatcacttcgttgtgttttctccccatattttactgtcttgggtcatcaccaacgtgatttttagttcccctgtagtagtaaatacatgtttcagttactgaaatgagggttttatgataagaaaaatcataaaagcaggggtcacaaacaagttaaagaatataaaatatgtatgaaatttttaattgaaaaatgggcctttctgtaatataatgatagtggctggccaacttgggctgccttcctccttctagagatatttctattttatctccatttgggggttcttttggtggaaaacatgggcttgtatttccatttaccactctgctggatggtgttaaatgcctggaaagcctgggaagactccagaatctgaaatgtatgaaagctgggagggaactcttagggtcatctggtggaaattcctttgtgacagatggggaaacagaggtctagaaagttgaagattcatccagaaaaagaaaacaatccatagaagaatgtccaagccttctcactcataggcctgaggttattcctctctataatgaccacaggagtccctgggtcctgggacactctctgattctgtatgtctttgtctctgttggggagaaccagcaaggtttggagatgcctgcttcctgagggccctgaaatccatggagatggactgactgcccttctgctagtgcttctaggaaggggaatgtagaggtcaaacatgaaagagtggcctctggctaggctgcctctagataatgaaacagtaaggacatttgttgagaagccacacatgtattttgtcttccaaagctttgggacattcatcagctttcctcaaaccttcactcccctctgatgtttcatttgcacagccaaagtggagttgtgtttccagtgtgttcctgggatgccttcaggatttcttggaaaccttaagcagatggttaagttgtgtgatctccatttccagcctctggaaaacctgtggctaatattccacaatggccctggaatttggggtggcttctcagtgacctggcttccgtggcttctctggcaaagatcaaagacttcaaaacagttggagcgtgtgaaatgattggtaactgtgctcggttcttccacagctatttgttcttgcaagcccaggctttacatctttttccaaaaagtgtacacggccttcattctccagagcggttgaaaagctaatagacattctcattttattccacccctgactacaggcaactctatcactagatgagtttgtctgaattccatttgcttaggctttatgaagtgaataaatttgaattaatgtggagctttctgaggagggggaagatatgctttgagaggttaagcaatgtctgtgttagtttatataaatgaatctttatgggtgcaaatgtgctcacaccacgttaccatattggctctattagtttatacagaaatttcattaagtgatgtgaaaatatacatatggggatttctacaatgacttcttccttttgaacagccagatatttacgttcctttgggtttcattggcacacaaatgtattttccctcttaaaggtaacacttggaagaaatatgcatcaagaaatatgtctataacaactcaaattcccaacaaattacatttgctatatttggtaactctctaacagtgtttctttccataataattgaagcagaattgagatgtcataaccgaaactgatactgcagacgcagttgttacttgggagcagaggaggggcagtgagaagcatttggcttttctgtaagttgaaatttttgttgttgtatttttatctgtaaatgattaggaatggaactgtggtgcgtaaactcatgaatgttaatatggctatagcttctgcttccgtaacacttagttattctatcccttattacactcttacagacgttgatagttcaacaattggagcttttaaactaatggaaggctttcaaccaagtagaatgccttcattactagcaagcagggagatctgaatgtgaattgaggtggtttaaaccaatttaaggaaacatttttataaaagactaatgcccataatttatgtttattttctgttttctgtgatttgaataaattagggcagggatttatattatttgtcttcttttcacatgcctcacccagtgcccacctgcattagtccatgatagctctgataacaaacaaaccagaaacctcaggggattcacacattgaagtttatttcttgctcatgtaaatgccactgggtctcggagctctccaggcagttcctttccaacgagtgactcagggacctaggcacctttcatcctgtagccatgtcatttggaaaatgtagcttctggaattactacaaggggaagagagaatgtgggagactcatagccccctctcctgtactttagataggaagtgacacacatcacttctgctcacaacccattggccaaaccagtcacatgcccaacaccaattacaagggatgctgggaaatgtagcagagtgcatggaacactctgtgagcattactgttcccaccaccttaacatgtcgcaggggcctagcaaatgctaattgagagaatgaatgaatgaatgaatgagtgatgaatccttttaaatggcttggcattgagagcatgcgattgctattttaaattaattgaaaaaggatagaaaattgctggaggaatattaaccttgagggctttttgcataaatttgcactttttgtatgcatttgctgtaagagcttgttgcgtaagtctaaatgccacacaatgatttttttttgaggtcttgatgcacagagcctaaaaaaattttgtttttgaccctaaaggcttctaaagcaaacagcatcttgcagttgattaggtggaagtgtttcttagcctttacggggtgcatggtgggaacagaccttgttaaggttacatagaaggttaacctccattgacaagacaaaattgaagttgttttctcttgccacagagcagttccccgatctgtattgtcagcacagaagagtttatccgttttctccagagcattatctcaaatgaagtgtcaaggcactaaatggatttaccttcttgtattattttttattttgatgtttaattttttatcctatttatttattgtcatatgaagttaaaacaacaaccacaaaaataaatagggaagtctgagagagaaaaatatcacagtctcaccatctttcaccttgtttcttagtagttgttgcaaaacccataaggaatgtcattgtgttgtaatttctaatttttgtttccttgacttatgacttctcatttctgtaacttattgtaattcagataataggtcaactcattcaaacatattcagaacacctactaaatacaagacaatgtatgatataggtatattgtaaataaatgactgcttttctataagatattgttaaattgaagttctggaaagttgcccggagcaactcacctggagtaagcactgaaattgttcacatcaggtttcaagcatagattctgtcacctcctagctgtaggaccttcagatggttatgtaatcatgttgtgctgcagtttccttatggggtgagatgggtaggagggtttgagtaagacctcaagaaaccctaagcaatgaaacactacggtactcccagcatatcacccttaatgtaactttaaataacatggccattttttaaaaaggacacaggaactacataacattttttttcagattttggaaaattctaaatatgtctagaaaaacttttctttctgttccattctccttcctattctccatgaccccctccccgcggactgtatcaggtacagcctgttggaaatccagcaccgcacattaggcacaccagtggtaagtttacttgttgagttatcaccttttttttccttttaatcagagaggcagctctgtgttgaagatgctaggtagtgatggaaaagacattaggaaaatttgttaccgtggtaaccggggatggacatcatgaccttttgtgatatgcatgctgtggccttggtagtctcttcccctaattaacatcctgtgagaaacgtgagagtaaatcaccggggcaactggaccactgcgatattaagtgtgagaacattctaaatggcaataataatcatgataatgaggccacatattctgtgtctatcttttaattgcttcttaactcttgtaactggaaatggtgaagttattatgatgtggaaactaggaagtgatttatttcttacttaaattggactttgtgcagaaaccctttttagtctgttgtgaattatgagagtatgagagttcctttgaagaagaaccacctaggtagataattttttttttttttttgggggatggagtcttactctgttgcctgggctggagtgcagtggtacaatatcagctcactgcaatctctgccttccaggttcaagcaattctcctgcctcagcctcccgagtagctgggattgcaggcacctgccactacgcctagctaatttttgtaattttagtagagacggggtttcatcgtgttggccaggctggtctcgatctcctgacctcgtgatttgcccgcctcggcctcccaaagtgctgggattacaggcatgagccaccgtgcccagctcacctaggtagataattttaaatacagtttactactactaataggcaacaccaaaaatatggatttgccgtagaatcaggggttatcatcatgcttgaagtattatgctctagaacccaagtaccctggttgagccctgttctttcacattttgccactcagttttggattcaaattcataggagaattttttaacttgaaccaaggaagtctagttattggacactaaaggaactataggatggttggtcttgtaagctggctttctggtttgtacctgcaagccacatgttcagattcaacttatggttcttgagtgtgagccgtctagcaatcagtgtcatttacactgatgattttatatatgatatgttagctcagaaagtccttatgaaaaccctccatagcatagtataatagacactttttttttttttttgagacagagttgccctgtcatccaggctggagtgcagttgtgtgatcttggctcattgcaacctccatctcctgggttcaagcaattcttctgcctcagcctcctgagtagctgggactacagacgtgcaacagcacgcttagccaatttttatatttttagtagagatggggtttcaccaggttggccaggctggtcttgaactcctgacctcaattgatccacctgccttggcctcccaaagttctgggattataggtctgagtgcccggccaatatgcagcttttaaagtctctgacagactaacagtgaccccccaacagccccttcattcatgagggtgggcccaataactatgcacaacttgactcctttgcttcctgtcctgtccctgccccctgcattcctttcctaagatttgggaattgcacgaaaaatttcagcctattccgggctagtctctgaacagaaagacatagacagggagaagctgtgagtgagtagttctcttttgttctataaatgaatgggctaagaaagccagactgtaaagaggagactagtgcaaacacctggagagaagtagaaaggagaggtgagagaactttgcccaggagttggaaggcttttttgattctggttccaggcccttcctgacagctggttgcatttagtcctttgaattccatcaagcacttccatatcttaagataaattccatcacttccaaagaaatgtcttaactaaaatgagtagatgttgttgatgctttttctcctgggagaaaaactgagattcagggaagccaacctaactgcaagtgttcactgcagtgttgctgaacactttctcaggactccagcaacccaagtcaaattagaataaaaaacaaaaagggaatgtattgactcactaatctaggcgttccaagatgtgactgcctttcagtatgatttgtcaaggatttcaccagaatcatttgatcaaactttactcttccttgccagctcatgactctgtttctgttaggctttgttctcagaagaatgatctctgtgtggggcaagatgaccactggcagcccaaagcagcagcaccacatcttgtgacccttgacccagggtgcagggacctcagtctcccagcatacccagcattccctggaaaaggactgtaatgggccagcctgggtcatgtgctcttgagtggagtgtggctgacagggccctcttgattgatagcccctcttgtagtggagaatggggtttctagttctgaaacaagggaggagagatgctgagcaggccaaagcaaccttattcacagcatttgcctgtttctctacctgacaacatggtagagagagaaatgctgcttagatgagtgacgcacttccatatgctgattttctccttaggtattagtcacctccttttcctcctactctagaaaataagtcttgatgcagatgattggggatgaacttattattcacataaccttatacccactatgattcaaaaaggcagtcctgcactttgagaggccaaggtgggaggatcccttgagcccaggagtttgagaccagcctgggcaacatagtgagaccccatctttacaaaaaatgaataaaattagctgggaatggtggcatgcacctgtagtcccagctactttggaggctgagttgggagcatcgcttgagcccaggaggttgaggctgtggtggactgagattgtgccactgcactcctgcttgggtgacagagcaagaccctgtatcaaagggggaaaaaaaccagacagtcctttgcaaatgtagtacttctgtcattagtagcaacaagcatggcacatcttactgtcgcttggggacaagtcctggagtggagacttctgctcttggatccatattatgaggataagtgtgtcaacacagtttttgacacaagcctacttattcaaatcatattcgagggtctcccaacaaccaggccctggagttccaaccatgaacaagattaaaaatatttctcttcttagggagctcaagtttctaatggaggagatagacagaaagcttaggaacaattttaaacgctttagatattgaatgcaataaagaaaaaaaataggggcatgggcctgttgttcagtatggtagccacaagccatgggtggctatttaaagttaaagtaaaattaattaaaatgaaataagagtaaaaaatcagttcttcagtcacactggtgaccttcacatgctcaatgaccacatgtggctagtggctgttgtatcagacagtacaggtacagaacatgcccatcatcatacaaagtgctgttggatggggctgggcttggcagtgactggaaaggtacaggagggtgttttcaggaaaggtcttcctgtggagccagcatttgtgctaagacctgaagccacccatacaaaggtcttaggggaataggcttcgaggcaggatgaacagtaaatgcaaacattctgaaatggtaatgagctttgtctatttgaagatccaaagacggcctgtgcatctggttgagttagagagggaggaaagagctagatcaagcatgaccttgggttattccataccaatgggatgggttgcttaagcaaggtagttttatttcattttaaaaggatcattctggctgctacggggcagagggaagcaagggtagaaggagcacataggaggacttccgaaaccaactgatgaatgaaagaactgatgaaaggccctgccaggctggggtgtccattagtctgatatcttcttatgagggctttttgggtcatgatggagccctcaggggagttcctagctaccttatgaaaccctccatcatggcattagactgaacagtggcccgactagcctcacaatagcccaggcccttggactctacacagttcccctaacagtccatcctgactctctaggtcatagcttggcccactattggctgcccttagcccctctgagctcctgccgtgtcctcaggccacggtaggacattgctgaggtgggacactcccttctctctttcttcgcattccttcaacagtctctactgagtacctgttctgtactctgtattgtattagataccgagattacagtggcacaggaagaaacagctatgcttcctccaaacatgtatctcacactgtagagcagaggccctatcaactgagtaatcactcagataagtgtgcgatgacccctgggataagtactatatgggacaggctcgtgaggctccaagatccccagtcaaggagttcagaggcagctgtcctaggcacatgataactgagctgaatccaaggaggaaccaggattgtgtgagcagaaggtggagcaggtatcctgggcaaggggaccagcatggacagagaccacatgcatagagaatcatggagcaatggagctaccagcagagaccagggaggctgaatggagggagcagtggggaggtggtgctggtgtggctggccaggagggcagaggccagagtgagcagggcctcatcagccgtgctaaggatcttgtcttgtgtcctaagagcaggaaaaagtccctgaaggattgcatgctgggagatggcccactcaggttggtatttctggaagctcgctatgccataaggagatgatattgaggggcccaaagtgggtgctgagggatcagatgtgggagacgactgtgtcttcaccctggctttcagcgtttccctctgtcctctgcctgtcagtcagctccactgcaatagtgactgctgccatttgttggaaccctggtaggtagaaccacatgaacttgctggtgttcggcactttttagcccacaaaagggtagttttatacagttcaatctaatattgtgtgccaggcactgaactgagtgcttttgactttctccatttatttctctaggaaacttgactataatctgggtggttataaactcattttatagatgcggagctgagaggctgtagataaggagcagagctggggttggaactcagtgtgctggagttaaacacttcactccatggcttttagagtgaaatgcccagtggccagcgaggcctgcagaaagctgcagtggaaagccttcataagtggcttgttaagtaggccattaatacttgtatttgaattttctcaggctggagattccagatggctggaagagggctattcattacctattttttttaaaggaactgtgacacttgggggattataaatgagttaatacttagaaatattctggaacagatcattaaaaaaatcatttttcacatatgaggagaaaatgagatgattgagtagtaaccagacggcactaaacctttggagaggggcatggctgagtagcaatgatgttacttccccataggacacacatgcaccgggagctgggtgtttgtttggctcatgtagaactagtattcctactaatttttattttttaatctaagttgtaaaaagctggccatcatcccagagctgggaagaagaaaacaataaggaaaaaaggagaaaatgaaaacacattaggaacctgctgcaggcactgtgtggtgacttgtgtacattgtatcccattcgatcacagaaagacctgaggaggtgggcggcaccaatcccacttcacaggaagagaaacagtccgagactcagcagtaagcaccgttccatccctgcgcagcagcaggctcccacgccctggctctccgggccataccaggccggttcccgcttcatgaatggaatgcagggttgaatccaggcagaggaaggtgtcaacagaatcaggaggtccatctaattcttcctctggcttgatctaaattgccagggagagagtgggaaggctcttcctagctggaggtaaaacacaaaaatgtttccctaagtggtacagacaaggacagccatgtctgttcagtcatcttcacacctttgactgaggacctctgggcactgtgcctggtgccaggactgtggaggtgagaaaggcacctccacagatgctgggaaggacagatgctccaggaatccagggatgcataggtggctacctgtcctttgagggctcaccagtggagtgaataccatgagggaaaggttcaaagaacccgccagtttcccccatggggagaagagttcagaggaagcggggttgctgggaaggggaaaggcttcagggagagtgggagacccttgagccctgcaggtgtgatggagcccatcaccatggattcctggtactgagttcttacttctcttccctgtgctggatgccgtgataggagctgggcatacaactgtgaaggagttcacagttactccacgttacagatgaggagactgaggcacatataaggaatatatacgtatctcattatcctatccatattctatattctctctctctctcctgttggttctgtttctttggagaaccttgactaatagtcacttactgagtgggcactggctttgctgctgaccatgtgttctagatctttccgccaggctggatttttggagtaggacttgttcttagggtcagtggtgcattgatgtgagagaagctcaggtgcgcctcttagggagtttgcagccagttggctctacagcatgcacacaggaaacaatgcgagaagctacaggaggaatttaatttccacgccacaatgtgtggagcctaggaaacaagccctttgcggtggcaccttgtatttttgttacacaacttaccctgcaggacagggaagcagaagccacccttgaaaacatggtgtctcagcctgggctgcacattggactcacctggagagactgaaagaatcctgctgcttggacctctgtccagggattcagagttcattgttctgaggtttggccagagttgagaagcactgtcttaggacaccttgatttctgagattatgtgctctcacctgaaaagagggaaccagagcagagttcaggaaatgagggcttgcgggccatgtcctgccagctgcctgtttttataaataaagttgtattggaacacagccacacccatttttaaaatgtattgcatttggctgtttttactaaaacagcaaaattgaatgttgccacagagactgtctggcctgcaaaacctaaaatatttactatctggatagttctttgcagaaaaagtttgccaacctctaaactggggagtaatgagttttgaaggacgtaggtggtggaggagaggctgggccaccagtgagaaggtagcaccctttcctctggttgagatatagacctggaaactttctcaacacgcacaggcagtcactgccagcccaccagggagggcacgcaaacatagcctttttgctgtctaggagttcttcctatagaatctgaagctttgctctacatggttacaggagcctagataaactggtgattaggccagagctgctggattctacaggggcagagggctgggctggagcaatggattcctttccctggtggcacctctatcagaattgaaaattgccactttctgtgacagtggcattaaaggagaggaactctgaaggcaagagggatgcccaggtggtccttagggaagctgcagaactgtcaaggtataacaaagccaggacccttgttcttttcttcttatggtgatggcacagaccagcaattctggacacttctggagtcatctttaccatactactctggaccagctcctctgtccaaatctgtgacagaagctgtgcaacgataggaccatggcctcctacagctttcccttatcccaggccataggagccattacttatagcgtgatcttcctcaccctctgagcagctttccctggcctcacccggcctgaagagttgattgtgaaggcaattttgtggagtgcaggtcttgtgagaggcctgtggatcaaatggattttgacactttcatttggtcaaccaacaactgattaccagttgtcaccgcacgaggacgtgctccatgtgaccccaaaccccagtattcaaacactttaacttagaaagggttaaaggctctgataagtccttcaatgaataaacctctttgcctttccttaaactcagctctccctgtatttcccaaactttgttcattgaaaaagaaaaaacctgtttccctgtgagtatgctgtagaatgactttctgttctacagctcgttctctggacatgctgcatctggggctgcacggagtgagcccagagagaatggaatgcccagagagaatatgctactttaatttccatttacatttaatgtcatttttgtagtttgttttataatgtacaaatgttaagacaatggcaggtagtacatatgagttataaataaataaatatgtatgtgggaggtattgctcaaaacttttttttttttttttttttttttttttttttttggagacggagtcaggctctgtcacccaggctggagtacagtggcacaatctcggctcgctgcaacctccgcctcctgggttcaagcaattctcctgcctcagcctcccgcatagctgggactacaggcgcacactaccacacccggctaatttttgtattttaatagagacagggtttcactgtgttgtccaggctggtctcgaactcttgagctcaggcagtccacccgtcttgacctcccaaaatgttaggatttcaggcgtgagcaaccgcgcatggcctcaagaactttttagtgaaaggaatgcttgatcaaaaatgtttggaatccttggtccagaaaataatgtccagtgcttattccagtattcaggaccttctctgccctggcccccacctgtttttgtctctgaactccccattactaccctctcattcagccaatctgagatatgtcctattcccttccctagttaccagctcctatgcctttacttctcctgtctccctccttatcttggcacgtcctaatcctccaattttcaaggcccagcctcgtgcatctttgctgaaaatctcttccagtcagagaagtttttaataatttctgtcccttgaatatccgacagcatcctgctgcctgggttgaccaactacagcctgaaggccaaatcttttttgcaactttgtaattttctggtaaatggctggagcacagccaggcccgtttgtattatctatggcagctgtcatgccacaacagtacaggtgaagagctgcaacaaagactctgaagcccaaaatatttactgtctgacccttgacagaaaaagtttgctggcccctgccctattgaataacttttaaatacttactcattgaaccacttcctgagcctgggcctgggccagtatctggtgaacaacacacccagtactttgtctctggtattttatatgccacattttgtcccctagattagttctgttgtgctcccatcacacttagtaggtcatcagacacacccacaaaagaattaaatttactcggatgacatggggaacaaggattcagaaatactgaggtgacttggactaaacatgtcttttcctgcattgatcatatggacaaaaccactgagcctcataattagagcaatgcattccaaagactgagaaatgattcttcttgtttgtactgaatcagccttttcaaaatcaatacagaagagacaaatgggtttggggaggagaagcagaacacacaatcgtccctggtaaatgatgagcgccattgagcaaaatcatgcttaggctttcatccctatttcatctgcattctgggcagcgcagattattcaattaaatggcagttttgaagctgctttcagagagcctgtgcatgaaccattattcattgtcctttgtcaagcaggctgaggcttcattttgctattttaacttccagttctatgaaacgatggagtgaaggcttgagtttggaaaaggtagataatatgtgaagcgctttggtctatggaagattaagacttccttcaacagggtgctgtattagtctgttttcacactgctataaagaatacctgaggctgggtaatttataaaggaaagaggtttaattgactcacagttccacatggctggggaggcctcaggaaacttacaatcatggcagaaggggaagcaggcctgtcttacatggcggcaggtgagagagagggagagagagagagcaagcatgaaggggcatacttatcaaacatccacatctcatgagaattcactgactgtcatgaggacagcaggggaaactgctcccatgatcccagtcacctcccatcaggtccctccctcgacacctgggaattataatttggattacaattcaagatgagattgggtggggacatagagccaaaccatatcaggtgctgtgggaagaagtgctgctgacatgtgtcctagaaagcagactgcttaagagaaggggtccttccaattggcattgagcggttcatgggctggtcaaggtatttccgcacagtgaggagtgccattgattggtctttcagcagaaaagtatgatgtttttatttctgggtgacatcttacagtgaattttgctttaaaaaatggttagggatggaattttttaacttgagttctgtttctataaacttcttgaattaataattcaaaaagaattgaaaggtctttagtgactttaattttttttattgaggcatgaatttctatatggaaaaatgcgcagttctttagcatacaattcaatgagtactgacaaatgaatccacctgagtaacccatgtatcatcaagatagggcaatttggccaggtgcagtggctcatacctgtaatcccagcactttgggaggctgaagagggcagatcacttgaggccaagagttcaaaaccagcctagccaatatggtgaaaccccatctctactaaaaatacaaaaattagcagggtgtggtggtgcacacttgttatcccagccacttgggaggctgaagcaggaggatcacttgaacccaggaggcagaggctgcagtgagccaagatcaggccactgcattccagcctgggtggacagagtgagactctgtctcaaaacaaacaaccaaccagagagggaaatttccaggactccaggaagctctgttgtgtacctctctagttgactctcactctccctctgagaagcaactcctgagtgccatcactattgaataataattttgcctgtattagaacttcgtatgtatgaaatcatgcatatgtactcttttgtctctggtttcttttactcagaatgtttgtgagattcattgatactttgaatgtatcagtaagttgttgttaagtagtaatccattacatgaatatatcacagatttgttaatcctttaactgttaatggatatttaggttatttctagtttggggctattatgaatggggtttccgtgaatattcacacaaatatttttgtgggcatatattctcatttcccttaggtaaatagctagaagtggaattgctgggtcatatggtagatatatgtttaacattataagaagctgcaaaatgtttttccaaagtgtttgtaccattttatatttccacaagcaatatatgagatatttgattgctccatatccttggcaatgtttaatattaccggaatttttaatgtcagcacttctagtgggtataaaatggcatctgattggagttttatttttgtactttcctgatgactaatgacattgaacacatgttggtctgcggattgaccattcacataccttcttttgtaaagtgtctgttcaaatcttttgcccatattttgattaatattttcagttgagctacaggagttgtttacatatttagggcacaggtcatttttcagatgtgtgtattacgaatactttttcctgaaccgtggctttcatttttgttttattactggtgaatttgatgaccagaagttttgaattttcataaattccaaattatccatttttaaaatgtaagtgccttctgtagcctaagaaatcaacgcctacctggaggccataaagtatcctttacttttttcctagaaatattacagatttagtttttacatttaagtctgtcatccatctcaaattcatatgtgtatgatgtgagttaggggttgagaatgtagtttttagtcatttgcttcagcacagtttgttgaaaatactgtcctcactgaattacctaagcacctttatttgatgtcaattgaccatatatgtgcagctttatttctgcactctccgtttcatgatctgtttgtctattctaatgcttataccatactgctttgattaatttgatttagaggaaggcccaaaatcagaaaatgtgagtccttgggcttttttcttctttttaaaaattgttttgaaaattgaggtctcttttacttatatgtaaaattttaaatcagcttttcaatttatattaaaaatgcttatatattttgattgggagttcattgaatttgtagatcactttgggaagaacttgcgtcataaaatagaattctccaatttttgagcaagctatctctctccatttatataagtcttctttaagttcaaacaaatatttgtggtttttagtactttgtagtatacaggcattgcacatagtttaatatacacctattatagtttaattgatacctgttttattctatgctatcataaatgctattattttccagttcaatttccaactgttttgtgttagtatattgaaataaaatggattttgtgtatttattttgtattctgtgatcttgttaactctctttaagttatattatgtgaattccttaggattttctatatagacaaaatctatgtagaaaagtaaaggtagattttttcccttttcaatacctatggcttttgtttatttatttgtcttacagtatttgccaggaccacctttacagtattgaacagaagtggtaagacaaccttgccttattcctgatcttagggggaaaacattcagtgcttcttcatcaatataatgtcagatacatgtttttttgtaaatccttttcattaggttgaagatatttttccttatttcaaatttcctgagggtttttatgatgaacaaaaattgaattctatcacatgctttttctttatctatttgatgttatgattttccttctttgttctgttgatgtggtgaattatgttgattaatcaaatattaaaccaaccttgaattcctgggattaatacagtttggtcgtgatgtattatccctttatttataggtggatttgatttaaaattttgttaagatttttgtatctaggcttatgagggatattggcatatagttttttttttttttaaagttcttgtttggtgtcaaggttaggctaccctcattaaattagataggaagtattttctcctctaattttcctaaagagtctatataagattgtttgtatttttttctcatatatttgatagaatccatcagttaaggcatatgaacctagagttgtttgtttgttttatcatggctattaacagtgaaatcaatatcttttgtatttctagggccagttatattttgtatttcttcttgtgtccattttgataatttctgtttcccaaggagtttgacatttaacctaagttattgaacttattggcataaagttgtttgtaatattcccttatcctttcattatctgtaggatctggagtaatgtttcctctttcatcccagatactggtattttctgctttcttactttttttcttaatcagtctaactagaatttcataattttgttaattatattaaccaaattttggtattattgattttttcctgttacttgttttgttttaaatttctgtacttatctctattactttattccttcttttaacattgagtttcatttattcatctttttaataccttgttaaggtagaatcttaaggtagactatttatcttgaaatttttttcttctatattataagcttttaaatgtgtaacttcttctctaagctctgctttcgttgcatctcacaaatattgatatgttgttttcattatgattaatttcaaaatattttccaatttcccatgtcatttttttccttgacatatgtattattaataagtattttgtttaatatccaaatctttagtctatttgcaggtatcatcttttattaaaatctagatatcaatgatatttttcatatcaatatcatacattgatttctaaatttagctcattattatcagagaacatagtatgtggatttcagtcattttaaatgtattgagacttgtttgatggcccagtatatgatctagaaaagaatgtgtgctcttcagttgttaggtatggagttctataaatgttaactaggttaagtttgaaagtagtattgctacaggaccaacccccaataaaaatcctgaatgctgagtctctgttagacaccacttccaatgtattattacaactcattaatagaagaattaagtataatctctgtgattgcactggggcagaactcttggaaggttgcacctggattccttgggactttgcctcatgtaccccttccctttgttaatttttatttggatctttgtactataattttaaaaagaacaaatttttggtttcattgatactactgattttctgtttttaatttcattgatttctgctttgcagaataaaaaatatacattttttctgcttactttagatttaatatgctcttctttttctagttttctaaagtagaagcttagatgattgcttctagatcttcttttctcttctgatacatgtgttcagtgctataaatttccttgtaagctttgcttttgctacatcccacaccttttgataggctgtgttttcattttaatttttaaaaaaattatcttgagaattcttttaaaagtatgttgtctaatctccaaatattttgggatttttttcagctatcttttttgttattgatttccagtttaatttcattgtggtctgagagcagacaccgtatgatttccattcttttaagtttgtgaagatgtgttttagggcccctgatgtggtctatcttgaatgttccaagcaagcatctttacatgcttaagaagaatgtgtattcttctctttatggatgaagtattctataaatgtaaattagatccaattgatggtattgttcatttcaactgtattcttaccagtactttgcctcctgagtctgtcagttactgatacaggggcatttaagtctttaactataatagctagttcatctgtttctccttgcagttctatcagtctttgtttcatgtattttaacgctgtgctgttagatgcatactacattaaggattgctttgtcttcttagagaattaacctctttatcattaagtaatgcctgcctatcttattccttgataattttccctgctctgaagtctgttttgcctgaaattaaaccaactaccctcactttcttttgattaatgttagcatggtatatcttcttcatccctttacttttaatatatctgtgtctttatgtttaaagtgggcttcttatggacaaaatatagttaggtcttgtattttaatctactctgccagcctctgtcttttgattgatgtatttattccatgctcattcaaggtgattattgatatagttggatttatatgtaccatatttgtaacagttttctattcactaccccaggtccgtccatcttccttccttcctatcttccttccttcctatcttccttccttccttccttccttccttccttccttccttccttccttcctttctctctctttcttttcttttcattcctttctttctttctctttttctttccttatttctttctttttttcttctactctttttctgccttctctagttttaattgaacatgttatgtgacttaattttctctcctctcttagcatataaattatgcttccttttacagttattttagtagttgccttaaagtttgctgtatgcatttacaactaatttaagtccacttcaaataaccttacactacttcatctgtagtgcaggtatcttataactgagtgtcttggccatttgtgctgctacaacagaatacctgagactttataaattcttcttaatttataaagaaaagaaatttattttctcacagttctggaggctggaaagcccaagatcaaggtgctggcatgtttagtgtgtggtgtaggctgctctgcttccaatatgatgcactgatactgtatcctcttgaagggaagagtgttgtttcctcacctggtagaagatagaatggaaaaagggacagactttctctgtcaatccctgttataaggacatctaatcccattcatgagggaggagccctcatggcctattcatctcttaatgaccacaccacttattactgtcacattggaacacctaaaatttggagggaacacattcaaatcatagcacagagtattccacattcctccctccggtttcttataacactgctattattcatttcacttatccatagacagtaatttattactattattattttgaacaagctgttatatgttagattagttaagaataacaaaatattttatgtaccttcatttattcttgctctaacactatttttttttttttttggtaagacagggtctcactctgtcacccaggctagagtacattggcacaatcatgactcactgcagcctcaacctcccaggctctggtgatcctcctcgttcagcctcctaagtagctgggactacaggcgggtgctgctgcaaccgactaatttgcctgactaattttttttttttttgtagagacagagtttcaccatgttgcctagggtggtcttgaactcctgggctcaagcaatcctcctgccttggtttcccaaagttctgggattacaagtgtgagccactgtgcctggccaaacattcttcctgtcttaatgcagatgagaatttctaaactatatcattttgcttctctcttaagaacttttaacaattcttgcaaggcaagtctactggcaacagattccttcatttttgtttgcctgagaaggtctttatttctcctttacttgtgaagggtaatttcatgggatacagaattctaggttgatggttctttctttgaacactttttaagtggttcactccattctcttcttgcctggatggcttctgaagagaagtctgatgtaatccttatccctgttcccctacaggtaagattctcccaccctctttctggtttctttcaagattttctctttttctttgattttatacagtttgaatatgatatgtgtagatgtaaatcttcgtaatattcattgtgttcagtgttctctcaacttccttgatctgtagcttgatttttgtcattaattttggaaaatactcagccattattatttcaaatatttcagtttccattcttctcagtctggtgtcccattacacatatgttacacgttttgtgattatctcacaattcttggatattctgttccctttctattttctcttctttttgcatttctttttggggagtttcttttgacacatcttcatcctctgcaattatttccttggctgtgttcagtctactaatgaaccagcaaaggtattcttcatttctgttacaatgtttttgatttctagcatttcacattgattctttcatagaatatccacctctctgcttatattacccatctgttcttacatgtccgctttttccattagcctctagagcatattaattgtagttattttaaggttctgctctgttaattccacccacacctgccattggccatctgatacagtagatttaaggacagactcaagatagatggcctgtatttgaattctggctttccttatcagctgtgtaattttttgcaggatgcatacattctctattcctaagtgtcctcatttgtgaagtaggaatactcataaaatccacctcataacattgttaggagaatcagatgagttaacacatgaaaagcacttagagtgatttctgacacaaagtaagccttctgtatatgtgagatgatgatatagccatttgtaaatcatgccagcacactcccatctgagggcttttcccttgctgttctttctcggatgtttccctgatgcccacaccactggatttctcccctcatttaatctctatttgagtgttgccatcgcagtgagaccttctcaaacaccatgtataaacacacagtccttctgaagctgctaatccctttaccctgctgtattatttttccatagcaagcatgatgatctgacgtatatttgcctgttattttttgctgattttcagcctccttcaacttaatataggctacataaagtcagggtctctcttcaaaatttaaagaattaaaatgtttctagggcagttttctctatatgcacataagaaagtactgcgttgccccttaacatttatgttttctgggagtatttagtgacattggaaactatttatataatgctatctcacccatgcaaaagcagccatggacagtacataagacataaaaagattatgtgagcagatcagggtccacagtgtaagggatggcacatggcctgtgcccaggtctaagtgagttcacagccctcttccctaagccacatgtaatgttttttgactttgtctttcagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaaggtaagactcccagccactgctccttttagaaggtgaagaatcagggggttgagaagcaggggctggctggtttgggatatagttttggtttgtttcattttttttgaaaagcacagttataagctgagtgtgtcaggtatcaactggataggtgaagcatgtacctgttctgcctggagcttctgggcttgctgtttctctggctggttgtttacatcaggctctctaacatgtagaataggggttggcagtttctataaaggaccagatagtaaatatcttaggctttgccagccatagagtctctgttgcaactactcacttctgctgttcaggcacaaaagcagccaaatggctgtgttccagtgaaatttatctacaaaaagagatggctggatgtaacctgcaggctgtagtcttctgacccctgatgtggtacctttgttttcttcttccagtttgtggaatggcatttaagggctggagagctcctaggggtgcaatggaaacagctggggtcttttcttagagtataaagcagcatggaccttaacagaattccttatttccaggcttgtgtgcctcaaatccagtcttcacataaactctagagtttatttttccctaagttcccatctgccaattccagttggaattatagtggccaaggactgggctctgacatcggatggattctggtcagaccgtgttctacttctttctggctgtgaccttgggcacgtcacctcatctttttaggtctgaattttctcatcttatgatgtgaataataatcatatctacctcctgggggtggttttgagggctaaatggaatgatgtttataaagggtttaagttgttttcagcatctttatcctattgctatcgagtagtagtttgctctgcttggtcatacctaaaaaacttctaaacaaagaactatcctcctagaaaaataagccagaaagtcatggaatcttcaaagtaaaaaatgtgccacattgtctcccatcaaggtttcaaagatatcaggggccagtttccaaatcatatacaagagctcagtagtcaagagcaagggctatgggtttaagtcctgatcttcctcttgtaggctgtgtgatcttaagcaagcaactttgcctttctgaggctcagtttccctatttgtgaaatagggataatgatgctgcctccgtcagagggttagtgagaggatatgaaatgatgtgtgtgtagcccttaatacaacagtaccatacagaaagtgcgcagtgcattttagctgccgttgtttttattggaaaataacgtgaatacaaattgcacttctgaaatgttctaagtcactatttaaggggcttggtcagtgattaaagatattccaactaactgtctctgaaacatttttcttacgcgtgttggatattaggtatagttggatacctaatgtctctttttcctggtttacctgttatccatccttaagagtcagtggaggcagtaccccattcattaactgttctgatagttactggggattccgaggtgaatcagatgcagcccctccctcaagaggttcacagttcatatagggaacagataatgagataattagaacaccatgtatcacatattggccacagtgtggacagccaggggacagtgggagtgccaaggatgggacctgtctacttcttcacatgggcagggccacagttcatctttttttcttttttcctcttagagaaagtgatgtgaatctaaacaaatcctagagggctctggactgggccatatcctctaccctactctttactttgggctcttccttagaaacaaatggaaccaagacatagagggctgagctcagcttcatttagtggagtttagttctctagaatgatcctgtcagcagatgaaatcctaaatgaaactgcccctttttgtgcgatgtggccaaaagaaagccatcttcttggcattcaatatattcccaactgaagatgaaaaattaacatgattttacagagcaatttcagacataaaacaattcagaatgatcttttaaaatatgacagctgcttcaaggtttcttgagccattaacaccattatagagatttaattgcacctctagctttaaaggcataattgtgccttttaatggtagtaacacgtaagggacccacaccaccactgatcacccaggctatagaatcatgcttgtaatgattcctagacagaatcttcagagatagtcagattttttgagccgttggatgtagctaatgatattcaaagtcatcctcagcagccctcctgggatctgcccatcacctctgcccagtccattgtcacccagccaggctgtggggcatggaccagggtcagccaggtgttctgtcttgtctcagccaggcagtgaatcactgcccaagggcagaggagaggcagggacttcaggcaaattcctgtctccactctacctaattcaaaacagcccctaacagccttttttttttgttttccttttcaagctgcaggaatatattttatgtttagaaggccctccagctcagatctagttattgatgacgtactcaaaacaaatgctcagagattggtcactggctgtgctgtttttgggttggaaatcttacccccagcgaagaaaaccaatacaaggtcattctctcctagctgcttggacttctgtgggcatataccaaagtggtttgatacttgcctaggagcttctgtgatctatgttctggggtataatttttagttctagatgaaactagctggtaaactctacctgctttctacaatctgctttctgcctccgtgggcgggcctggcaactgggctgctcagccgggtttgtgctttcctctctggctgaggtgcctttctcttgagcactgaaagagactgcagcttcaaagttggtgatgtgggcaagctgtgcccatgggaactcaaagaggcatattcattgagtgtttagaaatgcatctcagggccctcaggttgcctgatgcagcagcttttttcatgaaactccttcagcagatgtttgctgagtggctgctctggcatccccagcttgtgagtcttactatttcggagactttgaagatgaatggctgatacctttagagccgtaaatgactccatatcctctatgagtaaagcaagaggcaggatgcttttgcaagaactgctgatgatctggcagagaattcagataaagctgaactcttttaaggactttctcaactgaagtgctgtaaagtttatacgtatatatacacattatatatacacacatatatatatacatacacacacatatacagtacatatacacatacaccttatatgtatgtgcatgtttctgtctatgggcaggtctgttcatgtgtgtttgtaaatatgtgaatgtgtgtgaaagaaaatgctgtgctctcaacctattccttcatttccattttccacctctgtccacccgggtgagaccctgcttttgttcactgaacacaccttcctttttcttccattgtagtgtatttcactgtttttattcctattatccctgtccctcctttcctgcttgtcctaatgcctattcttagaaaccagctcaaatataacctccttgattctttttgtcttgtgtgatggaagtgacttttgtttattcctctgctctagcattgctctgttctgtgaatgcagagcatgcagtctttccttctctactttaggttctctgagggcagaggaccctgcagatgcagccttgtgccccctttacccctgcccatgctctttacagatgagtttttcccagatgttggttggtgtggaagacactgacacctgtgcctcctgggctatgagatgtcatccagggctgtggtgttttcatggttcttataagcaacagaaacagaacctggctgatagcaaagaaactttttgagaggagactgggtggcccacagactcttcaggaaagctaaagaataaggcctggaaatgtctgggaatggagggaggctggggccagagtcacacccagagtcacacccagatccaacctgacaaggacccactgaccccagggttgccctactctcacatctgtaactgcatacaatacctgtgcctcgttttcctcatccctaagctggagatgacaatcatagtgagttgcctcgggggatgtgctgaggattgaacacttagaggggtggatggcacatggtgtccatccaggactcaagtgctgtggtctgaatgtttgtgtccttccaaaatttgtatgttgaaacctaatcacccaggtgatggcattaaaaggggagcctttagcaggtgagtaggtactgtaactccaagactgagggagcttgttgtccaagggggctgtggagtggggcaagttgggcagatcccagccaaagtggcagcagcagtgggaacaactgctcctttgtggaagtcagaaaggcagttatggagcctggaagggctggccaggtggtgagaggctgtgggagccatcaggaggtcatgaacatgatggtgacaggtgaaatatggctgacagctttgccaggaagagagccactgaagaatactagttcccactcacactgaagaagagggagagggaggaggtgttcagggcctggtttggagaaaatccagagaagaacagcacatgggccaagactggatggataaggtgagagcccttgggcctggggccctagagagcaagctccagtgagcatatcagccccatgaaggcgggaaccccagcaggatacccagcacatggtagatgctcaataaatacttattgcaaggtaagggaatgaatatagattacaatcaaaacactgttttcactttgttcttgcacagaggaagaaaaaacataggaagtaacccaatctcaattcctcttcttcccccagtaacggaggacatccgggagaggtaggctgaagtggcagaggtgaaggggaggtgtgaattgcaggacacaggctagaccacgctttcatcctctagacttccccagcagggcacccagtcgggctgggaaaactgggctgcaaagctacattgtgctcagggtccagcccctgaaaatgaaaagagctccaggaaagggaagacctgtaaccaccactgcagagcatgagaaatcagtctgtctgttacagtccaataggttcttctaaaaagcccaagaaaagggcagaagtctgatgagatggcattgggtcccctgcttaggagcagagtatgcaggctgctggagggatgggcagggttgctgaatttggatttgtcagatgtctcaacctatttttcaaatgttgagcttgataaaacacaaaatgcattttgccaggcacttttccccttaattacatgtgtatattttaaggaaaatttaatccatatgtttctgattcgtttacacggaaatcattaaaatattgttttccaagagctatttgatgtgcaagaaggctcacaaaccttataaaaagctgtttaaaattttttcctttccctttgtttcttttcccttcacgtgtgtgtgtgtttgtgtgtgtgtgtgtgtgtgtttgagagagagggagagagagcacacgcacataagtgaacaagagtgactgaccccaggatgtcagaaacaaattccaacttgaaatggattttcttctcaggattctgaactaaagcatttggattaggctccaatcttgcttccttgttgtctcccagccctaatggaatgtgatgatgatatggccataacttggtattgggagtcaagatcagaggaattacaccagagcacattgctctggacctagagaaataacactcgagaacctcctcgcacatggtctgttggtacctacagtcctcagcaaggcccaggaaactttcccaagatgtagtttggattccaggaacccctattccagcaatatgagcataataggactaaggcatttggtaagaaacatacaagatagtgccactgaagtaactccacagctgtcatcccaaatttactcatagtttttctcttctagtttggaaattatattttatatggcaaaataactatccctgacttaaaattcacaagttgagtggctgagttcaagtctattggcaatgcctccatacttctgcatgtgtatgtggcacaataggtctgcagagatgtatatgtgtgtatgcataggtttgtgtctgtattttctcagaagttgtattagtagaaggaaggtgtgatttggccctttgtggctcctcagtcctatgcttaggcttatgtttagcctggaagttgcatttcatgaatgagtaggtggatggatggataaatggatggatggatgaatagatggatggacacatgcataggtagatggatggatgaatggatggatgaatggatgaagggtgggtgagtgagtggagggatggatggatggatgggtaggtgggggaatggatggatggatggatggatgaatggatgaatggatgaagggtgggtcggtgagtggatggatggatggatgagtggattacttaccaacagccatgctctgtagtgaggactttcagtgcattatctcattgacaatgaccccatgtgttatagaagcagtggggaccaccattctccaaggcaattcttccacagcctctgttctagagtcaggtccagggaagttacctggggcaaaactcaaaggcatcactttaggtacaggtgattctttcccaaaatccaagtgagaaaagagtttatgcttcctgcctaaggctctctgaagcactgttcctgtcccctggttcccttttcacctgggtcactgtcccttgccatccccatcatctctgttcttgtctaccatggagctcttcccagagctatcaaggagtctttggagattggcaggcctgggcttgtatccagtgctatgagtatcagcatggtggactagaaagggcatttcactcttgggccctctgtttcttcatctgtaagatgtaaattgtcattttgagcattaaagaaagtgaaggtgcagcatccagcagaacacctggcacacggaggaatttgatacacattgattcctcacactgactcagctcccagcaaaccagatgggttaccgtcactgtcctgccaaaaatatgtaggggatgctcttccccaagcccagaccccttccattcagccctgtttgtagaatgaagtgcaaacacgctcacaaaccagctctggtttactgtcctcttttcctggctaccccattccccctcttcctggtcatgctagatcccaggattccagactctctgaagacctttgcttaggctctgacctcctgctgagggtactgtcctttctccattctggaaagacctgtcctttcctgagagcctggctccatggctgccatgtctttccctctggccctagccctcctctccagaaacatcctctgccccctcatttatgcccccgtgtgggggttttgtctctccttctgttagattattcatcacatttttcagcagtttctttttcactgcactctcctcccttgaacttggaggcaggggctgtgttttttttttcattcccttgggaccatagcagaggacctggaatagaaatgcgcttctaaggatgttgttgaattgaactgaatcctcttattacaggccatcacaaatggttgttgttttatctgcttgttggttctgtcaactcttcttctatttaaattttgattcttgtttgtttctgaagacagtaattttagatgtatacctaatgaagtaattactttcaggatctaatttgtttgtatttttaatctcttttttcaaaggaatgggagtccagatggagtctcgcagttggataggagctgcacctaggctagagaaattctgaaaggtggtaccaggagcagtaaaggacaatgggagagcaggaatggttactaatagtgttttatttcaccctggtgccccgacatttgtgaaaggttacagtaatagtagggagctggagtttgtagatgatttatttttaaaaaatggcttagagaagtttcaaggttacttctatgataacttcaggatcaagcacttgctttctgtgttttgcctgggaaggagaagggtggagccaccttcagcaccgtgaaaattgcagcagcaactgttgcagcctgtggtggcagtcaagtatgttccagtgggggaaagagattaagagctactgtccctgggctgactcagttagttatatatgccacaggtccccctgtttgagaaagggattgccttgctgagggaaatgcagactagacttccaggatttaagaagcacggtagagaccagtagatggtctgcaggtggctcccaggcctcctcaggaatgctagccaggtgccctggccagccatcgggctcgcacagggtgtgtggtatgaatgtgaatataatatatccttgctgcctccatgttgaccctactcccacaaaaggctcagaccatgcttcttgcttatctgtgcaaagacaatgatagcacctatctcatgggggctttgtgaagataaaatgaaacaacggatattaagcatttcagactactgtgtaacaaaagtttactgagagctcaattgttagtattgttataagaatgatgatagtgacaccgggtcccccacagtggcatggcttatgcctgggaatatctctgatcctgagccaggtagccttcctttttctcctgcaccttggaaacccttttttcactgcagttgtacatcaagaaattcagtgaagggaggacaatgtggaggtagagttgctgggtcagaggctgacaagcaccctggcaggtggctcagtctttgatacctgcacctgctctccacccacctgctcatgatgcatggatgtggtgaacctctgtgtgtccatgtcctacttcttaggccactttgctcccaggaagcttggtgtctatgtcagtgaaaggctgtagggcttcgtattagtctgttttcatactgctgataaagacatacctgagactgggaagaaaaagaggtttaatggacttacagttccacatggctggggaggcctcacagtcatggcggaaggcaaggaggagcaagtcacatcttacatggacggcagcaggcaaagagagagcttgtgccgggaaactcctccttataaaaccatcagatctcgtgagagttattcactatcatgagaacagcatgggaaaaacctgccccatgattcaatttcctccccccaggtccctcccacaacacatgggaattcaagatgagatttgggcggggacacagccaaaccatatcaggctttaagtaatgctctgctttccttttgctggtaactcttagaaggacctgggggccctcagatgtttggaagcaatagcttccagggacataaagaaaatcttttcattttttacactcttttactcttcccaaatccaagctgatggaaacttctgtccagaacacactatctactcattgaccttagagacactcacctgtgccttagtcaactgatgcctccatcagtttcttttccttcaggtaacatttttgtggtgcttactatgtttcaggcataatatgatctcatacaatgcaatcctaccccaactcactgaagcaggaaccattactaattcccactttagaggtgagaaaactgaggcttagagacttgctcagaattactcagctagcaaagtgggcaatcagcatgcaagcctaatactttggctttagaaccacccgggctccacactgcctccctatactgtgcatctccaccaccctgatggctgagttttcagctagctatgtcatgcctgtttttgtttgtttgtttgtttgtttgttttgagatggagtatcactctgtcacccaggctggagtgcagtggtgcgatctcagctcattgcaacctctgcctcctgggttcaagtgattctactgcctcagccccccaagtagctgggtttacaggtgcacatcaccatgcccagataatttttgtatttttatcagagacaccatgttggccaggctggcctcgaactcctgacctcaagtgatccacctgccttggcctcccaaagtgctgggattacaggcatgagccaccgcacccagccgtcatgcctgtttatatgcacactttatatgtgcggcaaatggaaggccctgtttttgtcaaattgtgctattttcatctcagcatatgaaaatccatcataaatgaaaactagtcttattttacataaacacttccaatttcttccctttatgaaaataatgttgcagcaaagagtcgttttaaaaatgggaggcaaattctgcatcagaatgccaatgggtaccaactgctcacacataggggatatttctgttgggaatgagacagttccacatttaatcctgcaaacttgccataccaaaatatgtctaagagaagtgagtaaggaggtgatgatgatcagaatgcaaaaaggctcttctccttgccagaaagttcactgcagtgtgtttaggagaagtgaattcctccactatagcaactggaatggcatttgcagaactgggttctgtgggacactgccaccatctattgatttaataaatattcgtggagcacctctagcatgccagacgctgcatgggtgtgaggaggtgtggtgagagatgagcagactctgcccatgctctcttggagcttacaggtcagtgggaaggcaggcgggaagtcagcacacagctgggcatatgatgcacccggaggaaatgctgtggaggaaagggttgtggtacagtaagagtgtatcccacagcagctcagcctgggtgaactgggaaggtgggggtggccacgggcagaggacacttaggcccgctgccatctgaaggatgggtaggaaataatttagccaggggctggggtggggtgggaggtggagaatattgcagtgggagagaacacaccacacaagctattggtaagtagtccttcacagaatgttttgggttgaaataagggagggtgatgccttggagaatctaccgcttgtgccattgcactatctacctgagatgttcaaggaatacgaatttctactgtagaaaaagaaagccgttcaatctgatgcatcagcttttccctaagttacttgattatggcatccttttatcatggaacgtctcagaaggtatggacgtttcctgggaccaagagattctgctgagctggaactccctgtgctcaagagaaaggtcccaaaggtgcccagcaagtgacaaagatgcagaagaaaatgcatagtaaaatccgtgtgtgtgtgtctgtgtgtgtgtgtgtgtgtgtgtgtgagagagagagagagagagagaaagagagagaggatataagtggttgtatatgcagaagatttctggagagatgttcaggaaattaatagcgctgactttccactttctacccttctgttcagtttgaatattttatgaggaacatgtgctgcttttttagtaattaaaaatgaaagaactaaagaagttgagttacaaagctgcgcccatctacaagttagttgttcagagaacacagctatctgataaaaggaaatacgcctgcatgtaaattgttaatggcttcccaggtgctagctttctctgctttgtggtgaaaatggccaacagtagttttgttagaggtagcagaacgcccaagtaagttgtttctggcagtcagtgcagatgctacctttgcaggagattgtgttaagtttcatactgtgtccttatggtggcagtagttattttaagatgaatgatgttggcctgggaaaagagaaatggtttccctctaaaatgattctgtgatactctagtcatctgccgatgggtgtcacagacatggaaatgccctgcctcaaatatgaagaacattctgcacttgggaaaaaaatatgtcagtgcttccaagggtcacactggaaactgggattagaagtgaggttttcttgtctcaagaagtgactgtgcagtcccatttgttctctcactgacagagaactttcaagaggactttgtgaagcacctgttcctgggcctcagtggaccctcgagatgggaggcccagggctaagtggccaagagtgcagcagccagtctcctctgcttagatccattgtcaaaggccacatcctggagcctgacatgcatcagggacatgtgtcattgggggtttgggccaggggttccttgtaggccatcttcactacctgatgaatgcctgacaacagcacaggtgggctttggggataaggtgccctctctcagggatgttctctgctcagggccaccagttccttaagatgacatttgaaagttcacacctcagataggtgagtttctagtacaaatgacttgatgacctttcttatttctgaagacatcacaggctgccccgtgtggcagtgccatttcatcatctccaaagtgccaccgtctgaactcttccttcattcttaagtgacagaggtatttctgtacatttctgatgtttttcttttttccaccctcacttcacggtggtagaacaattctggagtggtttctacttcaacaactgctgctgtgctgtttcatgcccacacatgtagatatttgcatgtctccataggcatagagatgcaacacactggtactttatcatctggcaggtggactgatccacatcttagagatcaataaaatggcctacagagattgagggtgcataactttcagactggagtgaaaagtctctgggttccaagtctggttgcccactagtgctttgaagcagagccccagcggttgagtccacgcgaccacatcttcacccgtgtctactttattcaagtcccaggctggatgtggggaaattggatcagaactgactttcagagacttttctggggtagattttcatgttctctactcactgctatcaaaggcagggtgggaggaggggaattagcaagacaaagtgcccccaaaatccagatgaagaggtgatgaagggctgtctgttgggtctgcaggctcaggaccagtcggggtacctgtgatagaccagcactagtgagatagtggaagtttccccctgcaggagtgggagccccagaaaaggctgagttgggtggtggtgatttgctttttcacaaaccactttatagtagtcccttctaaggatcacacggatttgggtggtggtgatttgcttttccacaaaccaccttacagatgagaagacgcaggctcaagaaggttagttatttcttcaagtgtgaatttggatccaggtctgcctgttgtcctagctgcgttgcttaagtgggcaaaaagagactcccctcgagcagtggcttgggagaagcccaacccccaggctgctcctcattgatgaagaggaaaggttttcttggatccgcctggtcaaagccagattagagtgtagccatggctagttcttaatgacagtttctgcagcacaggctgacctcagctaggaagcattggtgtgggtatgctagtggttcagatagtgaaacgatgtgtgtgattggtaaatgacatagctccaagaccctcgccccagggcctcttgtccaccccagcccctccccacaactgaggagtcagcatcgcagaccacaggctgtgcccacctgctgcacaggctgtaaacactgagtatcacccaggtgtagagctgttgcgttccttcaactacaatataacgtggtttactgacagtgacgtcagcagtaggtaaatgtgcgtcttctcttcatgcccaacagaggttctgcctcttctctgaggggactcctgagcctcacagggcatccaggtgtcagctcacgtctcctgatgcccccaaggctgccttgccttgggctcaccttcctgttgctccaaccctgcctccctccttgctctgcatgcccttggaagctggctgacaaggcttccagggctgtctcatagccagtggaccaggaccccactgggctgaggtacgagcctaaagttgccccgggcatcctaccataagaggtcagccatctacctcagctttgcagccctcaggacccctggtgcttggggaagtcgttctggggctgggctttcctggtgtctttccaacaaagcacagtgggctcccataagtatcgtgaatggaatattttcagggactgaccacatctgcagaggcttctttacattaaaacagggctggggatgggggtggaattttcccctgctaaatgcagagctgagactaacactgtgtgtcagcgtggttacgagtggtggttggggtcccatccccgctcctccctttgctagctgtcagactggacaagttagccaactcctgtgagagttccgtaaggcctgatacccctacagcatgatggggagaagctacctgtgagaaagaatggcaaggaatggtagagagagggtaggggaagtgaggggtgaggaagtgggagagagagagagggaaagcaagagcaagcacctggggttccccccagtgtctgagaagtgcccctctgagaagcaccgagatggggtcacacagagtcctggcgtcttcttcatgcacccagcacctgtgtgacctgggccagtcatctgggaccagctgtaggctcctcttggcctcagccacccgactcattgtttttgtgcctggtattcttgataacctgattccagaaatgctctctgcttatcctgacacattttattctagagttttgggtttcttttcctctgtagctcattctaaggagttcgatgaaggagatactatgagaagttgtttcaactgtcaagatatgaaatatcttttgacatttttcaaccatttttcccctcccagatgtcacttgagttaataaaacaggaaagaagacttggggtttggtggttattttttttacttatacaggaaaagccatcttcagcctataaatatggattctgtatagaatatttgaaaatgacatttagtagctaatgtgaggaattaacaagtatatgtcccttgagaaattgaggggggagaaaagggactcaggggatgagggtggaaacctaagaacctcacagggtgtgggggtccgagtgccacctgcacacggaagtcatggtgacgaacatgctctgtgcatgtctgcctgcagggaggggcctctaggtgccaactgtcctcagttgacagatgggtgccctttggggagacatgaaatgcctacacctgtgaaatctgccatgtgttgtgaaggccagccatttcacactcgtggagtcatcactgagaaagaggctccccagggactggtttctaagatgagaggtcagtgtcctggtgttaacagtaatgacttcttagcaaggcaggggctgtaagaaagcggggttcacagagatgtgagtaggcccgaactgccttccagcccaaatgcaatctgggggacgctctgatcccattcaccctccaccatctcacagtgctctgggtgacaccagcgtttgagaggcagggatgcctcttttcctataatcaaaacctatagactaacagccccaccccagagtgaattggagatgaagaagtcagactgttcaacagtgcagtagggagtattttctgagccttgcctccttttcaggcaacacagcggcaatgataatatcttttcctattctaagcagtgcctttccctaataaatagcttagtcgtaggagatatgtaatatactttcagcttgtgccagaaagagtcttatctcccattccaggcctgtggcatatatttctgtataatggatggccaacttagcaggaattgtttcatactctgtgtctgaagggatttggtttatattagctcagctgacagaaatctaagtcagatgtcctgttgacaaaggatggagaccaagatctgattttaaatgggcagtgagtattaacttggttggttgaaaagcacaacattacgctggccctgaatggctacgttaaggccactggggccagaacagtgccagccaagaagtgaagcaaagagtttgaacacacctattatataaagctgtgtctgcattaagaataaaacctcttaagatggcagattgcaatattgtggaaactaaagtggccagtggagacaaagcttgttttacaaaagtgcaagttaacttcctagtggttccagtatccttctgcatagatacttcggactgaagttcattacatgtgcaaaggctgatatttagtgagtgccctagtgcagttcttcctggcctttctcacattataacactctggggaagcaagatgaggcaactctgtcagaagtactggaccagcaccatctcccttcctgagagccaagggaagagtgtcttggcccagcagtgggaggctggctttagtgtttaatctgagaagcagatgaagctgggtcatcacacagctaatttctggatgatgctcagtgtatttgtcccaaacaaaagagcagttctcaaaacctagaactgactcagtccgtggacagcatcaggaaggagtaaccttttagctgtagagagacaacctggggagcctctggacaccagaggttggagcagaggctctcatctcagtcacttactgatcaaaatcgctcagagagctgctgtaatttttcctaacccctttattgagatacaattcacataacatacaatttgcctgtttaaagtgtacaattcagtggttttagtgtattcacagatatttgcagccatcagtcaccattacattttagagcattttcatcaccgcacaaagaaaccctgtactctttggctatcgttcccttgtcccaacattcaccccacccctaagcaacgaatgatctttctgtccctatagatttaccttttctggatattttagataaatgtaatcatattatatgtgagcttttgtgactggcttatttcacttagcacaatgctttcaagatttttccatttgtaccatatatcagtattcatttctttttatggcagaataatattccattgtacataaatactacattttgtttatccattcatctgttgatgggcacttgggttgctactaactttttgtctattatgaataatgctgctaagaacactcacatttttctgtggatacatgttttcatttctcttgggtatatacctagaaatggaattgctggatcaaattgtaactctgtgttttactgtttgaaaaactatcaaagcggctgcatcatttttgattctcaccagtaatgtatgtaggttcagatttcttatctgactttttgtcagaagggtgagaagtggttttgatttgtatttctgtgatgactaatgatttcaaggcttctttttatgtgcttattgaccatttgaatatgctctttggagaaatgtctctttagatcctttgttcatctttaatcgggtagtctttttattatggtgttgtaagaattttttatgtattccagatacaagtcccttatcaagagatatgatttgcaaatattttctctgattctgtgagttgtcttttttgctttctggatgatgctctttgaagaacaaaaggttttaattttgatgaagtccaatttacctatttttaaattttgttactcatactattggtgtcatatctaagaatctgttgccaaagctaaggtcatgaaaatttattcctgtgttttcttgtaagagttgtatagttttagctcttacatttaggcttgtgctctatttgagttttttgtatgagttctatttgagtttttgtgtgaggtaagagtccaacctcattcttttgcatgtggctctccagttgtctcagcatggtttgttgaaaagactgttctttcccccattgaagcgagtcatgattcccttgtagaaaatcagtttaccatggacacacagctttatttctggactctcatgtctattgatctatttttatgctagtcctgattcttattattttgtagtaaaatttgaaatcagcaagtatgagtcctctgattttgttcatatttttcaagagtgttttggctattccaggtcccttgcaattctacatgtattttagaatcagtttgtcaatttctacaaagaggtcacctgggattctgacagagattgaactggatctgtagcttttttttggagagttttgccattttaacaatgttaagattttaaatccatgaatatgagatatattttttttcattttacttggatctttaatttttctcaacagttttgtagttttcaaaccctttgttaaatttattaaattatttcaaaatgtttattctttttaatgatattataaatgaaattgttttcttaatttcattgttgggttgttatggcaagtgcatagaaatacaattgatttttatgtatttgtattctgcaatcttgctgacttgtttattagttgtaatagttttttattgggtttcttaggaatttctatgtacaagcttatgtaatttgtgaatagagataattttacttctttctttcaaatccaaatgccatttcctgagtctattttatgttgctataacagaataccatcaagtgagtaatttatattgaacagaaatttattttgctcatagttccagagactgggaagtccaagatcatgtcattggcatgcaacaagggactttgggctgcatcatctcatggcaggaggctgaagggcaagagagggtgaaagtgagaaagggagaaagccaagcttatttctgttttcaggaactcactcctgcagcaaaccactattttgataatggccttaatccattcatgagggcagagacctcatgacctagtcaactcttacaggtctcatctctcaacactgttgtattgggtactaagtttctaacacatgaactttgggggacacattcaaaccaaagcaccatttatttatttatttatttatttatttacttacttacttacttacttacttacttacttacttactgaccaacctacctattgttctggctagaacttccagtatagtgacagttttgttctttgacacttggagtatgttatttcattgttttgatggcctttattgtttctagtaaaagtgttaagagcaggtaattcttttcttgttcctgatcttaaagaaagcatttaatatttcaccattaagtgggatgttattattactattttggagatatcctctataaagttgaagaagtcaccttctattcctagtttgttgagggttgtttttaatcatgaaagggtttggattttgtcaaatgcttttgctgcatctacttaaatgatcatgtggcttttgttttttgttctattgatttggtgtattagattaattgatttccagatgttaaaacaaccttgcattctagggataaatctcatttggttatggtatataattcttcttaagtgttgctggatttggtttgttagtatgacgtttttgcagtcatatttataaaagatagctctatagttttcttgtgatgtctttgacgttttggtatcagagtatgattgggctcatagaacgtattgggaattgttctccttttttataattttggaagagttcgtgaagaattggtattctttaaatgtttgatagaatttaccagtggccctggcttttctttttggatagctttttaaagttaataattcaatccctttactcgttgttttcagattatctatttctttttgggtcacttttcgtggtttgtgtctttgtaggaatttgtccatttcatctaagttatttattttattggcatacagttgtttatagtgttcctttataatccttttatttctgtaaagttgttagtaatatgccctctttcagattctggtaatttgagtttttctttctttttcgtgtttaatctagctaaagttttgtcaatttttttatcttcttaatgaatcatcttttggtttcgttgattttctcaaatatttttttctattctcaattttattaattttcattctagtctttattatttctttccttcttcttgctttagctttactttgttgttctttttccagtgtgttagggtggaagtttagcctattgctttgagctttttattctttcttaatagaggcatttgcagctataaatttttctctaaacactgctgtaactgcactacataagttttggtctcttgtgtgtttgttttcatttatctcaaaatattttgttatttgtcatttgatttcttctttgatgcactggttatttaggagtgtgttgcttagtttcacatagttgtgaattccccaaatttcttcctattattgagttctaattttattgcattgtggtcagaacatacacttttgattatttccaccctttaaaatttattgaagtttgttttatggcttatcctatggtctgtcctagagaatgtcccacgtgcacgtgagaagaatgtgtaatgtattgttgggtggtgtctgttgcgtctaggtggtttatagtgttttggaatcctttatttccatattaatcttctgcctagttgttttactctgtattcaaagtgagatattgaagtcctcaccagtcattgtttaattgtctatttcttttttcatctctgtcagtttttacttcatgaaatttgatgctctgtgtgtaggtgtgtatatgtgtataattgttatatcttcccgacagatttactcttttatcattataaaatatttctctttatcttcagtaactttttttgttttaaaatctatttgtctcatattattctaaccattccagctttcttgttaatagaacaagaagggttgctgtttccataatacacttttcattttgcttttagcctgtttgtatctttgaatctaaagtgtttctcttatagataacatgtacttggtgcattttataaaaatctagtctgaaaaatctctgcctcttggattatttaattaattcacatttattattaagtctgatgttagcatagcatatattcatatagcacatgtgtggtatagtatatagtatactaaagaaagatgtagtacgtcatatgtatatacatataatggcatatatgttttagttcataaggtatatatttatagcttcattatattaaccttatttaaaatgtatttctggatatttttatttattcctgtggatttcagttaccgtctggatttcttagccgcatatatctctgcactcaaccacttccttcatgccgtttttggcaaatatattacctctctatatgttatagacccaaccatacattgcataatattgccgtatacaattgttatttagtcaattaagaaaggtgaagacatgggcattcattttgtctttcatagttacatattcacctttttggtgatcttgatttttgtcttgtgactttgaattaccatcttgggttatttgctctaagcatgcagaacttcttttagcatttcctgtaagccaggtctgctagcactaaattctctcagtttttctttatctgttaatatctttattctatattcatttttaaaaaatagctatgctggatataggatttttggttgacagttttgttctttgacactttgaatatattatttcattgttttgatggcctttattgtttctactaagaagtcagcttttaatgttatgcagtttcacttgtaatattcttgtaatgagtcatttttttcttgtctgctttcaatattttttccttgtctttggccttcagcttttttttttctatgatgtgtctttttgcatatctgtttgcgtttatatgaattggagttcattgagcttcctggatgtgcaggttattatttttcaataattttagaaagtttatattcattcaatatccttcaatatctttttctgtttcttctctttgttctctccttcttatattcccatcacccatatgttggtgaatgtaatggtgtctcacatctgagctctgttcattttttctgttttttttaattgcataatctctattaatctatcttcaagtttgttaattcttcttcctccagttcaaatatgcttttgagtctctctaaagaattttttatttctgttattgtgtttttaagcccagaatttccatttggttctttttataatttctatctttttatttaattctctatttgatgtgatgtcgtaatatccatctttacctctttaattatggttttctttaattctttggacatatgtataatagctactttgaagtctttgtctattaaacaaagaacaatttctggtcactctcacaggcagtttctgttgcctgcttgtttttttctttgtgtatgtgtcatattttcctattttttgcatgtcttgtaatttttattagaaactggacattttagataatatattttagcaaccctgggtactggtttcagcctctggggttcgttattgttatttgattttagtgactggctggattatcttagtgaagtctatttcttcccttctctgcccctcttcccaatatgaagcccctgatgctgcttttgcttttcagagggtaatgccttgggtagagcacagtcaacaagagcttggtctttttccctggctacaccaacccttaagtacccataagtatttgtttttgttttcattgttgttttttcgagatggagtcttgctctgttgccctggctggagttcagtggcatgatctcagctcactgcaacctccacctcctgggttcaagtgattctcctgcatcagcctcccaagtagctggaattacaagtacccgtcaccacgcccagctgatttttgtatttttagtagagacagggtttcaccatgttggttaggctggtcttcaactgctgatctcaggtgatctgcccacctcagcctcccgaagtgctgggattacaggtgtgagccaccacgtggggccaggcacccccaattgttgactgactattctctctttttttaaaccatgccgtggggcatgaattgctccacagtctgctttgatcaaatccttgctcttctgaagggatatttcccaaggccagtatttgagatatgtcctcctcccagctgtctcttcctgtagagatctgtccagcaaacttaccagcctacagtttagattatatctccaatgaatctatcagtcccttcccaattgttttccactacaacctccactattttccagagtgtccttaggcttgaacttatctacactcaattgcaactgaagtcagttcatttgggaagaaatttcaaactatttgttttatggcctgctttctcccagcctcccctgggcacaatcgctgagccatagttttggagctgggggtggggactatggcatgattctctcttagtgacatgtatgtttagaagttgagtacttagctcggtggaaggggagtagtagcctcaagtcttctcagcttgcctctcccagtgtggagcgttcgcctttcaagtttgggcaagagcaatcagggtcccagtcttctcagaaagtcatgcccaaaataaagacttcgagtgcagatgttatggacgaagggagccctcatttctcagctgtactcgcccagaacttagcttcagcaacaggcagctggtagcaggatgagaaatgctgatgacctgcccctcctgggatgaatgccctccaactgtgaactttggggagagagaaccctgtgttcttggccatataagcctagagtgagtttgtgtcttgccaaacttggatgagagagggagggagcaggtctttgttcaaacaccatagtgccttgctgttcttactgagttttagtggggtttcttgaataaatgtttcttcatttgctatatgcccttaggaccaattccagatactttaaatttttgtgttttttcttctttttttaataactttcaccagtttcactatggaacagttctgtggagctcttcatgttgttgtgccagaaatgtttaagttctcaagaagcttcttaaacatgcacatgcccctccacgctgtgggaaatcagaaaatttaagatgtggataaggcttggaaaaacccaggagatgttggtgtgcagccagggttacggtcactactgcaacatgagtgaaagcagaggctttgtatatgagtcacagccctgatacttaacagtttgcaatattgggcacagaatcacttaacagataaaaaaaaaatgggcatgagaatagtttctaccccagaaggttgttgtgaggattaagtgagttaacaacacttaaaaagaaaatatcaaatatagcaatatgtaacagtatgtcatataatgctaataaaatgatgatgatgatgtagatgtagtctttatatattgggttattcttcaattctaaccacaacttggatgtcctggtttcctttagtatcacataaaagcccaatggaaatgcccctcttgtacctgtgtttatcctgacccatattttcctttatgattgaaacacgaaaccttgcttatttcttttgatttgtcccagaatgaaccttacttatttcttttttggaagggtcagtgtggctgggcaaacacacgtttttttatgccagatacgtgtgaacctttcctctaattattcctgtccaggaatttgtgagattatcaagcagctatcagcttgtgggctgacatttctgtccttgtgtaattgccccttaaacatgcaaattcagatggagcagcccgtagctcagagccctaataaagaaaaatgtgacttactaaaaggcttttcctccattgtagctcaaagtcatattaatggatattagtgtggggacttaagtggcacgatcccatgtggccatgctggtgggagggagtcttgcctgtgtcagggagagcaggcctagaatcaccaacctgattagaaaaggaaaaacacctttaaccccctactgaccttttgtggtttcatgataccaaggcagcaaaagttccagaaggaaagttcagtgagccagcacagtgatggaactcagtcctctgaaatgacagcacaggggtgccaccatgatggtataccatgatgtgtcacctgccaagctacctctagtgttttctcatttatagatgtccttctacactttttttttgtataaacgtgggctcatgtagtatgcatacccgtttcttaacagtaggcgttcatgttagcggtcttcaacttgtcattctctctgtgccctgccaaatagaggcaagggtgccagtcttgggttctgtacctgtcacccacagcctgtatgcctcggacaagtcattctgggtctctgagctatgggggccaggactaggagacactgtgctacagccattaagaatccagctttgaagcccccaaagacctggatttgacccctgagcatgctgacatcagcggggtggacctggaagattcattccacctgtctggccttcggtttccttacctgtgaagtgggaatgatgttcctcccagttgctgtgagcattcaggttgttctggagaggcttctccctggcagaggtttacaggtggactgctcggaggctggcccagtcacttgctgtagagtacaactggtctttgaatttggtaaattttgagcttaaaggaaaaaaaatggccgtattcttgtcattaattatctttctttataattcttattatttttgttgtttcttatccagtttgggatgttaagtgatataatttttttattgctttactttggatattttagatttcacaagcggccatcaggaattttaggagtgtgtatttgggcagatgtatttagggtagaggtgggcaggcagacagcttctgtggctgtaggaatgtgtgttggaaatggagggagctggctgccaggctgcctttgcagtccattgtagacccagtccttcagtattgggtgaggtcctggattctaagcagcttgcaggaaagagctgacagtgcccaggtcaaagtcgtgggggatgtgaacatcttaggcaagtggtccctcctccttcacttcttgggattccttagcacagttcagtttctttgttgcttccttcagtgacaccaatgagactatgggtcccatccatgctacctccagtgccctgttcttgcatgcactgtaccgtatgtggtcacagctgggactgttctgcctgcgctgctggtggagctctcctggcccggcacttggtgggtgctccatagttgctggttgaaagatgcaagatttgatgagccccgtggagctggaaaagctgacactatgtacctgtgattaagttgagagggaatgggaaaggactgtgtttttcccactccgaagggcagtgagcacatttgtgtatagagctaatcagaagcaaacctggggaaatgtttccttcatttcctcacaagaccagcccagacttggcatcacgtatcttcaaagtaagataggaaaattggactcaactaatgtaacattactatttttgaaggactcactatacaccaggcactgggctaagtgctttaaatatattatctccttcagttctcacagcagccctctgaagatcagctctgttccatccccctcattttataaatgaagaagggaactcagagacgttgtttaactggctgagggttacacagcccattcgtatgctcaaccatatgcaatattgcctgaatgtgaaatcttctgtaggaaatgaacatctgggagattgtgctttgttggctaagctgaaaaaagctgtgtcctcttgtggtctctccctgagtcatacacactggcaccactgagaccggcctagctgtttctcagggctcaggtgggctgaacaggccagagaatactttcctcccatgctatagttttgaggagatgaatcttcttttggtttaaagaacacagagttcaggacacccggaataagccctttaagagcctgcagaaacttgagctggcaactgccatggcttttaagatgtgatggtttgctctgtcttgtgtgctggtcgaggatggattattcgaagctgtgggaacagctgacatgctctagcaatttgtctgaatcttgtttctgcatttcctgcttacagaagaggatttttacatacctactgattgtagattatcacgtctgcacacctgttggggataaacttgggccgggacttacagtgcttcagaattacaggtagtcctggcccagctgcctcttggaggaagttgatagggaagtatgacggaaggatattcatagttccctttaagtggcaaattgaaaaaacccacttaatcaaaaaaatggctgtggttcatcatgtttcaatctcgttttgagctgcctctataccctcagaagattttttccccttgtgcaagcagaacttttgatttctgtcttcatttatcagcttgcagtgaataagcttgtctctgagcctggcaatgagagcctggctatggaaatgtcattctggtgagggcggcatctcttgctgtgtggcagagtccaggagaagcaaagttaattgtgtttctgtgatgtccgggttcggaatgtcggaagtcatcattccaagtcagagggattggctagttactgagaaacttgaattgcttgggtggaatcctgaccaagaggactttgaggcagaggagacaattttagaaatttgcagcattggcaaaaataaaaaacggatttttgtctattcatttgccatgttgtcactgcgctagtcaggtcagtcttcctgttctaaacataaaattccctctgcggatggtcagggtgcctggagcaagcagagcagttgcctttttcatttcacccttggcttggcagccggtgtcttgcctctccgcgagcccacactgcctctctcacctcattttccatcacttgccatcaagtctccacagtgagggtggctttctgcctgaccctgtggatgccctgcccattttctttttttgtttgtatcaatgtagggggtaaaagtgtggggaagagaaagagagatccaattgttactgtgtctttgtagaaaaaggaagacataagaaactccattttgatctgtagaaagaaaaattgttctgctttgagatgctgttaatctgtaactttagccccaatcctgtgctcacagaaacatgtgctgcattgaatcaaggtttgagatttagggctgtgcagcatgtgccttgttaacaatatgttaacaagtacagttttgctgcatggatacattgagtagtggtgaagtctgggcttgtgatgtaaccatcacctgaatagtgtacattatacccaataaggaatttctcatccctcaccccgctccaatgtttaccatatctattatttcattctctatgtccatgtgtacgcatcatttagctatcatttgtaaatgaggacatgcactatttcactttctgtttctgagttattccactgaagataatggcctctagttccatccatgttgctgcaaaagacatgatttcattctttttatgggtgagtaatattccatggtatacataccatacattttctttatccagtcatccattgatggacacttaggttgattccatatctttgttattgcgaatagtgctgcaataaacatttggatgcatggatctttttgatatactgacttcttttcctttgggtgtgtacccagcagtgggattgctggatcaaatgataactctattttcagttctttgagaaattttcatactgttttccatagaggttgtactactttacattcccactaagagtaggataagcccctttctctgcatcttcaccagcatctgttatttttttgactttttgataatggccattcttactagtgtaagacggtatcacattgtggctttaatttgcatttctctcatgattagtggccatgcccatttcctcctcagggtttcagcagacttgccctcctacctgcctgacatcccatctgtccttttcctgtctgtctaaaccctgtctgctttcaaagccacctagcctcattcctgaaagcttctcaaatcctgtcaaccttagagctcttacagaaattggtggtggaatgatgcagtccgtggtttactttcttgcattgttctgagtgtgctggttcctagctaggttgtaccatggtaccatgggctaacgtattttcttttctttcctttttttttttttttttttttgagacagagtctcattctgtcactcaggttgagtgcagtggcacgatccaggctcactgcaacctccatctcccaggttcaagcgattctcttgcttcagcctcccaagtagctgggattataggggcatgccaccatgcctggctaatttttgtatttttaatagcgatggggttttgccatgtttgccaggctagtctcgaactcctgacctcaggtgatctgcctgcctcagcttcccaaagtgctgggattacaggtgtgagccacagcacccagccatctgatgtgttttctgtcaagcatcatgctcactcaaaagaggcactgcataaatacaacaggatgtaccaggctcgaaatattggtgctctaaggtctttagggaagaagggtcatggtgtgtgcagtttgtcttctagtggtttgaaatggaaaatagtgtgtgtgtgtgtgtgtgtgtgtgtgtgtgtgttaatagggtgtgtaaatgttgaagcaagtgggataaagtgttcaaaataggacaatctaggagaaaaatatacaggtgttctttgtgctatttttattcttgaaaattttctgtgcatttgtgaatgtttccaaataaaaacatatttattaaccactgtggttatcctggagccctctcttgcacacacccacatcctgtcccaccagaagtctgtcagctccctctgcaggacagcttccattgccaccctccttgcacgctcttctggtgaccaccctggtccaggctgccgtcttctctcgcctggctggctgtgattgcctcttaagtgacagttcttgcttgcacctctgtttctggacagtcttttctcgacatctcaaaatagccagggtaatcttttttggtggcagaattatgggtagtttttaattcttcttttgttaaaatttttaaaattgacaaataataattgtgtgtagttcaaggtggtctttttaaaacatgcatcagattgcatcacatctccactcacaactgtaaccttctgatagaagagcttccctgccctcctgccttctcagagctcatttcctcccctgctcactcggagctgttcttcaccatgtgaagctcatcagcacatggtggtcttcccacgcgatgctccatctgcctggaagcctttcccgctgtaatggtatatggcctctctctcttcattcgttcactccatttgtttaaatgctacatcctcagaaatgctgtctctgaccaacttcttaaaaaaaaaaaagaaaaaagattctggctgggcatggtggctcatgcctataatcccaacactttgggaggccaaggctagaggattgcttgagcccaggagttaaagagcagcctggccaacatgacaaaacgttgtctctacaaaaaaaaaatagaaaaattagccaggcatggtggtacatgcctgtagtcccatctacttaagaggctgtggtgggagaattgcttgagctagggaggttgaggctgcagtgagctgagattgcaccactgcactgcagcctgggtgacagagctagcctctgtatcaaaaaataaacaatataagtaaaataaatgattcctatcttctccgtcattcccaattcttctctgactttattttttcatggtaaaaatgacccatttgccactactgaaattgttttatgcttcatcattccagtagaatgcaagctccatgggggaagggctttggttcattctctgctgtatttttatagcctggaacagtggctcacatatcgtggtcccaaaacaacagcatcaatatcatctgggaacttgttagaaatgaaaaattctgggtcctcccccagatctactgaatcaaatactctggagagagtgcccagcaatcttgtttttttacaagtcctccagttgattctgatgcattttaaaatttaggactcactgctttaaaatagtgcctcaaataaagtaagttctaagaaatatttaaatgaataagcaaatattcagtgtccttttgtgtcacactgcctattttttgttgttttcttgattcataaacttaccattttattctataaaagcataagtttttcattataacaatgttcatgtgtcagttttggactttgtgaggattcaaggttaaaatatgacttctatttttattctctctgtgcctgccatctcctttgttttatgtggatgttaagctattatatccttcattgatttacatttccaataatggctgtaattgagaaaacagaatattgagaactctaaattattaataattatagaggtatcactttatgctgttgaatatttattaagagaatatatgatagcaggctgtgtcctgagctggcaaactggcccaagctggagttcacatcaggacatattgtccaactaaaagtagaagctgcaagatggacaggtcacctgtcgggaggctgaattatgtctgatgtgactagagcctgtgctggtcaatttgtcagtgtcagctctgaactcattcttgtctggaaaacagatgaagtggccaccaggtagaatgacccaaaataaaagaggctaaaaggttatctgttggaaaattagaagtttcaacttacagaggatctcttggagatttcactgctaagagctatttagacgtgactgttagtggttgtgttttatgtattccatctaaaaatgtgggctttctacttgaatcaccctaaagcagcaaaaagttattaaaaacatccagtgttcagccttgacctctaatcctatgatatagagctagtgaaaaactgccaggctgatagtggcatgccgcatacacgaaacaggtcattatatgtagggggtgataaaatagactggcatttatcagtatagaggtggtcgtcctgggtcattggattataggttgcccttttccttctctcttcctgcactttttggattttatgctgtgaacatttttgtgcatgtgtttggaatatttatggttaggttggaacactttccatttgtttatgaattgagatatgcagagagggagcaggacaatctcaaggacgatggggacccaccccacaagggattatccatgctcctatgatgggaactcctccagaaaccagccaggccaacagcccagtaatgggcaaatgtgttctccacagggtgaccgcatgtccccatgtcactcttacttccatggctcactttgctgctgctctgtgagccagctctgggtaggtggccagtgaacagactggccctgggccacagccagcaggccccaaaagcagagaatgccatgtgctgggggagtgatcctagccaagaatggggtgagatgaggaccctgggcatttctgcagagcatctttcctctgtctctttctctcactctgatagaatagctgaagcctattctcttgctattattagagcagctgccatgcatcaagtgttcttgggtgcccagcgctgtgtcacctttggagaagtcccttcccctttcccacttgtgaaaggtggctgtctccacctcacctcggtggcggagatgcagtgccaggcgccaggcagactgttgcgcatgaataaatgctcgataaatggctatcactcctgtcaataacaatgactctctcttagtcctatcagctaagtattgttatcctctttttacagataaggaaaccaaggcagagagagagagagagagagagagagagatggaagaagggagggacaggcaggcacagagacacacagagcagaggattgcaggcatgttgatcatctcatgaagagctcctctttggccatgtgcgcgattagggttaacttttcctggaacttgcacactgactctgagggcagaggcacattatgtggtggtgaagcaagtgggctctggactagagggcatggttaaattcttgccctcacctctccatgcttaggaacttggaggaaatgcttcaaacacacgtaccccgtcccttgcttgcctctctgtgaaatgggggtgtaatagcactccctcattggagtcacttattttacaaacattcagtgaacacttactatgggtcatgcacttgcagggaaacagctccaccatggttgtatccaaacagaataatggcagcaattatgttttgagtgcctactggagcgaggccctacgctgagcaccatttctactgagttatccctgatactcaggtcacagtgggaagaagacatgggatgccacattttacagggaatcagagggttcctacctgttcatggacactcgggcatagtcaagtagggatttgaacctggctgtttgtttgccttgaggtcctcactccctgtggttaggcagcacctacagaaactgtgagacaatgcttgggaagcataccagcggctcactccggacctgagctgggcaccatgtctgtgggagagctacaccttggcctttgtttctggccccgacttgtacctggctgagacatctctgttcgttgctctcatcctccatgcagaaatctgagagggctcgtggttcctctctgtgacccacactgggaccctggctgtgtgctcttcattcactaacatttttcacccaggagtgctccaccctgcacagtcacgtgagtgtccacctggggagtagaactcaggaggtgatctgggctctggtatcaaacctgctgagaaccagcttcagacaagtcacatcacctccttgggccttttagattacttaaggatctgccaaccctgccactctccaccccatgggctgctccctagcaccccaaggttgcttgactgagagcaatatttggcaagttaaattgatgtggacattaatcaaataccaccatactatcagccaatgaatcccataccagcctgctatgaatgccttcccaggaaactgaacagctctgttgtgttctgtgctgttctgttctttttctcagtctctctttcctccccctcctccagcgtcccttgggggagtcctcatccgttcatgaaggaagctgtgttaggcatgccctcatggctaagagaagacagagagcacccttgccccttcacagcttctttccctggccttgtgggctgtaatgctcctctgacaacacaagggggatttgaggatccaggcaagcagagagagagaggatgccaagcttctgggcattcacaggggctacctcaagggaaggccggctttctcctaacagacttagcccgtgttctgagggattcactgtcctcccatgctgccttgtcttcattgcctttggccctggtgcaaagatgcggagaattatgggggtgctccataatttctgtacaaggtgcatccatgtgcatgagtgacccctggcccatttctcttaagggggcgggaccagaagagtccatactatatgtatgaatttgtcttagttttgaactttggaaatgtggccccagtaatttacttattctctctttacgttggtttctgtcaataaaatgtggtcaagaggacttttctcgtggctctgctgctaactgtgtgaccttggacatgttacttggtggcttacgttcacttttgccgtctgtaaaatgagaattacattagtactcaccctagagttgttttgattcaatgtgttgtcatccatagctgtcttaggatagctccttgacacatcctgaatgctcagttgtgtcggccgtgttcatgttccactagctcctagtagggtcacctagggcaaattacttaagccttctatggcttcagtttcctcatttgtaagtgtgcataataggacctttatcatagaggcttaagtgagccacagcatgaaagtgtttagctgagcaaatggagagtgctgtatacatgaccagtgttatttttttagggagatgtgttattgaaagtgcccctatttctccttctcctgtgttacttcttattcaaatgcagcctagtgaacagttaatggtgccttgcccaggaccatcagtatcctgttgcattttgaaggggtgtgtgtgtgttgtatgtgctaaatgttttcttttgctttgtgacatttgtgtggtgtgtaccctatttccatgtgaaggtgtgcgtctctttgccttccgctacttttgctttcctgaccaaagtcatctcaatctcagttgaccaggtccttgtggacacacacatgacagtgctcacagaagtgaagggtgagaatatgttctgaatagtcatctctgttttcaaagctttattttttcaaaattggtaaagctcaaaggctggggcaggcagctcacaaattgtgagtgtgaggggctcctctgcttgattaaagaaatttctgaagaaagaaatgtgtttaactgggagactggtgagatgtgtcagaaagtattctctgcgccagccagtttgtggccgggtattttaggaccagttttgcaaagctgctgacgagcaggccctgcttctgggttggaagagaggaaccgccatccattttccctaaaagaagaaaaataggtgagcctggaaagtctgtgggtaggagtgaaataatcaccaactcaatttgcagccgtcttggaagagataagctgttgtttcttcccaagtgaatttctgcaaagaacagatcctaccaagtgagcctcatctcctctaatcaagtggtggccgggctattgaacatgatgattgtcctcagcatccctttcacttggcctgtgaggcagagctggagtcttggcagtttatggaaataatgatttcctgcaagaacttccaattcagcggcatcctcaaacccagatgcctccctggataacagcgtttctcccctggctaacagactgatgactggtaaatgttgacctcaagtaagaaacaatagtgaactgcgaagctgctgctaagctttttaaaaataattgaagtaccaaatataaagctaaatataatttgccgttatcttccccaagataccatgggcattttgaatttgatattatttttcagaaataaaataatcattttcatctgctaatgttgtctcatgttaaggtaacgtgggaaatcgtcagacaggactcacaacccagtcattgttccatagtatgcattggtcgggtatatataaaatggtcgggtaaataggtagtggttggattctggtgaggactcttttcctagtttgcagttggctgttttcttcctgtgtcctcagatggcagtaaacaagcaagagaggaagcgagctctcttatgtctcttttttttaaaggcactaatttcatcatgagtgttccctctcatgatttaattaccacccaaagaccccatctcctagtaccatcacactggggattggggattattgtaggtatccccacaatctatgaattctgtggggacataaacattcattccatagcagtaaccttatatgaaaaatagggcctttgcagatgtaactagttaaggatcttgagatgaagtcatactggatttagagtgggtcctcaatctaataataggtgtccttttaagaaaagggaggccgagcgtggtggctcacgcctgtaatcccagcactttgggaggccaaggtgggcagatcacgaggtcaggatattgagaccatcctggctaacatggtgaaaccccatctctactaaaaatacaaaaaattagccgggcgtggtggcgggcgcctgtagtcccagctactcgggaggctgaggcaggagaatggcgtgaacctgggaggcagagcttgcagtgagctgagattacaccattgcactccagcctgggcaacagagcaagactccgtctcagaaaaaaaaaaaaaaaaaaaaaaagaaaagaaaagaaaaggagaaaagggaaagacacacagaggcacatagagaagatggtcatataaagatggaggcagaaatgggagtcatgcatttacaaaccaagcaaaaaggactgccaacaaccacgagaagctaggagaggggattaggacagtttctgcttgacagcctccaaaaggaaccagctctgcaaatgactttactccaggcttctggcctccagaactaaggagtaagtttctgttgttctaagccaccctggtggtggtagctttgttatggcagcccttggacacttatttagacatgctacaaaataactagccagggctcttctgagtcttgttgggcagtttctcaagttaccgtcacgtggtgctgccggaggaagtggaaagcatcaagaaagatcatgaaggatgaagaaagactgaggatctgtcctgaattagagactagagaggcaggcaatgtgtagtcctggattgaagctaggcccagacaaggacattgatgaaatttaaataagatctgtagatttaggtgatggtttcatagcagtggcaatgttgtggttttgattcttggctgtggttaagtaagaggttaacatttaggaaagggtgtgtgtgggtttttttttttttcgtacaatttttgcaagttttttgatgtttgaaatgtgtattagtcagggttctctagagcgacagaactaatatgatatatgtatatgtgaatgagagttttttttgttgttgttgtttttgttttttgagacagagtctcactctgtctccaggctggagtgcagtggcgtgatctcggctcgctgcaacctccgactccctggttcaagcaattctcctgcctcagcctcccgagtagctgggattacaggcacgtaccaccacgcccagctcatttttatatttttaggagagatggggttttaccatgttggccaggatggtctcaatcttctgaccttgtgatctgcccacgttgtcctcccaaagtgctgagattacaggtgtgagccaccacacccagcctgaaagggagtttattaaggagaattaactcacataggcacaaagtaaagtcccacaatggaccatctgcaagtggaggagcaaggaagccagtggtggatcagtctgagtctcaaaacctcacaagtagggaagccaacagtgcagtcttcagtctgtagccaaaggcccgagagtccctgcaaaaccactggtgtaagcccaagaatccaaaagctggagaacatggagtctgatgttggagggcaggaagcatgcagcacaggagaaacatgaaggccggcagactcagcaagtctacttttccaccttctcctgcttggtttattttagtcacactggcggctgattagatggtgccacccagatggagggtggtgggtctgcctctcccagcccactgactcaaaatgttcatctcctttgccaacaccttcacagtcacaccgaggaacaatactttgcatccttcagtccaatcaagttgacactcaatattaaggaacacaaaattatttcataatgaaaattaaaaacagtatttctatttgtttataggaaaaagacaagagagaatgaggtttgggggaattatcttggtcatattcgttggaattaccttgacaagcgaacacctcatgtgtccacttttatagtgaagacacaggcttcacctctcagttccagcctttttctctttacatttgtgaggaagttacatttattccgattaatacatatcccttcaaatactctaggtactaaaaatctcactcatgaaaacagacccttttacttctccctacttgaaatggaatgctatactgctgttacagatcagagcgatatgcacatggcttgggaaattgataaatggaacaaaaaggtcggagggtggcgttaggttgtaataatcccatcttagtacaaacaaaatgtctttccatagttagaggaggaagtaaactgtttcacatcaggattttaacagtggttctcaattgcatagggtgactttaatttcctttctgatcatttgatttttttaacagcggatatttttgttaaccaattaagaatttatcttttaagggaaagaatgaaactatttttaaagggtgatttctacttcctggccctccaaaaagagctgtatgtctggtttaagatgaaatgcgctcagtgaagacttactgcagaattcatttattattccactctcctgccatgtcgcggctgaggcttggcctctctccctgttcttggaggtggccagtgtgacagcacagcttgtgttttggtggtcctgtcaggctagaggaccccactgaggaatagtccttggctcaggacctcaagattttttaaaaatactcttgcattttctttatcaaaaggtctttcttgtctttctctttggcacaattaaatagattttagaatttgcagttgagggtcctcaatatattcaccccaagatgcctctgtgcatctgttatatatttccatgttgtttttgctaatagttttggagagatttaaaacatttgaacctttttttcttgctttaaagacaatgtctggagaaagttaaggacctagaaagttattaatttttttgttccccttgttgtactgtgtagttagctgctttcaaaacaaaaaagccttgtttttctttgtccttcttttctttataaataggctttgagttattcaagaggattgaattgaccctctggtatgaatttttactgatcccatatgctaattaactatgttttatctataattcaattgtaagagataatatctccatatatagatgataagtacataatacatttagagagtgaatattgaataacttaatattgaattaaatatctgtttcaagtgacatgtttgctcttaaataattctaccttttaatggtgggttactgttttgaaacaggctttattattctatctttatatcttttgttattgttgttcattcctccaatcttctgatcttacagtgaccaaactagcctttttttttttttaatgtttttaaagatacagggtcatattctgttatcaagactggagtgcagtggcatgatcatagctcactgcaacctccaactcttgggctcaagggatcctcccgctttaacctcccaagtagctagaagtataggtgtgcaccactgtgcctagtctagatttttgtagggatgggggtctcactatattgcccaggctggtctcaaactcctggcctcaagcgatcctctcatctcagcctcccaaagcatttggattacaggcatgagccaccatgcctgacctcaagccagcttttaaaatttttactttgtaacccttgacctggcatcatggacggtccttgctttgagacattctatgagtaacagagttttcagttcttaaaaaaaatttattatattttaattatgtaaatgctattgaaatagcaactttaaattgacatgtccattaattcatatacaaagtaaaaccaagctgtttaaaaataatcatcaaatagatcaaatggtaaaatcgtggaggattaaattaaaaaggtgaattggatactagctgcatagatagcatgtcttgtttctagttacctgctgtaataaaattagtcatcaaatgcgttaggactcttaaatgttaccaaggtgtgatgtgctgtgtacttctggccatttaaaatatgttccaaactaacaaactgataaaatagaacaacaccatgatacacaagttttagcacctatattgctagaagatctttctgaattagtttattttttcaaatttgaaaataataaagtttgaactactcaaaatttttaaaaatatttccaacccttgactttaaagcatgttctttttaaaacaatttcagctaaaatttctaagtagttctgtccttgaagatacttggagcttaacttccatttctgaaggcctgtccttgtcatatatcatttttgtagcagctggcttgttccactcttggtgtacttcctgttaaatatgtatggcttgcttggttttattttagtagcagtaacattttcccctttttcattgttatttgcagcatgtaatctgctggacttgcaacattatttcccacgaagcacttctttcttttttttctttacatcccaagagatctgtgtcttgcattaaactttccttgctggtgactgatacagttccttttatctgccatgcagttttagaatgccaacaaatttcttgtacaacaatatggtatggaagtgcttcacttggggaatgatcctgaccaatttaaatcccttaactgaattagtgacttggttaaatcctaggttccttgggttgtatgacctctgagatgactctgtgggtgtttgtgacaatactggaaacttggaagagatgtttatgtttggtgaccttatcttcttcttccctgtggtctttattctggcaccttgaatttcgttcaggaacccatctttcaggactgctgggcttgcattcagatccaaggcttaataggtttaagcaggttggcatgctccatcaccctcctgtgctgactagttgagggatgggcatacaatggtcaccgtccatgcagtcagaagacatctgaagatcccctattctgcctcggtagggttaggaaaagatgtgatgactgtaagtgctatggcaattttgtggccctataaggggaaaggctggaactaccggacaacaggggtcgggggaagggcctggatgtgtgaaaggaagaacctgagcatggaggcagccctgcaggatgcagaaaagaaataaagacagaaaccaggtcactggtgaagccacgggcaatgtctggatcattttctccacaaaaccatttttacccctcatttttgtagttccttgggctaatattttgaaaggtattttgagtaggtgtgtttggttccttatattgggaagacacctaacttgaagaagtagagagcactgacataattacagtagaaatgcttaagtagcctctacctaagcaacttagtagattaattaatgttcttcctttcttcttccattgataaaacactttggagggctggtgtctagagcatgcagaatgcccgcagctggtaaacctcccccaagactcaaaaggtcatgatcctgcatgtgaaggctggctaattattaaaagaaggtgtttaatgttttttgaaaatgactccttgctataatcttttttggttaaccaaccaactgcgtatcatgattacaccagagatcaacacatgcacacacacacgcgcgcacacacacacacacacagacggtcaaccagttccattctttatggagtggagtgaattataaatggaaggcccattcatcttggtttgctcagaataagcctaatttgtactctttgtttctgtgttaattaaaagactcccatttcttctcaaaagtggtccagtttggatgatcaaacatttagtcatcctggttataagtagtttaatagagttaaatttgtactcttttattatttttaatgaaccatttatatgacaagaggaggggatcttcaggcacttgtccgtgccactcaggagttagcagttagtatataggagctacagaggtccataagctgagtcatttggtctcatttaatttggcttcactgctgttgttcaacaagccaaagaaatagttgataaaggaatttatagggtgaatgaggtccagcgcaaagatggctggagtccttgttaatagttcttggctaacattactggaagttggcataattcctagcgtgtatcataccctttggaagcagtttaaacttccagtggtatagttcagggaggtttacaacctgtagatctttgcatgaaattgggcatgtacttacaatgttctagccatgagaacccaggcccctggcaccatgtccatcaaaaccacctcagcacaaaattggctccctccctggaactctgggaggggccagatctcttgtgagatttgctcacagatgatattgcccacttcttggaacatctttctgaactttctcaggccaatttctgactcctgcttacactctcccgtgggtagagagctagaaatgccctttgttacgtggccacatctacagttttatgttttgggggctgaatggattcagcagtttgtcagttgcagagcaggaagacatagaggatttatttatattttaaagaagaacctcccccaacccttttttttttttttttttttttttttaagagagacagggtcttgcctttctgcccagactgaagtgtagtggcacaagcatggctcactgcaacctcaaactcctgggctcaagcagtcctcccacctcagcctccctagtagctaggactacagggatccaccactgcagccagctagttttctaaacaataataataaatgcagacatggagtcttgctatattacgcaggctggtctcaaactcctggcctcaaatgatcctcctgccttgaccttccaaagcactcggattacaggcatgagccactgcacccagcctaaaacctcattttctttatacaagtgatgtgttcacatgacacctgccactccacacattgttctggacagtgttaaggctttggtgtggagtgactgaggaggggaactgggaggagctgagaagctttgctgctctgagctatgggaactgtatttccccagtcccagcaggtcatgggccacactcaggacatctccagtcctgcccaacacctgtgtgattactttaagcttttctctaaatgacttactctttattttcatctaaataaatgtagccacattaggagcaagggattttgagaattaagagttagatgtgttggttaaaatttctccaacatcatgaaatacataactgctaaaatctttaaaaggttgtgttctacctgaaatcactgacataggagggaggagcctttttccacccatggttcaagcaagagatcaagatttctttattctactaccccattggctatttgaagctcagacctctagcagcagttcctttcctaggcatttaaaaacaaattaaggggcagatgctcccattaccagacctggccattctgatccccaaacccagtacgttcagtagacaccaccttcttcctcaccccacctcttccagttacaaaaaccaaggctccccagcgtttcaaaggatgacaggggatcctgatccagggaccgtctccattactactaccactaccaccatggtgcctgttaaaccaatgacagcagacctgtgggcaggacttgcaagtgcatcatggcacaaaggcattcctttaccctcctcaaggccgacttcaaattcccactgtgttggacgtggccctgcagtggtccatcttctcttcttcctcactcagagctgacctctcctcctaattcatctggtgttcctcatcccaatacaggttttcaggctggtgacgctgtgacagatgttaaaagcagcacgtaatgcaaattccagctatacctcagtaaagctgtttaagaaacaaagcaaattccttttccctgtccccttggctccccatccagacctctcttagaagcaggctcatggttgcatattgtctctccaatataaatctcatattagaggcaggagagtcagcacttggccttttgctgttaaaaacaaacaacaggccaggcatggtggctcccgcctgtaatcccagcactttgggagaccgaggcgggcggatcacgaggtcgggagatcgagaccatcctggctaacacggtgaaaccccgtctctactaaaaatacaaaaaattagccgaatgtggtggcagacgcctgtagtcccagctactctggaggctgaggcaggagaatggcgtgaacccaggaggcggaacttgcagtgagccgagatcgtgccactgcagtctggcctgggcgaaagagcgagactccgtctcaaaaacaaaaaaaacaacaaacaaacaaaaaaacaaacaacaaacctgaacttgcccccgttccctttttcaaatgtccataatcccctgatctccctgcgtgccgtgtctgggcccacggaagccgtgactgtgtagtgacgtgtgatgctgctccccattcctttcccacagccctctgctgcccacatgcccccagctgcagcccccgcctttctttgtccagtctgcggcttctatgtctttgctccagcagtatccgtgacagctccttaattgctacacgcatttgtacagttccttggcaattatatttcagaccctgtcagggtacctgctagcctcggggctgtgtttatattaaatatcaataaaaagctgatagcatcagcccagatggcaggctcacaaaatcatattttactgggagccaggcctgtctggaagatggaaggaaggaatgtttaaatttctttctctcttccgaaaggttaaaatgagaagagacttccctgagtgaatatcaggaatcggttcttgctaaatgatgacagctgtgtactctctaactgggtgttgtcctttattgtaaatgacttgtcatctatcagttctttccagaattgtttcttttgtccccccgcccccacagagcataggacaaggcttcaaatcccataggtattttttaaattctggttgacggaatggctaagagtttatttggctttactttatgaggagggcttaggacaaacgccaagggttaagtggccctgagcccaccccatcctgcatcgcccgtcccctgcatcccctctgctgagggggccatgagagaggaacccacgttactcactggctgtgtggtgtttccttgctgggcctcggttccctcatcctccagaaatagcctgggccttccccggagctgtgagcgtgatggagtgcgagggggccgagcagctggcaccgcgtggcgcagtggctcccgccaagaaagcaccccctggaggtttcacacccccaaatgtgggcggtcaaggataccacttccctatggtttccactctttcatgctgctgatgatacagttctgtctattggagacagacgggaagaatggcttgaagggattgcattttgaggacagtttcaacagggaaatcagttttagtctgcaaatctatgacaagacagctttttggggacacgtttccctgttgcagtcaacagaatttcccatttacgtgtgatctaaggggcatgcccctccccttggctcatttccccgtggtatagtgattctgcagcatggttgtcctggcttcctgctgtgggggattccccacatggatgctgggacagtgcagaagagagcttcaacagctggcacagcacctgccttcagtgcaaaacctcgaccaacacgtgtttgcaagcacatcctctctgtgtcccactggcttctctccctctgccacccttgtacaggtgccctcatgtatcccatggatgactgcaggagcctctaaacactcccctccacccttccagcgccactcacctgccaccacttggttgctctctcaatggcaaaggaggaatccactcctcttgagattgaggacagactgcagacccaggtctgcaaagccctacttggttccccctgtccccatttctcaccccagcctcctttttatttcctgcattccaggcacttagacttcttttggctctgccaggaccactctacaacctgcccaccccatgcctctgcgttctgcagattccattttaccccaatgagctgtgcactccactaggtcaaaggccgtgtctggttttgcccactgttttgtctccaaatcctagcaggtgcctggcacacagtgggcattcagtaaatattttctgaatgaatgaataaataaatgcatactatatccagtataggtgctaaatgctttggggatattagaaaatatgacatgatttaataccctttgggtgggttgttcaatagttgtaagagttaacgtaaagggaacaatcagacgatgtaaaagagaaagcctcagtgagcttgaccagtgcagatttgggtgtatgttgggagctggagggaaagtggatttgtttccaaaaggggtcctgggccagatcagaatggtgtgaagcctcaggcagtgggattaatctctctgtgatgagttttcaaaaactactgatgcttctggaacagcgtgggtgctctggccgtcgtgttcagcacagattttcaagcaaaatgcttgagttccaaagagctgctgtgacagttttgcaacactggcattgttctagtatttgctggtgggaaaagagggattctgtgctcaccccatttctgaacctttccaaaatgagccttatgtcctttccagccagagccaaaaggaaggagtgggttcctcagcattttgttagaatggaaaggtgacttagtgatggcgaagtatcatgtatcaaaagaggtgttttaaattagtgaatattagcttaactacagccaatcaaatgccattttagaatcagaagcctcttggaatgtgcctaagttcactctacagtattttagccatgattttatgccttgtaaatgtcccctctaccagcatacctcaagtccaaatgctgatagtgatgcagtagcctcactggcctgctttgcagcagagaacctgggctggatgcatctaggaactctcggagggggactccaaattggtacccagtactactctatcttcatccatcctgccctctttaatgtacgcgtatatcctgagtattaagtactaagatgtcctgtcagggccccaggaaagcctgagggagccccctcttctaggtgtcacctaattatttgatgatggctaggagctggcagcctcctctgagccacgtgttaccctggtccgtggactgcgccttccctgccattgctttctcccaccccctgtgtactgtctggtagccagtaaatagagttcaagtcctctgttatctaggagtttttacaggaacttagcaaacttccgctttgagcaaggtaatgtactatagcaatggacttcaaagctttggggatagatttcctcatctgtaaaatgtggctaggaaaagtagttcatgactacctggaaagggccacacatagtgtgtggcacattgtaagtgccccctaagtggccatctctgccgctatcatcatcagcatcatcatgatttctgtgatacaattttcttcttaatgtctctaaaggagacttgtgaatggtttattccaggagaatgaggaagaggaaatgcaagtctctccacaaaatttaaaatatatgaagggagaaagactatttaaaattgatatatttatggcaaaagaaaattctaatcattcacctgaattctaattagaattctaattcacatgaattctaatcattcaccagggaatgaagcctgaagtgtagcataccaaggcaacaggctgagggagactagagcattctctggaatttgccaagccatttgcttcccagctccatccggagtggttcaacattgggccatgaatcctccttgtccctctggtcccagggctgccagaaaatggctccagctttgtgaaaagcaacctgcatttcatgtctagcatatcactaagtttagaggaagggtaaatgtttggcaaataaacctattgtataattcagcacacattaaggactattttccaatagatataagtgcttgataattagcatcaaaactgttcattatttaatctatgatctacttagaatgaatgggagagatgtcatttacttgctgaaatgggagacatgaaaactatccaaccattctcgtcttgaatttggtccaacacacggcacagaagaaaactcctgcgtgggctcaatccccaggctcccctgcctgctataatttcatagccgagaggtgcacagctttgaagacatttaggaaagacagagatcctttctccagccttgtttaaggcaggcatctgcacaggggccacactttaaaaatcctgttgattctgagctgagtcccttcccttccatcagtggtttttgggtaaatgtagtttgtctctaattctgtgttagcttataattgttcttcttcattcagattccctagaagctgacccattttttgtggtagaaaatggcaagtttaaattaatacagttctgctaattcggtggagaataaatggtattggggaaaaaaatcaagtgtgtatcagatgactgaggtctggagtggaaactcaagcactaaggcatccatgaagtttctgattgcctgtcctgggaagaggaagtaggccatgctcgctacagattttggaaaataaatttgattttggagccatgcagaaaggcatgatggaccttggcatgggtggaatacagattatgtctgctacaaaatgcattgttggcaggaaacttgcctatctgctaaaatccttgccacgacctccccacctctccagcctcatctagtacctctcgccaagacaccagattcttcccaagtcagggtttttgatcttgcttattcactctgtgtacaaagctcttgctagcgtaggcatttgggagctggtgccatctcagcattcaggtcatctatatgacctctgggagggtcatctttgaccacccaatttgggtaaaccccctccccactttccacagacagtaactctctggcttatcccagtttattttcattacacctatttctacttgaaattctcatttatttgccattgtttctctcctcatactgaaatgtcaacttcattgtctggcataatgttgaatgcctgatacagtaggtactcaatcaatatttgtcgagtaaacaaatgaatgaaagcgtcatcacagtaccttgccctgataatttaaggaagagagaaagagacttgcataaagtctaccctggatagtctcaggacagctgaactgctgcgggtggggagttggaggcttccactgttctgggactagtgaatgggccctggtggtgtatgcagtcctcccaccacacagcaagttctttgccttgtctcagctacctttgaggaagagccgctctcatctggcttctacagatgaaggcactggggctgaggaacattaagtccaggtccaaggccatcagctaaccagtggtaagtgagatctcatacctaggactcaagcttcaaggccagagtcctgactgccgtgctgctgttcaggtgctacccagcaaccctgatgtggagaacatggtgaaagttggaagcccctcttgagactttatttatttcttttcttttctctctcactctctttttttttttttttttttttggagacaaggtctcactctgtcacccagtctggagtccagtagtgcaatcttggctcatcgcagccttgacctcccagtttcaagcaatcctttcacctcggcttcttgagtagctgggattacaggagcacaccaccccgcctatctactgttttgtattttctgtagagatggagtttcgccatgttggccagactggtctcaaactcctgagctcaagtaatccacccaccttgacctcccaaagtgttgagattacaggtgtgagccagtgtgcccagccaagaccttatttatttattttctaatgaatggagtaagtaacagccagtatttatgaagccttttgtatgtgccagttgctgtgctaagtgctttacatccattaatttgcttggatctatgtgggctgaccatctcaggcactgctcaggatggaacatgtaactaaaatacagtcataagagggagtaccttattcaaagatgcaaaactaatctggaaaggtatgcaagggtgtataggagtgtgcagagagagaagaccctatgtagcatgtgcacaccacaagccagagcagttatctgggtgaaaatgaaaaaagaaaactacaaaaggaatttgctgctaggttataggatgcattacaaagacagatcagggttgtgggaggcgctcttcacatacaaattgtaaatttatcacaaaggttgtgtgggactcttactccccaaacatctgctactagtctgttttactaaaagctgaacatctgatagattcttgactggcactgggggtaatttcatgtctcggaaggtagaggaaacagaactgctattcctggattacacattgaccaatatgaataataagttaatgtggattggataggaatattggagaaaatgaccatgctatcctggaattcactttattgagcagagttctgggcattgatacatacacttgacattcagcaaagtgattttaatccaacttagtgcattacaggtaggacccattgacagaggtcaggaagaatggttagcttaggaaaatataacatgaacatgaaaatctgaattgttcccataaagaagaaaagagtgaaggccttgaaacatccttcactaggtagaagccctgctcttattaaactcagatttttaaaagaatacatacaaaccatgagatatgggtatgttgtgtaggataattcagagaacattgaacattggtcccaaaaaagtatgttcacgttctgatctccagtacctgcaaatgtggttttatttgaatatagggtctttgcaggcataattaatttaaggatcttgagatgagatcgtcccaaatttagggtggtgcctaaacccaatgaccagtccttctgagacaaaggagagagagagatttgacacagagacacacagaagggaaggccatttgaagatggaggtggagatggaaataatgaggctacaagccaagaagtatcaaggacggcaggcgagcaccagagattaagagacgggcatggaacacactctcttagaacctccagaaggaagcaaccctgctggcagcttgatttttaactgtttatatcctgaattgtgagggaataaatctctgttgtctttaagccatccagtttgcagtattttgccacagctgctacagaaagctaattcagtaccttaaacctctaaaaagatgagaggtggaggtacaagtcaaggctcagataaatctgaggcctaaagaaccgcaagtaaagcaaaggggtcttttaaacagaatttgaaacagaacacaaacaaggaaaatggtttgcctgctactcagcaggttgctgtcattttcacaagtgaccataagaaaacaaatcagctcagccaccatggagggaacatgaggctgagctctgatccacaccccagcatgacgtttgcctgctccccatgggacagtggaagggccaggggacctgggtatatgtggggcatggacagcatttactgtcccgtgggttacttcatttccactttctgtcagtgatgttgggaaaatcatatttaactgtttttttttaacgtaaatacttagatgaaagctccatctattttttctgttttttcttttcctatcttttaaatgactgtaacaatagacagctatttaagatttccccttctattaaaactgcttgctaagcaagcttgtgaaatcaatacactgtgattatgttacaagccaagataagtgttatttcaaatatttgatcaaatgggtgtgtacaacacagcccccattttaggtagattatatttttttagtgattctgtttccccttgttcaccatgcccttggaaaaatcgaagccccctcttcttgcagaagcataattttagagcaagatatggtgtccaaatgaagtaaatgaaacatcctcagtttgctttgtatttctgaagatgttcacagttcctcagggggcaatcttagatttctaggaccacctggaggtctggacaccaaagaaaccacacttaagaaaaaagaattgtcaaaactgggcaaatcccagttgtcacacttaagaaaaaataattgtctaactgtaaactgtttgactccttaacatgttgagacagtgagctaaggaaatggaatttcgcttctttttgtggaaggtttttatgacgccgacataattgagcccattgttggaggcaagcaccatggatttttcagtgtcattattgtatttgcatctttgtggattaatttaagcgggttttgccgctaggggtgagtcacaataatcgttatcaagcttggacaggaaaaagaaagagatccattttccaggatcgtgaggataaagtcctcctaaaattactttgtggtgaaaggctgattgggtcattttcacacccccaggctatgatagggtttattacagtttacaagagttagagcatttacccttgagatgggattcagaatcccagttacctcagtgatctgaaggaataaggcagggcagaggtgacacaacaagccagtacactgtgtctgcccactggccctggagccattctgtggactctagagctgtgtaggtggatgtcctggggctgccgctggaaaggtgtagacagctgtggaggagaggaggtgcactggggccaatcctgagtgccctcgtaagtggacctgacttatgtgaccatttctagcattatgttgctcattgtttcctctgcaacttgacgactggagtaacctcatccgtcctcacccctcctgtctgtatggtattgatgaatctctggaatgaggatgtcacagtagggttgcgtgacttggcatccagcagggatctctggtgagggtacagggctctaggccaagggaacagccccatcaatggcagtgtgagtgcctttggccattagctgttttctgttgatttgtttaaccttctaaacaggtctctagggtgggtattttttttttcctttccatcttttgtgttaggttcaggaggtacatgtgcaggtttgttatgtgggtaaattgcatgtcacatgtgtacagattattttatcacccaggtaataagcatagtacccaattggtagttttttgatcctcaccctcctcccaccctccaccctcaagtaggccccagtgtgtgttgttcccttctttgtgtccgtgtgtactcagtgtttagctcccacttataagtgagaacataggctgtttagttttctgttcctctgttaattcactcaggataatggcctctggctccatccatgtcactgcaaaggagataatctcattattttttatggccgtgtattattccatggtgtgtgtgtataggttgggtattattatccccattttacaaataaggaaacctcagatcagagaggctttgccccttagtagttggatgcttttaggaaagtacctcatatcctggtgctatagtttccactgctgtagaatggaggagaacaagggatctagcctgccttggaggtctgctgaggggggataggaggtaaagtaagcaccacgcctataccccgggaaggacccagtgaaagtttctcctcctcctcctcttcctcatcattaataactcatgtagtcattctcaaacttttcatcctgacacttgacagctatttctcctctaagaacggaatgttgcttaatgtggcatcattttgaaacagggtcttcagaggttaaaaagaaaaagtgaaccatcacagagcatcctcagtgacccacattgcttcagccagtgtacaggaaatacttgtttattctccttctttgtcttcacccttattttttttccaacttttattttatttttatttttattgttgagactgaggcttgctctgtcacccaggctggagtgcagtggcgcgatctcggctcaacctccgcctcccaggttcaagctattttcctgtctcagcctcccaagtagctgggactacagacgcccgccaccacgcccagctagtttttctatttttagtagagatgggctttcaccatgttggccaggctgtcctcgaactcctgccctcaagtgatctgcccacctcggcctcccaaagtgctgggattacaggtgtgagccatcacgcctggcttcaacttttatttttaacttcaggggtacatgtgcaggtttgttatatagacacacttgtgtcatgggggtttgtcgtacagattatttcatcacttaggtattaagcctagtacatattagttatttttcctaatcccctccgtcctccaaaccttcaccctctgaaaggccccagtgtgtgttgttctcctctatgtgtccatgtgttctcatcatttagctcccacttaataagtgagaacaagcagtatttggttttctgttcctgtattagttttgctaaggataatggcctgcagttccatccatgttcctgcagaggacatggtcttgttcttttttatggctgcatagtatttcatggtgtatatgtgccacattttcttatcattgatggacatttaagttgattccatgtctttactgttgtgagtagtgcagcactgaacatatgcatgggtgtatctttataatagactgatttatactcctttgagtatatgcccagtaatgggattgctgagtctaatggtatttctgtctttaggtctttgaggaatcgctacactgtcttccacaatggttgaactaatttacacccccaccaacagtgtaaaagtgttcctttttctccacaacctcaccagcatctgttactttttgactttttaataacagccattctgactggtatgagacagtatctcattgtggttttgatttgcatttctctaatgatcagtgatgttgagcttttttaaatgtgattgttggctgcatgtatgccttcttttgagaagtgtctgttcatttcctttgtccactttttaataggattgtttttcttgtaaatttgtttaagttccttatagatgctggatattagacttttgtcagatgcataatttgcaaaaattttctcctattctgtaggttgtctgttgactctgttggtggtttcttttgcagaagctctctggtttaattagatcccatttgtcaatttttgcttttgttgcaattgcttttggtgtctttgtcatgaaatatttgcctgtgcctgtgtcctgaatggtattgtctaggttgtattccagggtttttatagttttgggttttacatttatgtctttaaaccatcttgtcttaatttttgtatacagtataaggaagaggtccagttttaatcttctacatatggctagccagttattccagcatcatttattgaatagggaatcctttccccattgcttgtttttgtcaggtttgtcaaagataagatagttgtaggcatgcagtcttatttctttcctctctatttggttccattggtctatgtatctgttctcataccagtaccactgctgttttggttactgtagccctgtagtatagtttgaagtcagatactgtgatgcctctagctttattcattttgattagggttgccttggctattcaggctcttttttagtttcatatgaatttaaaaatagtttttctagttctgtgaagaatctcaacggtaatttattaggattagcattcaatctatgaattgctttgggcagtatgaccattttaacaatattgattcttcttatccatgagcatgggatgtcttacatttgtttgtgtcatctcttattgcttggagcagtggtttgtagttctccttgtagagatctttcacctccctagttagctatatttctaggtactttattctttttgtggcagttgtgaatgggagttcattcatgatttggctttcagcttcactgtcgttagtgtataggaatgctagtgatattttgcacattgatgttgtatcctcagactttgctgaaatcgtttatgagcttaagaagcttttgggctgggactgtggggttttccaggtataggatcatgtcatctgtaaacagggatagtttgacttcctttcttcctatttgaatgccctttatttctttctcttgcctgattgccctggccaggaattccaatattgtgttgaataggaattcacccttatttttttaaatcactgcactgaaggcaaggagttgtctttgggctaccataggtgaggaaaagagatttgctcatgggattccatggcagaagagcaaatgattgcctggtatctggagaacaacctttgtgttatccatctgtattggcctgttcccatgctggtaataaagacatacctgagattggataatttataaaggaaagaggtttaactgactcacagttccacatggctggggaggcctcacagtcatggcagaaggcaaaggaggagcaaaggcacatcttacatggtaacatgcaagagagcatatgtaggggagtgcccctttataaaaagtctcaggtctcgtgagacttattcgctatcataagaacagcacaggaaagacctgccccacccccatgattcaattatctcctaccaggtccctcccacaacacatgggaattatgggagctgcaattcaagatgagatttgggtggggacatagccaaatcataccaccatccatccatccttccctctgttcctctacaagagttttggagcttctgccatgtgctggtcaaagggtacagcagaagaccaagaggcagtctgtgctttcacagagatcacattctgctgaacagaagaagtagagagatttagttatgtaatttcaatttatttatttttttaagaaaagcaaacttctaatcagggacaagagaaatggaatagggctgtgttggtggctgaggtgattacagtgagagaaaatacagttttcctatttttaatgccgagttttggctccgtagggggaaaagcaggaaaataatgctaataaggtctctctctgctttcttaaagaggattatgtgattttctctatgggatatgtgatattgaaaggtacaaataaaaggaagtgtctttcaagtaaggaaccatcagtagaggctcctgggagactaggagggctcaggcaggaggggaatccccagcatctggacaccccaggagctaaacgtttttgtggctataacttccttcatagcctcctgcaagatggagtaccttgtgccagtatctgccaagcagcgtgggatgccaggaattttatttcactttggtttctaatacacccctctctctctctttcttttttacagaccctgcaattgtcaatggggtttattggtctgaatctctaaacaaagtttttgtagataactttgaccgtgacccatctctcatatggcagtactttggaagtgcaaagggcttttttaggcagtatccgggtgagtatacctgcattgacagttatgactcagattaatgataactgataatgtggtatttttctttagggttcaaggttaaaacttttctgccttttcttagaagaaaatgaaagatgaattccaaacctattgtcagggtgcaggacaggaatggcaaggtggcatccagatgggcacgcacacacacaggacatgatcacaggaattctctggacctgccctgttctcaatagaataattcacagagctgtcaccaaatgtgaagaactgtagtgtgaactgtaccttatttaatacttctgaacaagagtttggccttattaccaatactgctgctgttattgctataattattattattggggaaaagagcatacttgggcaattaaattctcactaacaggtataagaaatagagaatttgaaccggatttgtccacccaagagctgactccccttgcaggaagatgttgaaatggcccaggcgtcgctgacggcaagaacccctccacagagggtgctcccagcaccctagcacccccagtactcccagcggtgcgtatctcagaggctgtccatcatgcctttggaacaggtgttccttctggagccttcccaggcctctgctttgtgataggattttaattctggcttggtttgaattttaattaaaaagggaagttttaattttgcttacaagttgtgaaaacaggactcggggctgcaactgtgccaacatcacagctgtagaaattaacaagctcaacctaaaagaagggggagaaaaaccccaccctgcataatcttggagcaattaagtgaagtctttcatgttttcattaagtaagactaggcacctgatgccttcccactttgaggcacagactgccggcctctgccttgcggagctgtttgccccgcgcacagcatctgaccctcgagaattgcctgctgggtctctgctttgccagattacagaacatttcccaagagtcatgttcagcatggcacacgtgcttcctcccggagctcacagaaatgtaaacaataagcatcctattaaagataatgccataataaacagtggacgattaaagttccagtgccaccaaattgcagtctgccttgatacactcaacagagagcaaatctggtgcagatattgctgaaatcagagcctaggggagaggttcctctgcttgggaagcccctgggtagccaaccgtctcgctatgcggcactgtgaagagggcaagacagataagtagaaaccgcagatcacctgttgtctcctccaacagggagtccttaaactatggtcacgaggacatttgaaaataaagggaatcctcataaagggtttgtgtaataggggagattaatttacatacaaggtttttatcagtcagaacaattggttcagccatgcttactgttcttttaggacttttgggcaggatgtggctctgtaaaatgcctgcataatttctgtgttagtaaagacgtgggccgcagtccaccaaggtgtttcaatgccttgataaatgtcatgtggccactcaactctgtgcttggttctgaacacagagcatacctcttgcctcctggacatgtgactcaaagagtgatcatgagcattttgcgaggatgtttttcttttcaggatgcctctttccattgttagagtggtgtgaatcagtggcaagtgtgcgtgttcttaagcagaaggagtctttcttcagtcttactgagttctggctttgtaccactatatgaggccctgaggataaaatcatgaactagacaaaagaggtctctgccctcatccagctccttcttgtggggacatgcatttgtcgtggattttgtttgcaagggacagaaacacaattccagctagctccagcaagaagcacacttactggctcatgtaatttgaaatctagggagtgtgccatttgggcgacagcaatgagagactggagcaaagtcatttggaatttgaatccttcctttcagctctcatttctgccttcttccattctaaccttgtctcactggcaagtgatctcctcgtaatggggaacaggcctggcaggatttctcagtgggggttccaggggaggagacagcatctgtcccagtagcttggatgaaagtccaagaattagcctggtctgagttgcttgcccaccactgatgcctgaagaactagtgggtaaggtcagccatccgaaaccctgggaactagtcaggattattgtggctttgcctagactgcatccccaaaggagggggcatcagtgaccaccatggggagatagacaggcaaacatcatcatggtacagtgcgtttcatgctaagctgagggaaatagaaggtgctgggtgatcactgagaaggatcaccaactccaactcctggcgtgagaggaaagagtcctgggaaggagaattttggtaagcattagcctgaaagccttggcgtgatgatgatgtccatttctgcatggcttcacacataggccttcaccagttcaatttatgtcctaagggcatgtggtaactctcttgtgtctctcaaaaggactttatgagatggtggaaatgttctgtatcctatctaatatcactaatgtcactggccacacaggggtagtgagcacttgaagtgtgctaggtgaggctgaggaactgaaatttaaatgttatttaactttatttaaaattaaaattaaatggccacacgtggttagtagtcaccatgttgaataacataatgctgtaggaagagacttctgtagtctgataccccgtttccaagggaccagccttatctttcagggcttgcattgcaaaaaggtcttactgaacagatgacttcattaggctctatagttcttactttataaaatgggaactctaccctgaaatcctgaaccatcaggctttcaactcctgtctcctctactataatatttgcccctgggaggagtcatttgttttgtccattactctgtcactagctgcaagaataacacatagtgggtgctcaatatgtgtttgttgaatgaatgaatcacccattagatcaaactccaccagatctgttgtctcccatcacaccagtggcagctgccctctctcttcagacagaatagagctattgcctctttgggggagctggtccccagctgcactctggtagagacttgatgactcagcaaggagctggcataaatgcagtacagagccatagtccctttatgttctcattgatccctctcctccaagtcttcctagtacctgccctttccaccccactgcccaccatgtcctggacactgggcatgcccatctgttggctatttccttctgatgctttatgaccatctcatctaatgagtagtgttctccaggctccccatctcccaggaggcagaggatcaaagggctgcacagtcatcccttttcctgtgaggcttgaccagttcatctttttatagccctctgtgggacccgttttctacctggttattggctgaggccaccagtgactgatctattcttcctgttctggccaattcttagctttatttaaaatgatgtggctggctgacagtacctacccatgtactcttacctacataaagaaaactgtgtctatacatcacagacaggtcactgtctaatcaaacacaggacatcagttaggttcatgcatgattataagaagccctggtcccttccccaacatcagactgtcacctttctatagccgtacgcaggggagtttgttcctgtagaaggcttggtaattacaaaggtcaatgattgtcttatccttgcactatgatttggctgccataggaaggtgaaagctggttcatagctacagccacgatgagggagctgaacagctaagtaaagagttctccataagtttggactcatacatgctgtttgctagtatcaagttcaggttctgtgcacagcattactttttgtttcttcccttccatgccttcctcaccaggctcaggtttagcaatggggagagtatgattgatattagggttttcttccttggctagctcaacaggactgccctaataaagatgatcatggaacaccataatttataattttcatagcaactgtcttgctatatcctcatattcatggtgcgtaatctctcaggagattggcaagagagatggcatctagttgaataaaggagctctttttagagaagtgcataggcagcttctcagaagacattttacagccaagtttgactgtagcttgactcacattagaagccagcatgtatttttgatcagatattttagatctaaagttatctggaaggtatgtgtttaaactttaaattatgggccaagtactaaatattttttgaggaaggaattgggcagaacttagggataaaccaatgtctgccaccccttgattttccttctttccacatctttctggactttttgctttcaagtagggaagacaaatgccatgtttcagtaggataggcagtatctgttcaggtggaggtggttttttgtttgttgtttgttgttgttgttgttctctgtttgttttttgagaaggagtcttactctgtctcccaggctggagtgcagtggtgcaatcttggctcactgcaacctctgctgcccaagttcaagcaattctcctgcctcaacctgccaagtagctgggattacaggcgcctgccaccacacctggctaattgttgcagttttagtagagatggggcttcaccattttggccaggctggtctttaactcttcacctcatgatccaccttggcctcccaaagtgttgggattacaggcgtgagccactgtgcctggctggagatggtttgaatgtcattggcagtgccagtgatgttgtatggaaaacactgcgctttaaagacaggagaaggaatggacgaagatgccctttcctgaagtggagagaaaaggagaacatggagcagaaataaaaccacagggcaaaaagatattcagatttttattgtgctatttgttgtagtccttcatagttccattacacagtctcagacctcattgccacacagaattatgttgggaacatgtggcttgaccttcagtcttgtatcagtctctgttcctttggccctactgtttcttttcacaagctaaaagagaacaggaagtcataggttgtcttaaatgaaattaattttcctccaatgttagtttgtaatgcctgtgggagagaacccgtgggatatagcagtgttgcacaatgattcaaattcactcaaatttgagcgtttgaatctgcagcagagatttggacattattttcagttttacatagggatttacgtacattctggggacaggggtggccgtggtcttaagatcactcaccacagttcaattcaagaaacatccactgaacacctcccgtgggtcaacacatttaaaaaacaaaaaataaaaaattatctttatatcacactcaaaccagttatttgtggaattataaattggagcattgcctagcctcaccagggatataacttcactgtttctcaagactgtgccatcctaatggtacctggctttatgcaaagcaatgtgtcagatatttttaaattaattgcattcttgtcccttagtgtgcaacatcatattagttgtattttatctttattacctaatgacctccaatttggcagtagcttcttatactaacattttctgatttcttatggagagtgtttttaaattagacacatgtgcagtgggaaatgtaggtacaagaaggacagaacccaatatctctttgcattacagactactgtctcaaggttatctgtgtgataatttggggatgttatcttcagcagatgcctgttattagcccattgtggtcctgtagaaagctggccattgttaatcggaaaaaaagaatctcaatgccatcagctgagtcaggattctctcctgcgaaaacgatatttctgtttttattttcttatctccaaagtctctgttgcaaatcctccatccctgagcagaactgatggttgaaaacagtgattttctgtcttatttttaagcagccaatgcctttcttttcaaatgatattttattcttaaaaactaagttggatatatcctgactaggctgcaaaccacaagactaaggatgttggatctgattttacacatggggaaaactccccaggcttcaggagctgaaattcaaactttattatgcagcataatgagagccattttatttcatttcaatgtggaaagccaggccaaaatttctgattttaaaaacaggagtgaggagggaacagacccgtgtatatccttagttggaaacattgtatctatgctttcaacccccctcctgtagacattacatcacctggtccagggacgggccagactctgcccagagatctatggatgatccccccaggtgcaacaacttgctggacagtaagaaatgacttcggctacctttatccctagccaagggaaggagctggagtcacatactctctcaatggacagcacagtcctaaaaacatctccactctctgcaggcctttggagaagctgagctagcgctgtgtttgctatagggttatggcccaacagctccttcctggatttggcgatggagcatgtgatgagctctggggttggtctttgcatgtgatttttcaccctgtccattcaatcagcaaagtagagcagccttgaaatgctatgaataaatatttgaagtttctgggtttctcataaccccatttttcttctagggattaaatgggaaccagatgagaatggagtcattgccttcgactgcaggaaccgaaaatggtaggcagtggtcagacctctttgttatttctcaaagagatatcttgaagagaagtgaagtcaggattaattttgacttaatttttcccttgacctaggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgctgtgagtgcaccgttttgtgccttctttgcacttgggttcatttgatcttttggtagtgactggttaacattgctctcgctgttagatccagagcatctagatgccagaacatgaggcctggttagtctcatgaaagttgacagagtcatggacagtggaaggcagtggaagggcttttggaaatgcagttgaacacacgttgcctgtcttaacctaccacacagccacaccgccacaccatctgagagaatgacacaccagatgtggtattcctggggagctgacattttcagattcttggaaaacagacttagcaagattttcaccaaaccactagaatttctcacatggaaattaacttccagctaggttagcctgatgatattgacgatgataataattgataataataataataatggcaatgaagcaactaaaatatggagagcactttatggctcacagaacactttatttcagcttctggaaaaaaggtggcatttattaaatgcctgcttttaataaatgccttaatcttcatatttttattatcttggtttttcacagcaagtctaggaggtagggggtggtttgggcatattctcaaatgaaggtgctgagattggaagagtgtcagtaacttgtccaggtcacaaggctggcaaatgggagatcagggaaccaagcctgagaccgggcagtcatgtagcctggaaatgaccacttattcaggtgtccatcttgtcaatgaaaagaggcaaactctgcaaaatatttgaagagatttattctgagccaaatatgagtgaccatggcctgtgacacagccctcaggaggtcctaagaacatgcgcccaaggtagttgggcacctgttcagcttggttcactggtgcagcttgtttttctacattttagggagacatgagacttcagtcaaatacatttaagaaatacattggtttggtccggaaaggcaggacagctcgaagcaggggcttccagcttataggtagattttaaaattttctggttgacaattggttgagtttttctaaagagctgggggtgaataaaaaggaatgtctgggttaagataaaggatggtggaggcccgagttcttatttgtagaggaagccttcacgtcctaggcttcagagagaataggttgtaaaatatttcttatcagacttaaagtctgtgttgatgttcatgccggagaggtgtaaggaggcatgttcgacccccatttcccatcacggcctgaaacagtctctcagattaaattttaaaagagcctttgtctcctgtgtagaggaggaagtccattcagatggttggggggggtcttagaattttatttttggtttacaatctccagttctttttcttcttcccactgattatttggtatgattttcatcatgccccttatgttcctcccactctcttaccaaaggctcgtcagagtgagcctgatttctttgagtccttgagcacttaaccaagtgtgtgtgtgtgtgtgtgtgtgtgtgtgtgtgtgtgtgtgtgtgtggtggacacttattcttttgcatgaaaataacacacatcacatctatttgggaggtggagtagttgctatggacaatggaggcagcatggtgatgggcgcagagcctgggttttggagttgggctgttttgaatcccattcaccacatatgctgtgtgtcttgggctaattactttagtctgggcatcagctacctcagctgtgaagtaggtgtgctcaccttgcccacagggttgctgctgggatcatctgagttgatgcaccagagtcaagctggtgcacagggctccttagccagtggtgggatacaaaagaagagggtgctccgagaatgctgttgctgtggtctgcatggctcccctaaacccgcaaggagagtatgttgtcatggatggagccttatgactgggctgccttctgcataggcgtgacacccacttgtgttctccaggcagagggcctgggcctctaagtgacatggtggccgaggggattgcctgaattagtatcctgcctatacaggcctcttctgatcagactctcagaacaaaagtttctgattttaagaaatcctaaagacgaaagggaaaagaaagagaatactaaattccttgggagcaggggttagtcttgttcattcatggatgtatccccagcacctaggcagtgcttggcaaatagcaggagtttaaatatttgttgaatgaataataaccacagctgccttccactcactgtgtgcaagtcagttgctaagtgtcctgtgtggattatctcactgaatcctcaccccagctctgtgctatgtggcatggagacagaggcatgaagccgcagaagtgactttttgagttacacagccagaaaaggtggcacggtgaaggctcagacattgtccggcttcaccttgcaccctttcctgagcagaagtgaagaggatatagttgatccactcagccatcttatcatgaaattatatggccttgaggcatagttctttggaagaagactttcagatagttagaactttgggtttgctgccaagttactctagttgccagcctagtggtgagaatgcaagtgtggcttgatccccacacatcctgaagcatttatagataagaagcagctaatatgagactatctttcttattaatctttaattactcattacagaagtatcagaaattcacgtaataagaagagctaactaattacatcctgcattctttatcagtcaggatttattgttctgttaacaaaaccaatcgattgaaataatctatgtaagttcattaagatatacaaacagtgtcaactcaataaagaagagagggtgactaagataattaaaagtaggcatgccagttattatagaagagttaagaaaaaaaatttttttaccccaaattgtccctttatataaagaaacccattaaagatcccattaaccctcactgtgcatctgtttgttcattttcaacataaataatcagcttcaacactatttacataattatttcaacaactagaaagacactctgaacttctttatttgaagcctttatagtaaaatcatgaactttgttcctctaatggataagagaatggatcagatatgttagtgaatttatattagaaggccaaggtcataaaagaaccattaattaatagtaatgtttataggttcattgctttttaatgtaggcaatgtatgtaataattttaagcaattcagtaatgttctcatttctctttcatttggcacatattctaaatgtttctgtgtatatgagcacacagtcttttcgcaaaaatggattcatattttacagaatattcagcaactcttatttcaatcaaatgtatttgaataacagagcattccatcacatttgttactcagaagtgctgcagtgagtgcagtgcgtacagtgcactgaatggaatgcatatatttttgcaaggttgggtgtgcttctattgaataaaatctagaagtgaaatttatgcaccaaagggtatacacacaggcacctaccagaatgtctaccaaacagggcataatgtttacacagttaccaacagtttgaggcttctaaataataggagattcctagctggctaattttcatttgcattcccttgaattgtctctcccaatcctaagtgtgttctgcgaattttgcctcgttgaattcttattcttttttcctccatcacctccttctgtttctgccctgacataattgctctagtaatatggtgtaggttttccctcagtctgtttaaaatggtcacttgtctcctgtgtagagggcgacccaactgcaggttcttaaagtgcaggggaatgggatatttgaaacgccatccagaacgccctgcaaatctgtgtgagtgcattgttatcatcggctggattccatttacgaaagaggacattatcatttcaccctccattacactgtcagccttcctttgcttgccgggtagatgtttgtggagatagctcactgttttagaggaaaagtaaagaatacaatattttcagtgccggaagccctcgtgtactgtaggtttttgtttgtgcaaatctaattcatcattgcctcttgattttcagtgccataatggaggtcggaggaaagagatttaaatagtgggaaagacttcccttggccacttaagttcgtctttcggttttgcaggttttattaagttcattgtgaactgcatgtttaatattatactgaaaagtttctgatcttgatctatccagagtataaacataaagagataatgttaaaaattgttttagctctcatgggcaaggtattacaagatctatctaaaatggacaaactaactgattgaattatgaaagaatagttgaaatatgagagtaattttgtgcagttgaagttaaaattttaaggtcaaaccactggtgcatgaagagagatgtctctgacaagagaaaaggcatatttttctgattcactttgaagtctaacttcaagccatgcattaaattaacaatattatcataaaaatgagggtgctaattctgtccgatgttgaaatttgaaaaatgactttacagaagcttaagccatgcattaaatgaacacagcattaaccgggccaatattgttacatcaatttaaatgcctcctgcagcccatatttgtgcagacttgaattaagaagagcatcatttgttagttcaagcaagaactttctgatgccctggttttaatttgcagattttctttagaacggtttctccgatgctttgccgctgtggatttgctttttaaagtaatcgattccgtattaaaagtatgaggatagtattttctttcagtgctcatttgttctgtactactaattgtgtccagttgtgtttcaaattacataagatgcttttgtaatgcaaaagatccctaggatggcttgtgttggtcaaaataatgtgtgttcatctgctttattacataatccctacatgttttcattcaaaggttatttaatcaaaagtgcaccagtaaaactgtaaaaatatttaatggagtcccagcaattctgcatcagtttcttgtattacatgagcatggcagcatttaattctatgggtttttttggcagaactttggattctttaaaacatagccacttacttcctttactttttgtttatttacctgttttttgaagggggtagagattcttatcttattttttgtttctgtgccaattttttttctggctttgttcctagtcctttccatcagtgatcttctctgcaattttgcctttttgtttctttgttctatcgattcattcaacaaatagtactgagtgctctgcattaagcattggggctaacttaagacaagctgtctgctctcagagacttaggttttctgtgtgtgagccttgtttgggggctaccaggaagcaggtctcacaacacagtgtggccagtgcagtcttggagagggagtagttggggggctgggtgtctagagctgggtcatgtatcgcctggggctctgtggtggcttatcagaagaagtcatgactaagtggacacttgaagataagtaggctagccaggcataggcaaacgtgatgggacaaggcagggagagaaggaggaaggagtcaacaactgaggaggaaagtgccatttgcaggtgtaagatccccctaccccagcccctaagaaggagctcttggtgtgtctggatcacataggggggtgggtgaatgtggaggcaagtggatccggtgagtgatggtgaaatgaatgagactggatggagagaggcaagccagatcgaaccagtctggtcagccaggtggaggaattgggacaacccatggaggcaatggagacccacagaaatgagtctcagcttcagggcagggtgttgagatgcgccccgaagccggtccctgcttagagaggtctttcctcatcctcttctctaggtgactgataaccttctgttaggcctgaaagcggaattgctttcatctctcaagttcagcttctgacattaggtgggttcctcactgttatccagagcccaaagtcagttgtctttggctctctggcttttggactgtgattcacctgagcctgtgtatgctgggattctacactaatgcagaagctcctgtgaaccttggtgggagggtctagcccatttgcattgcttttagatccttccccaaaacgttctggcccttcatttaatcaaagttgtctttcctatcttagatcatcattaagattctcattgatcactttgctgtgtctgtaaaaggggagatctagggaatgctcacagacattgggcaaaaggaaagaaaaggcatatgatgatgtgtcccttgccttcagggcggagagtttggaggttggttgaatggagacagagggacagttacctcagcaagagttgtgcgatgtagtctaatacctgaggaagattgtgggtttgtctcaagcttgttgttatttttggagggactgttgcagcatcacaaataagcactatttgttataaaaaggaaagccagggccaggtgcagtggctcatgcctataatcctagtacttgggaggctgaggcaggaggattgctcgagcccaggagttcgagaccagcctgggcaacatagggagaccttgttgctacaaataataataaaaaaattagctggacgtggtggcatgtgcctgtggtccgaactatttgggaagctgagtcagaaggactgcttgaccctgggaggtggaggctgcagtgagctgtgatcacaccactgcactccagcctgggtgatacgtgagtgggacccgcgtttcaaaaacaaacaaacaaaaacaaacaaaaggaaaaaaggccttatgttcagatggaacaagagtaaacatactcttttactaagaaaagtaaaaaacggttcattgtcactctacaatgatggtcataagcaaacttagccagtgttttatgtccccagcacacagtaggtgcttagggtaatattcagtgagcaaataaagaagtgaagagttctgtggcagatgccttcctgcgtggggatttcccagtaagctggctgcaccgtcttggctccctatctgccaaagaccccggtccctgggaggattcagagggtggcttagagtgggacagtgtgtggccagacatcatgggcttgtcttgggtacatagatagtgacatgtgcctgatgacatggcatcttatccccaacaaatgcagatccatgatctccagagaaggccaaggacacatgcccctgttccaaagagtgagtcactttgccgtcactgacatcaccctcttccttcatagcaagttccagctctgggtgcagggtgtcatctgttggcctttccctttatgtagcacacatcacactcacatatatattttctttcttttttgtgcatttgtgcctgtgcacctagatgcctttctcattcttacgtgccaggttctatgttgacttatttcatcctcacagtgagctcatgaaagaggtgcagttagaatacctgtttccccaacacaaaagctgaggccaagctcacccagctagtgtgtggcagagtcaggatttgaacccgggcctgcctgcctcagttgctttagctctactgttctacccttgtgagaatcagaaaaggaaagccaaccaggaaggaagcagagagaagaaagccaacagcatccgagtccccgtatgctatgtggcagcttctaagctctttaaagggtgaaagctgtttgtccatttccttaccgtgtagttggtgggctggactggacccatttccagggcagcctgggcccactcctgtcttcctaagagactcttcccatttcccagaaatttgcaagaaggactaaccacttgggcagaaaggggaaagtttaagtacgtctttagggttcaatcctggtagtgcagggaagtaaaagcaaattatagaaggaaattgcatctagctggtgatgatgtacattgtatccttttcttccttagactgttgatatcagattatttcactagggatcaaggagagccatttataaggctgttgtgtcttagggcaagaggtgaccaaatcttgagttgtaaatatatatggctcttctacaacatcgtttcacaaaatagaaatctagagaacatacacaaaaatgcagaagctgaaagatttccaaataaagggctgcgaggagtctggaagcagttccgtgcacagggcatccttggggtccccctcgggaggagccgttgggtagtgagaggagcgtgcatagctagcaggccttagtacagctgcctggtgtgcacagttcccttacacacatggctgagcccggctccctctggtgatacagaccagattgctcagcatagctttatcctgatgcagtcaagggaaattagtcaactgcaagcttggatgatgccactaacaagctggctgggattctgaagagcggattcttccactgaggccatagcacacacagtgctggcaagcatggttttgattactgcacatgtacctccctgatgagggcaagaactccttggtcttcttgacttttaaatcccctctggagcccccacaagtatagacttttatattagcaaggcagtttcaggtctgttgcctcactcaatttctgcagggcccccagagggagactgaaggtgaattagtgtattcttatgcataagattctgggatcagagaggcttagcaacttctccaaggccacacagtgagtacacggtagaggcaggacttggacccaagtgacctgactcccagctcaaactgtacaaccccaggaatcaattttgagagtgtgtattaggtagaatgtcaatgaagtgattcaatttacctggaaaatggaagaatgagaggaagtaaaaccacggtgggaacctcagttaagaaagttttgggctctggtttatagaacaggtgaggaaaggttggttcagcatacaggcatctgataatgtcatgtaagaagcctggaggaaggtggctgcagcttttgcacagtagctcaacattatcttcaggggcccacactggctccgtcttcctgctgtgtcttccttgggctttgcattccgttctttctcttgtaacctcatagttgcaaaatggctgcagcaactccacaatagcatcccaagcaggaagaaaagagtgagtatagatgagttttcccttaatggcaggaaaacgtttcattgaaactgcccatcaaactttcccttatgtcatggtcatttgactgcccctagctgcagggcagcctatgaaaggtcgtgtccaacaacggggaactggatggctgtgactggctaagaccctttgtgcttcaggccttagaaatcggtgtattgtcaccctaaaccaaatgagtcagcaagggaagtgaaggagaggggactggctgttttctcagcaacttccagggtcagtccaacagagattgagagctttggaggagttttccttcatattgaactctgcagttgcttcttggatcctgagctgatgttctgtttgttgactaaaagtcatactcccatttgtcagtggctaatgtcataaatatattttttctccatgccttgttagaagatatttaagccctcaaatcattgggatataatttttcaaatactttttatatgactaaaagcaaagatgaacgagagggcacaagcctgactgatggggagatctggaggtttgggggccagagaggataagttgggggcattgaggacctgttgtgagtggcagtgaggtcagactgcctgaatttgaatctggactccaccacccctcacttactctctggtgtctttgggcaagtcgatcatttttgccgtgcctcagtttccccatctgtaaagggtgagtgattggacgtgcttgccaaacggtgctaagataacgtgcagatgaagtttccctgctgcctaggtgcagtaagtgctcaataacagttaattgccaaggtcagtttgatcaccacttctgcttgcttagtgaggctctctccatgggaaacctgatgcatcccagttgctcttgagcagctttaggtctagcccctcttcgacctgtccctgcggtgtatccagagggatttcccaaactcgtatctttattccactcactcccttgctcacagccctgcctggtcctcgctgactttagttttaaagcacaaactcccgaggccctctttgctcaagagttagctgggtctgggagagatggttctgttctcttccctcaggagctccgggcctctttggctgctaaagtagatataccataacgctgtcatcaatcaaatggtcctcaggcacctactgtgggtccagccctgtgcttgctgcagaaaataacaccgaaggaccaggcatgggccctaatggtgtggtcccactttgtggtggggaatccggccaacagataattagaatttacagggattatatggaagagggacctaacccagtgcctagcctgcaccagagcctgcttcccagaggaggtgggagtaatctgacccaggaggtgaacaggagtcagccagagagaagaggtgccagagcgagagctcaaagcaggggtcccagcattggagggactgaaggaaaagaggagacatgtcagaggacagcaggggaataatggctggccaggataagttttaggggaaggctgatgagtaaagatgctagagtgtcagcaggaccaagggtccagagcctcacaaagtcccgggaacattcatctgcacagcaatgggagctgtgaataggattgacaagaggcaacacgatcagatgtgtaaggaccggcctccctgcagggcagagaagcaagcttgctgagagaaatgatgagaatactcacatttttgctacctggttgtgagcttcgggcaaataaaaagtgtgggggggtcctattctggatattctgggattgaagtgatgggagtgccggtgttggcaatgtatgggaaattgtgcatggacagtttcctgatcagcacccacatacccttgcagagtgaccagggaacatcaaggcttattctgtccccacttgtgtaagccacacatgtgtcccttggttccatgaagccaaagacagtagctggagctgtatccacgcaactctggggtgctcttcagctcccaccaggaccatgggctgtcagccatgcccagggaactgccagcgtttggaggcaaccccaaagaatgatcagttaacagggtgcaccctgaaccctgccagctaccagcacatgctctagaagtttctccttcaaacaagaaaagaatgaagtctgtctgcagcacataatcatagttgtctagagggacacccatgagagagttcaccttatgtgaataaatggagcctgtgattgtgccgcttttttgtttgtgtgcgtacctccttaaattattaagaagtacccttcaattccttaattaagtgttccttcttgacttttttcctttgcagtataatgaggagcttcactatgtggaaccttgcctgaatggaactttggtgcaagccgacaggacaaacaaagaggtaggggcagctcgggggagcattccagtcatggtacacccctgtctccctcatagtgattgtttcacaataaatctgtcttatcaaatgcactgccctttcattgaggcccttggagcccccatgtgtagaatatttattaagagcacaaagaaaatcatggcactaaaataattacattgaattcaaaggcttgctagttctgaaacaattgcattcacttattgtccttgtgctctaataaacacaatgctatggtgtgcttgatgcttacgttgacactcttgaaagaatatggctcttgctaagatttcaaagaaaattgaacccacttgttatttcccttgtccttctcacgattgattaaatggtcactggggtaactgttggggtaacttgtctgctattaaaggtaagcttttcaaggataggaatgctgtctgctcactactgtatcctcaatgtgccaagcattgcctgttccattaatattgtggaacaaaaggacgatacgttaaaggagaatcttacacaatgggatagaggtttcccctccagttttggagtatcctaggaaaatttctaaagtagacttctgtaaaataaatcctgtttccctttagccacctttaaatttgtcagtacagctaccgcaaccaccactataccacccctgcagggccagttgacagtttcacttgaaggtatagctgtggctgcagccatgtcacagcttctgggactcacagctgccattgcccatgttgattttctgtacctgacacacagagctgctcttcccctggagagcagacctgcatgaggtagctgggggcaatggccaaggcaggcttttgtgaggcacattctatatgctggagagaatcccctggctcgtattgtgttggtgctatcttagatgcaggtagtagaagcacttaatttaggtatgtttgaggaagtgagcaacagaggattgggagaaattcattccagttggaacacaaagtataaagtgaaaaatacactagagttaatatctgggcttcagtttgaggggaaagaagcagcatgataagcttcatatttaggagggaggaaccaagtacactgaagttcaaagaacaggtgtaacctgagaatgctcattcatggtaattgtttaggctaaggtaagaaaagtgacttaagtctatagccgcatttttctagagactttcccgttgtttggccattgtgtaagtgaagatctcatccctattccaatattgtaatattgtaatatcctccagagcctcaaataggtgttccatcctggtgcttgcaacgttaaacagaacaagcacttaaatgatcaaagccttccttcagattgcttcccagaggaacaaaggacagtatgatctttggaaataggaagttttatgaatgaaaaaaagtcattagaggaaatgggctaagaaattattctaaattgcctttgagtttatggatattgaagactggaatacttttgaatataaaaactaatctggacttcttattctgccaatatggagtaaccatattccaatgaggtcctcacctttataactgagaagccctagacataacgcaacaaacaagtataggttgagtattccttatctaaaatggttgggactagaagtgtttctgatttttcagattttggaatatttgcattatacttacgggttgagcatccctaatctgaaaatctgaaatccgcaatgctccaatgagcatttcctttgggtatgactgttgagcattatatcggttctcaaaaagtttcagattttggagaatttcatattttggatcttggatttttggattagtatgcctaatctgtataagaagacttgaaaaggagaaaatgaaatgtctaggggctttgggtcttaaagacaaaagggaagttccctgattttcctctttgactcccatatatcctgaatagagcattccagaatctcacctggaccaacaataggcacagattaaaaaaaaaaaaagaaagtcccagaaaatcttgttccttctagccaaaggaccacagaaaacctttgtgacaacactttttctactccagctgaatatcaacggaacaaccaatcctacatggtttcagtggggccaaataagaagttgatcttttgccccatgcatacccccttggcccttctcctaccgagaatgactgctaagagaaaagatgaaatcggatccagagtctcataatataaaatccataatgcccagaatgcaattaaaatgccacgaactgggaaaatcacaacatgaatgagaaaaaacaatcaacagaagccagtatttacatgaattggatgttggaattacaaaattgttttaacaagcaattaggaattctcttgcaacaaatgaaacagtagaaaatctcccaaaggaatagaagttataaaatagagccaaatggaaattattgaactgaaaaatacaaccactaaataaaagctcactgatgagctcaatagagtgaagatgacagcagataaaatcagtgaatttcaggacagatcaatagcaattacccaatttgaacaacagcgagaaaatagactggaccaaaatgaacagtctcagggacttgagggacaataacaaaaaaatataacattaattacatcaaagtcataggagaggagagagagaatgggactgaagaggtatttaaagatgtattgtctggaaactcccccaaactgggtaaaaggtgtaagcatacatattcaaaaggttatgcaaactccaaatagaataaacctatgtaaatccatgccaagacacatcataaatataattagacaagaaaaaaatctagaaacagccagagagaaaggacacattgcttatatggaacagcaatttgaattacatagatttctcatatgaaatcatgaagaccagaagtaagtagcatagcatttttcaaatactgaaagaaaagaactgccaacccaggattctatatccagtgaaaatatccatcaggaatgaaggagaaataaaggcattctcaatggaaggaaaactgtaaaactgttgcctctaaacctacccttaaataatgtctaaagggaattctctaaacagaaaggaaataaggaaagaaagcttggaaattcagaaaggagagaagaacattggaatgagtaagaagattacaattagagtatcctaattctcagacaattcttaaattatgtttgatagttgaagcaaaactggcctaacaccatctgatgtgatacccaatgtttatggatggaatacttaagacaattatattttaaaagtgtgaagggtaaagggacctaaatagaaggtttctatacttcagtggaaatggtaaatactgatatgagtagacagtaataaattacatatttgtaccataatacctacagcaaccactaagaaaacaatacagagagttattcttaaaaagtaactcataggaaggtaagaaatgagaaacagaggaattagaaagaggatgaataggaaaaaaataaactggcagactcaagttttaatatatcattaatcaccttatgtattagtctgctctctgctaataaagacatacctgagactgggtaatttataaagaaaaagaggtttaatggacccaagttccacgtagctggggaggcctcacaatcatggcagaaggcaaggaaagagcaaaggcacatcttacatggcagcaggcaagagagcatgtgcagaggaactgccctttataaaatcatcagatctcatgaaatttgctcagtatcatgagaacagcataggaaaaacccaccttcatgattcagttacctcccactgggtccctccaatgacacatggggattatgggagctcaaattcaagatgagatttgggtgggacacagccaaaatatatcacctgaaatttaagtgttcttaagaccatcagtgtcaaggcagagattgtttgagtggattaaaaaaacacaaacaaacatgatccaaccgtatgaccatatgctgactataagaaactcatttgaggcctggcacagtggttcatgcctgtaatcctagcactttgggaggccgaggcaggcagatcatggggtcaggaaatcgagaccatcctggctaacatgttgaaatcccgtctctactaaaagtacaaaaaattagctgggcgtggtggcacatgcctgtagtcccagctacttgggaggctgaggcaggagaatcacttgaacccgggaggtggaggttgcagtgagccgagattgcaccactgcactccagcctgggcaatagagcgagatccatctcaaaaaaaaaaaaaaaaaagaaactcatttgaaatacagtgacagatatgttgaaagtaaaaaaatcagaaaaatatgtaccatgctaacattaattttaaagtaagagtgattctattaataccatataaagtcttcagggcaaagaaaattactagagacaaagaaagggatatttcataatgataaaaggatcacttgcatagaaaaacattacaatcctaagtgtgtttggatcaaaatacacagtttcaaaatacacaaagcagaaactgttagagctgaggatagaaatagacagatttacaattatagttgggacttgtacattccacagtcaccagttgataggctactgtacaaaaagtcagcaaggatatagaagagctgaacaacaccatcaaccaatgagattgaaatgacatttatagagcactctatctaaataacagcagaatacacgttcttctcaagcacctatggaacattaagcaagataaaacatcctgggtcatagtagaaaccttaaaattaaatctttaaaattgtagaatataatttttgatgaaaatggaatagaacaggaaattcataacagaaagacagcagaaaaatccccagacacttagaaattaaacagtatactattaaaaaaatacttgggtcaaagaggaagtcttaaaagaaattaaaaaaaatacaaatctgaatgaaaacaaagattacatatcacaagaggtggaacaaagctatagcaatgttaggggagaaatttatagcactatatacttacatatttaagttctctaataattgaagtttccacctcaagaaattagaaaaaatagtgcaaaataaaactaaagcaagcagaagggagaaaataataaagagccaaactcaactaaattgaaataggaaaacagtagagaaaaatcaatgacaccaaaagctggttctttaaatcagtaaaactgataaacctctaccaagactgataaaaatgaagagaggggcaggcgcggtggctcaagcatgtaatcccagcactttgggaggccgaggcagatggatcacctgaggtcaggagttggagaccatcctggccaacattgtgaaaccctgtctctactaaaaatgcagaaattaactgggtgtggtggcatgtgcctatagtcccagctactcggtaggttgaggcaggagaatcacttgaacccgggaggcagagattgcagtaagctgagatggtgccactgcactccagcctggcgacagagcaagactctgtctcaaaaaaacaagttaaaaaaatttaaaaaaataaaaagagagaagacaaatcagcaatatcaggaatgaaacaagagacgccagtactgaacctgcagtcattaaaaggataataaaatactattgtaaacaactttacactcatgaattaacgacttagaaaaaaattgatcaaattctcaaagccgcaaacttccaaaattcaaccaagatgaaatagatagctagactaatcctataactattaaaggaattgagttgataatttaaaagcaccctctccctgccaaaaaaaccattttcaggtctggagaatgctttcactggagaattctaccaaacatttaaagaagaattaatatcaattttacacaatctcttccagaaaaatagaagagtaaggaaatcaccccagctcattttataaggctagcgtttccctgacaaaccaaagacagtgcagaaaaagaacaatatttctcatgaacttacatgcaagaatcctcaacaaaatttcagcacatcaaacccaatgatgtatataaaaaataatatgctacctgcaagcaggattattgagatatgcaaagccaatgtaacatccatgtcaaatcaatcaatgtaatctactatatcaacaagctgaaaatgacaactcatatgatcatattaattgactcagaaaaggcatttgataaaaaacaccctttataattttaaaaatacaaaacttctcagtgcattgggaatgggaagtaacttctccaaattgatagagaccatctacagaaacctacaggtaacatcaaacttaacagggaaagtttgaaagcttttcctcttaagatcaggaacaggtaaggatgtccacactgacatttgacaaagtgttaagttttagtcaggccaggaaaagaagtaaaaggcatacgggttacaaaggaagaagtaaaacttcctattttcagataacatgattgtgtacatagaaaatctcaaagaatctacacacaaaaaaatttcctagaactaataagagagctcagtaaggtcacatatacaagatcaacacaaaaaccatcctatttctctaccttaataaaaacaatgaacctatggtaactgaaatttaaaacataatacaatttataattgttccaaagaaataagcctaacaaaacatgtgtatataggctgtatttgctgaaaattacaaaatgctgatgaaggaaatcaaagaagacctaaataattggagagacttaccatgttcatggatgagaagtctccacagggtaaaggtgttattttttttcaaactgatatgtaggtttaatatttatatatttaatagttatatatttaatattaatatgtaggtttaatttaatatgtatgtataataataccaaactgtgtttaggtttgatacaattcctatagaaatatctgcaagatttgtgtagagtattctagagtttacctaggaagtcacagtccctagaatagtaagatgatcttaaagaagaatgaagtagaaggaatcaatctacccaatgttaaggcctattatatagtaacagtacacaagagaatgtggcattagaagagaaatagacatatagattaatggaatagaatagagaacacaagacatatacccacatacatacacccaactgattttagacaaaggtgcagaaacaattcgatggaggaaggatatcttttcaacaaatggctctggagcaattgatcattcacagacaaaaacaaacaaaaaacaacaaattaaccttgactcaaacctcacaactgaaacaacatttaactcaaacggatcaaagacttaaaactatacaaccatgacattttctgaaaaaaaaaatagatgtggggagaaaatcttcaagatgtagggctaggcaaagcgttcttaggctttacatcaaaaatataatttgtaaaaggaaaatttgttaaaatggatctcattaaaatgaaaaaaaaagaaccaaaccttttgctatgtgaaagactctgttaacaggatgaaaagataagctacagattgagagaagatatttgcaaagcagatgtccacatgtccacaaatatatagagaatatataagtaattcttaaaactcaacaataaacacaattgaatttaaaaatgggcaaaagccatgaatagacattttactgaagaggatatacagatggcaagaaagtacatgaaaagatactcagtgttcttagccatgaagggaatgaaaattaaaaccacagttagatatcactatacctatcagagtaactagaataaaaaataaaaagaataaaaacagcaaatattggggaggatgtggagaaacaggatcactcacacattgctgtgggaatgtaaaatagcacaggcactctggaagacagtttgacagtttcttctaaaactaaatatgtaacttccatattactcagcaattgcatccttggcattaatctcagagaaattaaaattatgttcacacaaaagccccatacagaaatgttcatagcatctttatttgtaatagcctagaactagaaacaacccagatatccttcaatgactgaatggttaaacaaactgttctatgtcgccactatggaatattacttagtaattaaaaaaacaacagcaatctattgatagatacatccaagaatgtaaatgaatccttgaatctttagggagtcatgctgagtgaaaaataaaaaagccaatatcaaaagaacacatacttcatgattccattcacattactttcttgaaatgacaagtttaatagaaagagagaacagattagtggttgccaggggttaggcatgggagtggggagaggtcattgtgattataaaagggtaacatgagggctccttgtggtggtggaactgttctgtgtcttgatcatatcaatgtcagtatcccttgtgatgttatgctgtagtttgtaacatgtcattgaagaataccaggtaaagaatgtgtggcatttctcttattattattattattattattttatttgtaagacacggggtcttgctgtgttgcccaggttggacttgagctcctgggctcaagtgatcctgctgtctccacctcccaaaatgctgggattacaggcgtgagccaccatgcttggcctctttattatttcacacagttacatgtggatctatgattacctcaaaataaaaagtgtaattaaaaaataatctgcagtaggtgagaaattcttgaagagaagctttatcaaattagtgtgaacggttgtataatgcatgttaggttgctttagttatataaaaaagtactgattgtggttcactttttaatgacaggaagttttgatgttcttaccgtatgtgtctttttatttggagaaaagctcagacgacaaagcattttttttattagtatttggggatatgtttaaataatgctgagcttcattgcttgaaaccttaaaccagtttccatttttaccataaattcagtgttgggccatgttcatttaggacttacttaatggcatgtggcagacagtagcaaattcatgaaaagcaaaatagaaatttacatcagcttccctagcaccaaattcctagggtggaaaagtcagcacccaaaaccttacactggatgttaggagtcatcccctctccccagctatctcctctaggtgtcttccgtgaactctgattggttctgctaaatcaggtgcccattctggagccatgattgaatctcaaggggtggggcagcctagtcagcagcctggttcaggtgcctatacctgtggctgagaggcaggcctttgctgggcagacttgcctggttttccgagggaaaatgctctgggcaaccatgccagtgcctatgagatagatgttccatagaagcatgaatgaatgaatgaatttgagtagataagccacctgggagaggactgtggttgaaaaaagttttttttttttttttttttcacatcactagaacatccacaaaacactgaaaacaaaagcatcaaactcattacattttaatataatcagggccatcagaatgagattgtgggtgaaattatctgagtccagggttggcagttctcactgtctcattctgtctaaacaccctgaatggagctttgagtccattttctcacatcctttgtgtgatggggatggagaattatgaccttctgtataaacctgtgtagaactcgcggtgtgatcatcgatgctagtcttctgtcctgagttaaaggagtctgactagaatgtgccagatcctttggggtgtatcattctttaatcaaaatattcatgtgcatgctgacaagttcttatgacagccaaatacccaagattctttcctgcccgtacctttcatcttaggactgttttcctggtggccactgcagtgttaacttcaagttaatgaaagggcgtgaaggggcttctagaaggtgacagctgggattatgatgttgtgcactgacagccaattctggtttcacaatactcgggtgaccccctgagaagtcagaagtagatcatttaaattataacagcctttgataaactccatttaaaaatgtcgaagaggtagtgagaggatctccatgagtcttaaaacagaggaaaggttagggtgaaagtgctggccttgatcaaactgagttgtcctggaacatagattttcgagattttgcttgaaatagcccacagcacaccatccctgaagagggggtcttaaaattctgttaggtttttggttttgtcttttaaagctattgtttactgtctggagagagttttgctttgctgttttatgttccaaataactgacttcttttttcctttaaggaaaaagaaaccatgacaaattgggtgagcctggagttcaaatatagaatttaaatgagaaaactctcatcctaatctactacagaccttctgaaccattcatcagaccttaaaatgaacctcctgtggtctgtcttgggggagtgtaggggaagagagtgaggaaggagaatgatatgatttttctctggttttataatgaagatgtcctgaaatccactgaatttcatggctctgtttaagattcatttgcaaatatttgttgcaaaatcagcccaccttagaaacccttgtaactttcatcttctttggcagttttgatcttttcttgtgggatcagaagtcactaaaacttcataaactaacaaaagtacacaccagagttgctggattttccccagtacttttctttcagcctgagatttgtcaatggaggcactctggattctaaaacttcctaccttctctggccttataggtatagaatgtacagtttgtgagtgatactggggtgaggggtatgttatgaatcataagcagaaagtagcccttctgcacatgggcaaatgttgcctgctgaaacacctagggagacgaagtttgcagagagaacaaatacccacttttattcaattcaaaactaataaaagatagtaagagttgcactgctttttaaatgtcatgagtacattaaaaataacttacatagagaaaaattgagaacaacctacatgtaaataaattctagatccagtataatttaacgtaatttggctctaaattacaagaataaagtaggtttatatatattaccacaaaagagtgataatcatatatggttagataaagaaacacatgtaaatttcagaatagtatggttcatggcttctattttgtttgcttaaagacagaaagaaagaaggagaggggaggacagtggaggggaggggaggagagacgaggaaagaagagagggaagaataaaggaacagagggagggaaggaaggtgaaggattcaggaggtacacctgatatatttctccactgttagcgtgtctttacaatgaaccccaaatcctttcacaatcataaagaaaatattttaaataagtagtttcctaatattgaaattaataaaaatatttaaaagaaactatttttgtgggtctgtaagtgccagttgttttcctgtgattgtgaggatataacttctgctgatttccaggtatgtttctccctttgcacatgagctgatttgtgcttatcccttgataagcacaggcaatagatacagctacattttaaatccatatcaccttactgatttaaataaattataatgcagctatttcacagtgattcaaatgatgcataatgcaaaatagttcctaattcctgcatagcagctttgtagagttaaggctacacaagtgatctagggactgtttctatgcgagatgtagtacagaaactatgctcaattctttttttatattatactatatatttttatcaatttgatgaaatgcatttgtttgaaaataaccaatatactactggggaactaacacgattagccagtatatgccaataaattgtttgggttaaaaccattaatatgatacaaacatttttcattaatctccacttcattatagtgtgctaattgtgaattctttgtatgagcctagataagatgttagcaaaatttttttgttaagggcctgatagtaaatattctaggcttcgtgggccatacaatttctgctgtaactactcagctttacaattgtagcatgaaagcagccatgggtaatacgtaaatgagtgggcatggttatgttccaataaaactttatttaaaaaaataggtggcaggcaaaatatggcccttgagtcttagttttccaatccctggtctagactgtggacaagactagaaggagaagtctgttattaaataaataacataacattagcatcaggttaaaatctttctgaaaggtgaacatgggaattggtagttgagagcatgactagattgggtaatattcctttactcttctcatttcaactcttttggcaaatgaggatttggggtggatctttccttagactgtctaccttcaataaacttgccagttaaccaatttctgatttctctgttcatcagtgtttaactggagggcaagaagacttggatatatgttgtaaatagagatagagataagaaataatatcaataataaatacagcattttgcaatttagaaaatacttcttattggattctcatgattattaccagtgtcatttccaacttttacacctggggtcctgggcccagatgtatttgtcagctgagttgacagaagactagatagacggagaagctgagagagtttaagagacacatgcgggtatacacaatcagtaagtgcgcaaccacatcatgaatactcatctgaagatttcaaatactatcctattatcttcactatctgagcaggtagagttacctttccggcatggttcaaccctatgtcattcttctaaagatttgttctatagagtaaattctagttcagatttgtgttttaaaagagtatcactgaatatgatgtgttgggacatttatgtgataatgtatccttatggagctgtggtgcccatcttagtagaaagggcacaactgtttatatgtatgaagtgtaaagtgaagactaatacaatagttagtttgtcatttatttctatccatctgggaatctctcgaggttgttttatcttggaattctctgtggctgtacatagacaggtctgctgaaagctctgtgtgtgtggtgtgtgtgtgtgtgtgtgtgtgtgtgtgtgtgtgtgtgtgtatggttgtggatatggatgggtgtccatactcattggttctgccacttagccaaggagactaatcaagtgaaaagctggcttactgttgcctggcagtgacctggtggttgtgcccctgccatttctccccagttcctaccaaggagatgctatggagactgagactgctgcttgtaaaccttgtcctctggtcccctgctttcagtgcccatgcctttctttgcctgtgacaactgcttgggtcccagcagcacccatgcgtcacctgagcatcctgtcgaccacacagcctgccctcttcctgaggctttttccctggtaccctgtcttgatatcagttttgtggagctttggggtagcactagtgaaacagaggtagatataagaaataatatcaataataaagagcactaaaactgatttgattgatttgaaactgatcaaatcctgagactcagggggagtagtatgttcccagatacagttataccttatcataaatgttcacacctcacatacccagaactcacccatccattcactacttggactaccacagaggagcaaagccatttactctatatagggccccttgaatgccactcagagcccatttactcttacttggcatacaattttaaccaatttggctattaactatgaagggaaagcaattaggtggggagggcgggggaagaagtatccagagacagctttctctttcagcactcctcatcccaggaatggtgccactgtggatccagatgccaaaacctacacctacaagccattttaggtccctccttcagtctccaagtccattgattctccctccccggtaatctccagtccccgccccccatatctagtctagctggccctccgcagttactgtcatcattgtcttctcccagcatctcagccctggccttggtgcagagttccattccgctggtcctgacctccagtgcatgtgcttccacatgaagcagataggcctgtggaagcacagctgcttagaggacttccctgcttgcatttcatcaccttccccttgttgttaacacaatggcaaactccctattagtacctagaaggggatacatccctgtttgcccaggggttagtctccatatgtatgggctctcacggactagttagtaaaagcactgcccttcactgtcagaagcgtcccagcttggatggttggatcattaggccccctcgtcaagccctgcatgatacgccttttgcttgtgggttctcatctcttgctagtatgacctcttcccacccctggtctccaccagctttctctcttcgtctttcctgatccagccaaatcaaaattcttctgttcttgacttcaccatgcaccttcttaaaaccagaccattgcatatgttcttttcccttctctggaacgcgctgtttctctccttcctgttctcccacactccttcttcgcctggttaactctttcccattttctgatctcagataaaataacattccctttaggaaatcttcccttcccacctaacaaggggctcagtggcccctgtggtcttcccatgaggccacatgtgacctagtttctcactgccctccccacaggccagcatctcatggacaacattgtggtcaccactgtctccacggcacacagcatagggtcaggctctccatagatagcattgaatgaaggaagaaagaagcacatcccagccaatcagtctcctggccaacctcatcccctactgcaaggttttccctttccacctgagataaaatctaaccttctttcattagggtgaggccttctttcattaggaggaggccttgctgcctctctgtctactagccagtctctgatcttttcccactgtgggcaccccacaccctttcccacctccttagggcctcagcaccttgtgagatctcagctgcaaggtcatcttccctacctccccttctccatatcaccttgccctgatttttgggagcccttataacaggcatttctttctttcttttttttccacttgctccttgacctctctctcccaccttcacccctgaaagtctcagtgggcacttgtactcttgtgttttctctgctgcatctattaaaagggtgtctagcccatcgaatgggcttaaatattactgaccacataggtaagtgaatggataaggaaatactagatttcttgtcctgctatagtttaaaatggtcttgagggtaaaaggaagagtgatgggtgggaaaactgacagctgaaagagtaggagctgatcgtgtggtatttggggagaaggtgaaaaataaaaccatggataaaacaaccaagaaaaataggaaccctagatcccgagttgtctagggttttgctatgttatagcaacacacatatatcccattgcagttactgttcagcatgacaatttttagtctttggggtgaatttaaattctgttttggtgggagaaggtaattttagaaatggaaatgcctcatggttaagatttaggttactgcagctttgagtcttagccatggtgaccagccgtgggcactggttgtgtcacatcacacccctgtgagctgccctttcccatccatagagcgaggatcagtactaccttggggctgggcgtggtggctcatgcctgtaatcccagcactttgggaagcccaggtgggtggatcacttgaggtcaggaatttgagaccagcctggtcaacatggtgaaacactatctctactaaaaaaaaaaaatacaacaacaacaaaaaaattagccgggcatggcgatgtgtgtctgtaattccagctacttaggagactgaggcaggagaatcgcttgaacctgggaggcggaggttgcagtgagccgagatcatgccaccgcactccagcctgggcaacagcgagactccgtctcacaaaaaaaaaaaaaaaaaaaaaaaaagaagaaaggaaaaaaaagaaaaaagaaaaaaatctaccttggcttcagatacatgtcccagtggggctctgttattaaatgggataagagcttttagaacattttgcccagtgcccagcatcttaacaaatgtaattatttactcaaataataatgatgatgagtgctttattgagaggtgtttacatcccagatggttcgaatacagaaagacagaggatataaaggatacagtgcagtatcagaacaagcctttcccaggacatctctcccaggaagatgagtccttctgtatggagttctcatgtgcataccttaataccaagtcctctacctttcgacatttttaatggaaacacccaaaccactaagttagaatgtcctgttcatgatttcacaaatatttagctaatgataatggggattttagaatatggcacagaaacaggtccacactttgattcacgctcgtgtccttggccattggtcaacatagtctctgagtaaaatgcggtgaaattacccagagtacctggaccactctgcagaccactccagagacatgttagcaaaacaccgtttgtgatgctctgggttttcgtggccagcatctaatgtccaaagaattctggttttacactaaaattgatgttatttttatggcaggtgacaacgataggaagatatgaaagaaaatgcaactagcaagaggtcccaccgtgcattttaaaatcgcgccctattgagttgcttgcaggtgcggccgccttggctgttatatttataactgactggaacattgtgaatgtgatcaggacaacaggaatatagtcacgccatccccttaaactcgggttgccactcctgactttccacagcctcatcttgcctttcatttgttcatcacatactctgagggagaggaaatcaaacccttggatcttatattttatattagatgaatctagaaagacttgctcagaataaaaagctacttggaggaaccatattaaatcgctatttttgtagatcaaaaagtggtcaaatgtcggcaatttcatgtgaatacagcctgacaactcagtgtttctgttagatgttgctatggtcaggccctttattggacagtgacctcaggtgtaacacattaacccacatgctccccaatttgtattgtgaattccattaacagggagctgagcttgagcatacatgagtttctgttttttcttcccggtgcttcacgtaaataaataaaataactaattaataaggtgggggggaggaaaaaacctctggtaggcaaaacggtggtctttcacatgcagattatcccatcaatgcggggaaaagcagccttgtttccttttcctgccctcaaactttaattatttctgtgggattaaactgttgcttttgctaaacctggttaaaatgagctttgagaaatcactgaagcttttagtgccgcgtggcttcactctgctcgttccttaggtctgggtctcagtgccaggacatctgagcctgccaggcacacgggcagacccttgggtggctgccagggtctctgcctcagctgtgatccctgagcctggggaggaccatccagatgccaggtcctatgttgtgctggccaagggacctggcggcataagtctgctggcacagcctgtgcacggccccggagtttttatttttttgcctgaaacactttcggactggaggttggagctgaaggcatttcccaggaaggagctgttgtcttgccagaacgttgccagttctgcggtttcaagcagtgttcgacgcaccttcatggggttgggggagatgaaatggcttgggtagaaggtctgaaaaatagtggaagaaacctcctgcagctttactcccacctgcctaaaccctctgagtttccctcactctgggtcatgttgctaattcaggagcagtctcttctccattaaattcatccactgcacaaagcagaaggtatttctgcttgtgtaactgcctctttcttatccttagagggagaagatgatcctccatcggtaacacttaaaagattagccttaagtctagcagctttcgtgggtatttgctacaaactcttgctgggtcaagctggattgacttcattgaacagccagctgggtcttgcaggagaacatgcagcacagatcagtatgccccggttggagctgagttctcattagcattccactcaggggtcaggagctgagttactggcttctcctcaaggaccactttggggatctgcagattgctgagtaaccaagataatgcggtgtgctgtgaggcaatgagggaactgactatttttaaatagagagcctcctgctgtacttgtttttggcttttcttcctccccagttgtcatgagcctcctgcgctctggcttcattatgtgagcgtctaatgagccgggagtggaagctgtgggtctcgcagggagcaaacatttcaccagtgcagcccggacctagcttctggagccatccctgtcatgacactccctgaacctgcacttgatctcgttgcccagacatttcttcaattttgactcactttcatagatatcagatgttttgttttgggttttcttgtgacgtccagatcatgtgcccaaagtcttgcaatcggaattgcacgatccagagtggctaaccaagaccacagtcttgccacatttccattgttagacacactatgctggaggagacttggtcgacatttgactgtgcattttgacttatttactttctgaaatcccattctgcttatcaagttggtggatgaccaaaacttggctgggcctaagaatcttaaagacaacattgttttgttttggttttctttgtagagacagtatctcactgtgtcattcaggctggagtgcagtggcatgatcatagctcactacagactcaaactcctggtctcaaaggatcctcctacctcagtcagtctcctgagtagctaggactacaggtgtttgccaccactccagggtaatttttggattttttatagaaacggggtcctgctgtgttgcccaagctggtctgtaactcctgggctcaagtgatcctcctgcctcagcctccctaagtgctgggattataggcatgagccaccatgccctggacaagatttttaaaagtatgattcctgggcccacccaaagcctgcaggatcagaacctctcagcctggaggcctaggatgtttttaacaagcttccaagggaatcagtctgttgcagtctgtccaccgacatagtattagacactattgggatctaacacaaccccaaatcttataccccagtcactagtaagaaactctagcaattctgcttggatttgtttgaatgtcattacatgaaacttcatgagcatgtgcttctggagtctgatttaaatgtttgactcatttttggagttaaaatattaaataatttcatggtacgatatgccttctaaacatgtttattttttgctgatgtttgacactggctaattttaatagctagcacatcaaactaatagttgtgaaggactctgtgcccagttgccagttaaagaaaaaaaatactgttttcttatttgagcctttgaggacactgggaaataaaaccaggcactgataaacactggtaggcatttatgtagagaaaaaaatgtccataaatgcacacagtcctccaccacagtgcctggttcctgtccctgtgtctgcagcaagccatagttgccatcaggactggctacataattttcaagatccagtacaaaataaaaatgcagggcttcttgttcaaaaattattatgagcttcaagatggccaatagcaaggccaggcgtggtggctcatgcctgtaatcctagcattttgggaggccgaggcaggcggatcacctgaagtcaggagttagagaccagcctggccaacatggcgaaactccatctctacaaacaatacaaaaattagctgggcatggtggcaagcacctgtagtcccagctactcgggaggctgaggcaggagaatcacttgaacctgggaggtggaggttgcagtgagccgagatcatgccactgcactccagcctgggcgacagagcgagattccatctcaaaaaaaaaaaaaaaaaaaaaaaagggaaaaaagaaaaaagagagcagcagcagagcattaaaccaagggcagaggccgtctgagcacagagcatatgtgaattatacaggtcacacacccatgaagctaaccctggatttgtactcaaatttcttagctctgacgataaatatgttctcttttctacctgtttgtggggtgccttcaaaagagtactgacataataaaagagtcctgaattatgatagagatttttgaagtaaggagactgaattttagggcagcctgtctttgttattttttaaaccagcattcaatttgtttccacttcatttgcaacggcgtgaaagtttatctgaccactggaagaggcaacttctttactcacactcctcacattgcagaaagggcctggaatgggaccctttcaaagcacccacctcataatctgggattccaaactcaagttgaagcagtgcagtgtctgctgttgtttagacattctcgttgtctaaagctggagggttttgtgggtggtccctctctgttcggtgtcactatcaacaaatgtgtggaaagaagaaataaccggagatgagggcaagcttcaatcagctatgccttaattggtgagtcagttgcactggacacaggcagaatcaattaggaagctggactcagagggcgctggccgtgcagcccgcccggcaggaagagccagtgtgaggctccacagaagaggaagaagcgctgccccccaccacctcctcctcctaaataaggctccaggactgctgagttgcccaaaagtgctcaactgttttcagttcttgtattttccaagaattcctactacctaccaggctctctcaaccccatctatccaacccctttctttctttcaagggctacccctctggggtatccttaggggtctctctggctcccagaagacaagtcctgactcaacttccttcctctgtgactatgtctcagcatcagtctagctttcttgaaggcaggatctatctttcgtccatgtcttcactgttcctgacccggggaaggctgttcgttgtatggtctaagctggcaagttggatgatggcttcaaggctaagatttcaaaatgtggaatactttcatacagacatgctgggaagaggagcacatccacagcaatgacgctttgtctgtggaatgatgttttctcatgtttaaaaagcccgacaatttcttactacacgaaacaatcaagaatatggataagcaatagcaagagaattataagttgcatgtagttcattgtgacaaagaaccaactctagtatttttgtgtttatctgcaaggccatcattttattagatatgcatgctttaaaaaaaaaaagtttaacttatctaaatgtctttttaaaataagagtaaattgggatagcccttacagaccctgaaatatcctactgtattttagatggatacatagcattccaacctccttattattgaaaatatagcttacttctagggtcttttattttttattttttgctattataaacaatgctatgatgagcatcagtatattaatatttggatttgtttaattccttaggatatgggcctgaaattgagttaaatggtatttaacttttgcccacatgtaaaaccttttatgtgtgttgatttgcccattgattcaacaaacatttgagtgtctgccttaggctaagcaccattaggactttaggggtataatggggagcaagagtgatgaagtcccttctcccatggagatacaagttcaggtggaagaagacagataataaagtattgttagacccagactttagaccccaatgatgccagcactcacactgccaaccctgatctcagccctgcctactcaggggtcctttggcatgttaatcaggaatgtaagtttcttgtatcgaaaaccaaactcttggccttacctccccaaatcacaccttctcctagtcttcctcatctcagcaaacagcagtcctcctttccaagactcagaccccaaatcctagcatcatctttgtttcttcttcctggaacccacatcccagtagctagcaagtcctgtcacctgtgccttcaagagagccagcctctggccacgctttacccactccactgctctcaccctgggctgagccaccattctctgtttcctgaatcttggcagtaaccttctaataggttgtcctacctttgccttccccagcccccacttgatccccagcatccagcctattctccacgcaagagacagagtgctgtgccttgttaacataaacatcagatcacatcccttctgtagtcaacatctcatgaaggccgtactgctggagtagttcgcaagggctgctgtgatgaagtaccacaaagtaggtggcttaaaacagcagaaatgtattgtctcacagttctggaggctgacagtctgaaaatcaaattgtcagcagagccaagcttcccctgaaacctgtagaggaatcttttttggcctgctcctagttttggtggttttcctgcaatctttggtgttctctggcttgcagatgtataattcctgtcctctgtcttcacgtggcattctgtgtgtctatcttcacctggtcatcttttctaaagacaccagtcatattgcattaggggtccaacctactccagtgtgacttcatcttaaggcagctaattacatctgcagcaacccttctaggactgaggattagggcttcagtgtatcttttgtgggggacacaattcaacccaaacactggttgaaacccacatgcctaatgatggttctgagaagtttcaagctcctcaccatgcatgataatggcccttatcctattgtggactcaccttctaaccccatccattcccagtctttattattcaccagcatttcagacatgcaatgacttttccagccaaggacttgcctcgaatgctaccactcttagtgggaccaccctgaccacccaaccacagcagcccatgctccctacttcactctttctcacccaacccaccatacagaacacttgtttcttattgttacgctattttaccttaaatatctttaaatttatttggtgtctctccccattattgcccccacccactagtatgtaagttctatgaggccagaggctttgtctcattttccagtatgtagatcccagaaaagcatgtgccagtccttctggggacattactgtgaatcctagtgcacgtcagaattagataagtgagtttgtactaaatgcagacaggaactgattgacagctgtgtggcatgtataaataataatctataggagaaatcatttcatatgaatttgatgatatttgctccagctcatttgagtgacttttcttctgtaatgccttcagattatggtgcagactcctttactagtagaataaattgaattttaattctgagatgagtacagagtctgatccatttctgtagcttagattaactattcttcctttttctttatttgaaggcagaacatagcaatgaatcaggggaagggggcttatcaaattgcattagaaccaggtactattttcacttgactatgtaatgtaactttatatatatatatatatttcatttatgaatcacataataacaaccaatgcattcctcctattggcttcttgttttatacttttcaggggctggagagcagcctttctagggttgaaggagttattttcagtactataagaaggttggaatagtcgatagaggaagtctctttcagcacaaggaataggctggatgctggggagcaagtcggggctggggaaggtagaggtaggacaaccagttagaaggttactgccaagattcaggaaacagaggatggtggctcaccccagggtgagagtggtggagtgggtaaagcgtggccagatgctggctctcttgaaggcacaggtgacaggacttgctggctattgggatgtgggttccaggaagaagagacaaggatgatgctaggatttggggtctgagtcttgggaggattgccatttgccgagatgaggaagactaggagacgccattctgggaaacaaggcacatgaagtgagttgaattcggaggctcccgctcgctccattccagcctgcatttgtggtgctgcagccctgcaaatgtagccctgtgcgcacacactggagcactggatccctgggtcatgaacaagaagacgacgtggcctgaaggctctacttcttttcaccccctctctaatccctctttgctcaactctgactataaaagtctaaattaacataatcatagtatccacaaccttttcagcaaaatgcacctatctcccagtcctgtgctgcagatattcgcttcatgcttgcctgcatattcctctgagtcacttcagatcctcttcactacttcatatgactttttgagaaacatattttttaatttgcctcagaagtgaagttgaaaatcttttccatgtagtccttcgagccagagaagcagtaagtggacaaaaacccaattttaaggtttccatttcaatagtattttgccattgccactgagaatgaacaacattaagggagcccctgggcagaggaattggcactgtgcaagggaaggacatactttctgtatctccagtgggcatgttcatgtccctctagatctgtttctccccacctcctgtccctgaggtcatgcggcactatagtttctgactgtggaatggctccccatgcagctggtttttttgttttgttttgttttttgaggcagagtctcactctctgtcacccaggctagagtgcagtggtgccatcttggctcactgcaacctccacctcctgggttcaagtgattctcctgccgatgaggccggactccctgcatcattgccatcccctcatatatcccccggcaagactctccaagtgatgagaaattcccacagtgccgctacacacaatagccagagtaaaaaaaaatactgacaatactaaatgcgggctaggacacagagcaattggatctctcataggttgttgataggaacgtaaaatagtgcagccattctggaaaacagtttggcaattttctcataaatttaaacatatggatactgtatgactttacctatgacccagcaatcccattcctggatatttaccaaaaggaatgaaaaattatgtttatacaaagacttgcacatgaatgctcctagcagttttcattgtaaccacccaaactggaaacaacccaagtttccttcagcacgggaatgaataaacagactatggtacattcatacagaagaactgctaagttaaaaaaagccagtctcaaaaagttacatactgtatgattccatttatatgacattctcaaaataaaattatagtgatagaaaatgatcagtggtttccagggactaggagtggaggggagtatagggcgataaagggttattgcaagggagtttctttatggtgatagaacagttctgaatcctgattgtggtggttgtgacacaagtctattcttgtgataaaatttcataaaattgtacacacaacaaaaaaatgaatgtgaaaactggtgaaatccaaatgaagtctgtagttaggttaacagtgttataccactgtcagtttcctgggtttgaatattatactacaataaagatgttatcattgggggaagctgggtgaagggcacaggaactttctgatactagctttgcaacttttatgtcagtctataattattttttaaaaggctttaaacattcccctaatagcagctaataattcctgaatatttgctagtttccagccctttgctcatctcatttgaccttcccaacagccttgtctggtgcattctgttttgcccattttatggaggaagagatgttacgaaaatcacacacacaataaagagtagtatggctaggttttgcatgcacgtggcctggctccagaatttgtgtgtttaaccaccgtaaggtttttcctcccttgccaagctttgagataacaaagactggtgtagaccatgctgtgtgtagaccactttgctggaaatctcagtggtagtgctcaaagatgtggcttcatccttgctgcttgctatgatgaacatgactcttgcagatttaaaaatgtcatggccaaatttctttgcgcaataaagtaatgtgttttaaaagaatgcacaatctattgaagaaatgtataactagggaccttcttgccatagaagaggcttgcaggggatagaggctaagtagtgtggggaggtgaatggaccccatgacgttgaagccattgagttgtgatctggagtctgatacttgctagagaccttgaggaacttaacctttttcgtctgttttcttaactacaacccaagaacctatgcctcctgactgagcaattgagggggtgttatggactgaatcatgtccccccaacaactgtgtgtttaagccctaatctttaatgtgtatttggagatggggcctttaaagagacagttaaggttaaatgaggtcataagggtgtggctgtgagccaatatggtagctgttcttattagaaaaagaggcatcagtgatacacatgcacagtgaaaaggtcactaaaagacctagtgataaggtggccatctgtataccaagaaaggaggcctcgggagaagccaaaactgccgacaccttcaccttagacttctaacctctaaaactgtaagaaaatatagatctgagtggcttaagccactcagcctgtgatgttttgttgtggcagccctggcaaattaatacagagggaaactcagatagactctaaacgtgtttgaaatatctcaggtcctgcttgcacatcaagtgacaaggatggctgtggaaacctggcatctaaccatgtttcttagaaagagcaagttcatagcatgcttctccttttttattggcaaagcaggtgtttctcaaaaatgtacttgaggaaatagcagttctatgatgtgatcttaacacgtccgctaatagggaacagagaggagggggttttgtggtcaaagaaagcttaaaatgacaaatgaaaaaaattttaaatatgcttcttcaccacacgacttctcagagcttttaaaatgcttgtgtatattgtgactctctccaagagttaaataatttattttatggcatttccaaagcattttctaggaacaccatttaatcaagtaagttttgtaggtggtgatttgggaaatgttgttgtgtacattttcttggacggccataacaaagtaccacaaacttggtggcttaaaataacagaagtatattgtcttacagttctggaggctagaagtttgaaaccaaggtattggcaggtcatgcttcctcggaagcctgcaagggagattccttccttgcctcttctagcctctggtggtggctatcgatccttggccttccttggcatctagatgcatcactccagtctctgcctccatcttcatatggtcatcttcaccctgtgtgtggctgtgtctcttataaaaacgctagattaggggcccatcccagtgacctcatattaacttaattaattacgttagtaatggccctatcctaaataagatcacattctaaggtactggggtttggacttcaacatgtctttttgcaggacacaatttaacccataatacctgccaagtactttgcaatgattgggatacatgccttaaaattttacttggttacttttcgtttttgcttctttcaggctaagctgctccttttaattttacactccttaaagcagaggattttaatttgcagtgtagcagcagaatcataatgcttttttttttttaagtccgtttcaatgccctacccacctcaagactgattcagtgggagctgggtgatgggtgttaatgcaggtttgtttgaaaactgaagcatttgacagactagatctgactgtatctggcttctatatttcagaattttccaggacccatgttttggatcttttcttctttcctttttttttctttttgagatggagtttcactctcgtcacccaggctggagtgcagtggcatgatcttgactcactgtaactgtaaccaccgcctcccagattcaagtgattcttctgcctcagcctcccaagtagctggtattacagacatccgccaccatgcccggctaattttgtattgttggtagagatggggtttcaccatgttggccaggctggtctcgaactcctgacctcaggtgatccacccgccttggcctcccaaaatgctgggattacaggagtgagccaccacaccctgcctggacattttttttcaaatacctcttctctaatccctggcttttcttcgccaaatgtagcatcgccctctttgcaagtttgtggacagcattcatgtcccagtcttatcccagaatccaggaaagaatgtgtcagtgagtgctgtatctggaggtttgtcctaattgagggactcagccaagcctcgtgcagaaataacctttgagagtttgtgtcaaagtcacaactccacctgagcaaagtgtgaatacagcctagctggattgaaatacatgtcacacctaactgtactctgtgcatgtggttctgtgtgtggggatgcatggggtttagctgtgtttttgagtcacatgtttctaattgtcaaccctttctcagacggtatttctgcttcaggaggttatttgaatcatcttggctaagcagccttcaaataactctctctcaatttctgcatgtcaatttatgtcccacttccaaagactcagactgtgaatgacttctctccacagatagggtcaccttagccaggtgctcttttgtctttgtctttaagatccttggtgtgccacttattgattcagcagtggaatcatttttcttctaaaatgctgactggaagggccattttgttaatttagtgtgcctgcttttgtgctcaaatgagtagtttccataaaatgagaaacatggaatgatgaggcctggggcccaggactatccagtctctttgctgacttggtctcagaaagggggtggagtgcagagaagaatcttttcaaacttggataagaattgccatctttaatatgtgataccaccttgaaaattatattcagattttggcaggatgtggagagagaagagtgaaaaaaaaaatcagtgcctattccagaatcgcatattggagttatgtggcattttctgttttaaataaatgaattcagcacacatactgttaaagggatgtttgttttatctttcgaaaaggatcatgcatcatattaacttattcctggtgctgtacacatttgcacaaggactatattaaaaggaagagatttaaagaaagaatgccaatgcccccatggtctgtcccaggagttgggattcacaccagttctgttcattctactagttggctgtcccagggttggtttccttccccttcctctgctccccttgggaagaggaagaggaaggaagtgaggaagagagggaagtgagggcttacagctgaaaatcagcagagccaataaggtgggttccataaagcacaccctgttggaggagaatttctttttcctaaatggtctggtgtttcctggtcagacatctttgatctgggccggtttcagggccttctcctgattgactgaggaaaccctctcatggattctccctgctgttgcactgacattaatcattttttttagactcataatcatagtctacctggaatcagaagcagcccaaggaccgtgagcaacagagaaaaaggccaagttggctttatggaagtaaagtcagggaggcccgtggaaggcctgaaccccaagtgaaggaccttctctagctcctgcatttattatctttgtgaagagtattatccagatgtcagatgattagcatattttgctagtttctctgtgatgggaataatgaattctttctaaatttcctttaatttcaattagaggtgagtagagatatattaattatactcatgaaatctactgcctaccaggtcaaaaagtagataaggtccagggcgctgggaagatgccctgataactgagaaagagcaagctctgggaagggataagaccagcggatgaatctgaggatgcctacctgctaatcgccccatttaaaacttagtttttcagccagctgaaatgacccaccagtctacagtggcagacaagactggaccgccttattacccccacagtcctacattgctgggataagcagtctgtgcagaggaggggcccctgtatttgctgtggctcagggatacaggaaagggttttggtgaactgctgtgaaaatggaccacccccatgactagacatgacaagcatcctggccacattcacaggtggatacaaacaataaatgtcatgagactgtctccactaagtggatcagagtcacagtggatatttagttgacctgtgacttaacggccacagacctcttacagtgtacattatgtttattaatttgcatttttacctgccaggtagactgtacatttgcaaagaggtgttttgcttcagaaaaatgacttggataatttaacaaggtatatctttgatcttccaacagtgaattcaaaaaagaaaaaagtttcctgtattggtgtgtcataaaagtctttgttgcagagatttctctgctgttttgtttcccttggtagtgactgaatcttaattttctgtaatgggagcacttatttcatgtcctgaggatgaaaatccatgtttccatttcttgtgaattacagctgtttggttttatagcctgtgaatggccctgggcctctcttgccttgttctttgaggtccacgtttctgtttactcatggtccactgctgctaatctaagggtcgctgagaaggctttctatcccatattatgaacctacagcatgtcattccatcttacctctgagtcttaaggtctcttgatccttaaacaaccactgtagccaataacttagtgaacacaaacactgaatgcctggaagttcctgctgagtctggctccttgctgcatttccaggctcatggtgcgctgtgttcctttttcctttctttgctctggattccatgactttgttacaattatttgtgtatgctctgtttcctcctaccccggagccttggtacctacaaacactatttctccatctaaaaatctcatgctctagcagccctgcctttacctccaggccctcctttagtgcctctgttttatactacgaaatacactaccaaatcaccatgagcctctccctgatggtacttgctactcctgcatgtagctgtgtgcttattgattgagatctctctccactggcctgtgaactctgcaggaagagaccaggtctccccttgttcaattgatcaagcacagcatgttgtacttggtggcttcttaataaacatttgatgactcaatgaatgctgcaaggatattgggataaaatgtgtaccatgaggaaagggaaggagagtctttggtagcaaagatgtggggctaatataggcagacctcacttcacttagaccagaggacgttgtacctaatgggtgtccttggaggccccttccattgctgaggatagaatttgaattctcactatggtactggcccagggcagagcctgtcttactcaagcatgaaactcttgcctatttcatcaaattgttctaatgccaatctttccctcaccatgtttcctgtccttggagtaaattccaggccagggtctagcaagtgcttccccactgtatttacttgtcactttgcctgtcaggtttttggagtaatgtttgcatcacattttgtgcaagcttctcagatggccatgttacacttttcttctttgcccttttacttggccctcttcagttatttttttctcttcctccttccttctcattccccaggtgtatgctcaaggaaaatacagagataatagagtgtaaatggttaagaatggtgaatttcttggttccttagagaaatggccgattctaggttaggggcagaagatgaacaagatgagtctgtaacctcttgcttattgtgatagcaggaagctatcaactactgtatggggccttggtagcaagtctgaagagaagcggctcccactggccaaagatgggataaattaaatatccctccaccactccccaaaaaaacacacaaaaatcatcaacatttggaaacatataatatatgttacaacccatgctgagactaaaatgatgaagcagaaaagccattgatgatactaaaaaagaaaaagggtgtgggagatcctcattgatcaccttcggaccaatctttattttgaaaaccagtaaagaaatgaacggcagctaacatttatccaattttcttctacaagtggttcttcagctgacttaacagtgcaaaagaggaagcacttcttcgcagaaattggttatctaataaatgaagagagatgatgaaattaaaatatcactatgttgcagcttctgatgaattaatgaatctgggcattggtcgttgatgactaccatcatcgcaaggagactactactcatttgttggagggaagtaaaaaaacatcacgaatgaatagcaaataaataagtaaataccaaataaataaataaatatgtagtcaaatctgaatccaatcaaactgctcaatctcaccatcaattaaaatagagggacagaagaacatgttaaatgacacctcagaaatacagttagtaaaatctggattctggaatgctcttcatgaccaacaagttatttcttcaacaaaacttgtgagaaaaataatggagagggaactctagaataagagacttaagagatatctcaatcaatcacaatgagtagatcttaacatgaatcctcattcaaactgtgtaactgtgacaaagtgaaacgtggtttgtttttaaaatgtttacagatgaaataatatgatatctgggatgtgcttcacaataatctagatgagtatattagttatctgctgttgtggaacaaattacccctaaacttaatagctaaaacaggggtccccaacccacaggccacagatcaaataccatactggtctctggtctgttaggaaccaggctgcacagcaggaggtaagtagcgggtgagtgagcaagcattaccacctgagctctacctcagatcagccagcagcatcatttgattcttacaggagtgcaaaccttattgtgaactatgcatacaaggaatctaggttgtgtgccccttatgagaatctaagtaatgcctgatgatttgaggtggaacaatttcatccttcgccctgccccgctaccatcccgggctacctccccatacccctgtccttggacagattgtcttccgtgaaaccagtctctagtgccaaaaagattggggaccataggcttaaaacaacaaacatttattatctcatgtagttcctggactcaagaacccaggagtagcctgactgggttgttctggctcagggtctctagtgaggttgcattcaggatgtaggctgggggctggtcttccaagggctggctaggatggaagatccatgtctaagctaattcatatggctcttggaaagagacttcagttccctgacagctgttggttggaagcttcagtttcttactccatggcatctccccagggctgcttccagcaaagcagttggcttcctccagagggaggtatccaatagagatcagacgagcaactgtgatagaagccatagtgttacttacaacctaatcttgcaggtggcataccatcacttctatgacattctctttgttgcagacaccaacccctggtgtaatgtaagagggcccaacacaagggtctgcgtatcagtgggtgagaatcataggaggccattttggaggctggctgccaaaagggacgtcgatgtagatggtgtcaggatattgataaaacaagattggctgtgagttgatcattaaaattttctaatataaaaagtttctggcaaaaaaacttttttagagaccaaatgcttggatataagctccagctctaccatttattagctgtgagacctagtcaagtgatgtgaattcattctctcattcttaaaaggagggtaataagagtacctaccttctgtctggggattgctgtgaggattgaactcatgaggactcagggacaaggctggtgtgtagagggcacccagagaatattagttgatggtagcagtctcttctcttctgtctcgggcattctctttctgctgggcctgaaaacatccctggaccacctattttctagaaactcttttatctaacttttaagaagcatattgtgatatccctgggaaaagctaccattttttctttatctgatcttctcactacatgtatgtctgcccccacatgctgctgcagaggaaatgagtgcagtgagagcatgcatgtggaagtgcatgtgttttggcacacctttgctaccctggcctgcatcagtgtgtttttctagaatatggaccttgctactgccactaaaaggctgtacctcttctgagaagctgcttgtaagtcgactgttcttatctgtccagcacctctctctctcatcctttacatgaaatccctctgtccttagaaaacccatttggtgaagtcaggtaggactttccccatttctccccaccacaccctcaagttcagacgtggtgatgcgatccagacctgaataagtcagaggtcccattctctggccacctgattggctcaggcccagacacacatcctaagttggcctgatcagagtatttctggggacttttctgatagcaatattgctgaaactgctcttgggtaaagttgccagattttgcaaaacaaacaaacagggcactcaattttaaatatcagataacaaagaatacatttttattatattcattgttatgtatccaaaattcaaagttaattgggcatcctatatttatctggcaaccatagctcttgccagtgggcaggctgagctaggaggatgtgagaccactgatgtaggcagctgtgtgctcaagagcttgctgggggaatgaaaccaagtagagccaggagatacaatagagaagacagactgagccctgaggccaccactgggtcccctgtccctcccttcactgagacagctgcactcccagtcttctcgttctaggagccagtgactttcctttttctgtatgtagagtttgggttttttttttttttaattgttgttgtttgtttctagaatttcaacttggatactttcatagactaaaaatacagtgccataagggattgtaagccacaggtgccctactaataagatctagtgtttactgagtgcctactatatgctgaactctgtatgaagcactctgtctacattatcttattaagtcctcacagtcactctgcatggtataaatgaagaaattattgactcaattctttatcttccatgaggttgttataattatcttactacacatatgcactacaatgtgagtacaaagatgtttactatagtaatgttgaaaacataaaatactgaaaatttaaactttcactagtaggggactggtcaaagttcaaattgatgttgatacatacatatatatatatatatatatatgcacacacacacacacacacacacacacacacacacacagtgccttacagggtatttgtttattcacagactcaaataagaatggaagaaattcagacaattaagtttaatacccatatgtaattaagcttggcaaaatacagagatcattgaaacacattttaattgaatacaagttttataaaacgctacaaatcttccaagtgttcatacagaaaaagtccaaatttaggtgtccctggggtcacatttctttgctgagctttcccagaaatgaatgtagccaccactgcttggggaatatggctcctaacctgtgtcttagcacacgctgctcccccaatcctgggccatagctttgcattgagtgcaaagaactgtaggtgtgactgcgaggtgatggtttgatgcagacgagtgcgctggcacccacagcactggtcagcatcacattccccctgggtgttggctatcaatacgtacctcttctgagctgaggcatcctcagagctggcactgtgtttgtaatgaattgaaactgacttcagtctaccctggcacactgcagccactgaaagcattcttcctccaagaaacgcatttgaatcaagtcaagattttcatgaagttcataaaggatacatggagacctttggaaatttcagaaagacgtgaagggtgaggcctactgtgtacacacactgccatgccatgcagaaacacaacacaggcgtcctgtccatgcagcactgggcttcagcttttcccaggctttcaggggttcgcaaagcttagttccctgagatgcactgacaagtccacatgacctcacaagaaggacgatgagctcacataatacgtctcctcttggagctggccttgttcacaggcatggtaatcatcatgtccctccccctcagcagttacttggaaatgtgcactgcttaggtggaggggctgttccactttaggtatttcccaattgtagagaatcaccaattctgagctcatcaccatcatcctgcatgaaataattagtgcttttgccattgaaatgaggatgtagctaatctgactacctggatgaaataatgttcattgttcacatccaggagatctatcttttctctaatttggcactggcattaaacagctgctaccttcagacacatcaatttgttacacacacgtaaaggacaaacggggaatagctcagatgccattctatcagtgtctgtactgtctcccccaaattgcaaacagctgggcctgcctccttcctaccagctttcttcagccattctgttttcttctttgagaaataccatgtcactgcttcccacgggaattaaatgacagtctgatttacaggaacctaggcttggtggtagccatgtcacaagatatgtgccttacctacaagataatattggctctgcactgccctaacatccctgagagatttgccccaaagaggctgtaaaagtcagccaagggagttctcagactaaatgggaatatgagagactcatcccaggttgaggttagggttgggtgtgtgtgtgttgtcaggaggaattagatcaagaggaagtgtccagatttacatcagataatcttgtggtgtaatatccaaatcagcggggaggacaggtgtgggcaccctttgagcctctgaaaaatgggcttctgcactttgggtttggagcacagtagtagtgggaccacagaaccccatgagcttatctggaagtctcactgaggagttgggcatcagaatagggtggacatggctgttgggaccctgctcgtcatttaggctgataggagccacatctctgttttaggagaaagcaggcaatcctgtgtctgtttactgacagaactgaaaatgaaagaggctctacagaacactcttacctttaatgccttaattttaattttccagtgagctcgagctacctgacagccacagtgcaaagtgacctattaaagtgaagtccatttgaggatacctgcactgtagcagcacaccagaattctgtgctgcgtgtgaacagggcagcaaggagcagcagacaccatcttttgggtgtctcctctgctcacaggcatgctccattgctccactggatttcacgtacaaatcacagattcaaaaaatacaattataaagaatttcaggacagtggtaacaaagcattaaaccaaacactgagtccttctgaaaatgggactctgggccactgcatatgtcacatcccctggaaaccagccctgcacggaatcttagctttgcacacgaacctaagtctctgcacccacctgcatgctgtagtttatcagggacgtagagagctgggccctgggcgctgtgaaggggccctattgcacagggactcagcactttgaaacccactctgctgtcttgacctttctagtgtcctcggcctacatgtaaaataagaatgtaatagtacctttcttttaggggtgttaggaggatcaaacaaagtaatgtacaaaaagcacgtgatgcctagcatacagttgtcactttgccagtattggctgcccttggagggcttggtgacgtgacttctgaagccttcccatggtggagttgctgcaacaacctttgtccactcctaatgggtacgaaattcatgtctgcagtactcgaatgaccctgatgggtgtcattgatagatggctattagcctcccctccaaatagcggctgtactcccagccaggaccaccagctctcaagggcttgttttgtccgctgatgtccatttgacaccttgctcttaacaggaaggactcaaacatttattataattacatagacaggaaaaaaaacatgattgctgtgatcacagagagtcatcagtatgattcaactaaactgaatactggtgaaggagaggcttatttcaccaggatcctctgctggcctcaacgttgtggctgtttgtcagagataagcggatgtggccgtgctgctggcatttggcacagggagtggtggcgccagcgtgggctcatctccccaggcattaagctgcactaattgctttggaagcgaggctttttcctgggcagcagcatatgctgcgtgagtcgcttgaagcaaagataaagagccaccctcctcctttattgaggtttaataataaaatggaactgtcaccatttccaataaatggtttattttaattgagaaaaataatgagaactggccaccttttggtacacggctgttcagcgtctccctgacttgggcgatctggagccttctgttctgtagctgtgcccttgaggcactcgggtcctggggtcagtgaagtcagctacgtgtctctatccatttgagaaaacctggccctcgaaaggcaaaataattccttttccaaggtctattagattataaagttgcaacccaggaagtgggcatagaaagcgttggagatgtagtctgttttaattttcacatgttgaagacggtcctttcttttagtgaatatgaaatgaaagtctcacttttttttctgtcaccaaaattctttcagatgacttcttttttcgggtcccccagggagaagtcaacccagtaccaccaagtatcagagagaaatgaaggcacagataaggcagtgtcttactcaggcttgtagagagggcgaatgtcagaacaggaattggaaggaagtcctgcctgctgttctgaggcactgatgctctcactaccccacccactactcaggtgctttcccatcctcatttcacagcaggcaaaattgaagccagagaactaaagccacttgtctcaggggttcagttggtaaatggtataaccagcactggaactcagtctcctgacccccagttcagttttttgtttgtttgtttgttttgaaatggagtctcgctctttcgcccaggctggagtgcagtggtgcaatctcagctcactgcaagctctgcctcccgggttcacgccattcttctgcctcagcctcccgagtagctgggactacaggcgcccgccaccacgtctggctaattttttgtattgttagtagagatggggtttcaccatgttagccaggacggttgcgatctcctgacctcgtgatctgcctgccttggcctcccaaaatgctgggattacaggcatgagccactgcacctggccagtttttggttttttttttttttaaatcagagttcatagggcctgtataccaattgcctccacacaataacaatgatatgatggcattaaacataacaatttctggatcttacaacgaccacaactgggagtagagaaaaataaatctgtagtgatgcagaggatgcagggcagtcagccagccccttcctttgcttccagacactacccttggggtgtacatggttaggattgatcatcagcaaaatcacaaatcctccgtgccatgggtcgtcaaagcactggctgttaaagcctcgagcaccaaaagcctgctgtgtataaagtgctgtattcagtctagcacaggcgcggtaaaccgatcgcaccatacgatggctgtgattaagaaggggaggaggggcataggggagaagaggaagatcattttaatgcaggggaagctttcacgaggtatggtctccgcagccagggtcattggtttggttgtggtaatcataagggatcttttcaattaagtggcccacatcagctaaaactggttaagcagaggagcaaaggtattggttcacttacctaaaaggccaggcatgcccggatctaggggctcaagccttgttgtccccatcctgtcctggctcctccatgtgggctttgctctctgcggctgttaccttcattcaggtgtgcacctcccgtgcggtggcaggatgattgctggcagccctaggcttcctctcagcaatcctcatggaaagagagagtccttcctcccacgtgccagcagaagtccagggattggctcaatgcccgtgcacaactgtggcccttggggtggaattcatagactagacaggtctgataaatggtcccactccttaatctgggagggagggagagagacattagcttcactcaaatcatatgaattatgggttggtgggagaaggaaaatcagaagaaggggacttgatgctgggcaggcaaaactcacacatgtccctgggtccaggtcttagaccttcctctgactcaccattagtccatggcttgataggaaggaaggtccattttaacccctgtctctgggtcagtgctgtccagttgcacttcctgcaatgatggcgatgttcattaattggcagtgtccagtgcagtagccactagccacatgtggctaatgagcacttgaaatgaggttagcactactgaggaactgtatttttaatgttaggtaattttattaataattacatttaaatgtaaattctacatgtggctcaaggctacctaactggacagagcagctcttagtggaggacacatcatgggaggtagttccctgggagacaagagctggttttgtgtaggagagttgggcagagggctaaatgaagctccaaagaccaggagggtgatctgggtcagggtgtggaggaggagaagagggagttggacatgagagagagagaggagggagaaacaaacacagagagtcctttattggtggcatcatttgggagtccttaacttgagaagatagtttttctgtctaacatatggaccagatatgtaccaggaagaaacaaaatcacaactgaccttgttataaaagcgaattaaagggaactccataacatgttgttacatttgatctaaatgtccaactgtaaaaaagcaaccattgcctgaagtgccacatgagctacacagagatgaaaagaaaaattaaatgttgtgcaggttgtttaaaaaaatgctctgtaggctgggcccggtggctcatgcctgtaatcccagcactttgggaggctgaggcgggtggatcatgaggtcaggagatcgagaccatcctggctaacacggtgaaaccccgtctctattaaaaatacaaaaaattagccaggcgtggtggcgggcgcctgtagtcccagctactctggaggctgaggcaggagaatggcgtgaacccgggaggcggagcttctggtgagccgagatcgcacccactgcactccagcctgggcgacagagcgagactactccgtctcaagaaaaaaaagaaaaaaatgctgtgttaacatgtgtgactgagtgcaattaaggcatttggcagaaatgacatcaggcaaatagaatgaacttgtaaaggcagagtctggccacagctttgtgaatctagggctggttaatgaccagcctctcagtgagctgtgtgatgggtgtttcatcatgctccgtgtccctaggtgggtgcaggagggtgtggggaccaccatgtgttgacactttcagagcctaagtcctcatggtggtcacaagcctgatttccaccgggggtggttgttggtgaaggcagactcccttcctgcccaactacagctgggacgcctggcttccttggactcggttaattgcctggatttgttcaccaggcattcctggaggacctgccatgcacttggcatcctgatgggccttgagaactgggcagaaagaaaagagaggcacaaagcttggctcctggccctgagactgcctagttccctggccctcagcattcctctcccccatcactcaagccatttgatcatcccctgaagacttagctcccacccaggagcagagattaaagtgagcattctggagccagactgctcaggtatatgtcaagcccatggcaagtgcctggcatacaaggtgctcaaaaagaaaaaaaaatattattttgctaatttagagaaacaacaggtatatagcagaaagaagaagggcattagagtaggtgtagctgacctggattgaaacctgggccaggcaactaggtggtgtgtgtatttggacacagttctcagtctatctgtaaagtgggatgatggaacctcacatgattgtcatgaagactcagttgcactgtattttttaagggcctaacaccaggcaggcttcaataatggtggctgctctgatgggccagagggcaaggaaggttgctatgacagtggagcgggccagggaagagggtcttgtgggttgtatatgtgcccaaggtgagccaccagttttaaattcagcctcgattcatgttaggcccaggtgtcattcaaaggtttttaccatgaagaacccacccaaactttggcgttcacactggcaccatcttgccagcaaatcttctgcccagctcaatgactgggggctcctactgcttctgaggggacccaaggagaggcagagcagcatcttaaaacaatcagcatgccctaagatttgtctctacgatccattttgattccgtgatcattttgggggtcctaagcagtgtggccaattagacacatcatgaatgggtttcaccatctgagtgctgatggcatgcctggggcgttgttgggtgttagggcgtggtaagagaaagaaagccactccttagcaaggaaatcatgggtggatattttccatgagctcattcttcctgttcctctccctcctggtgactccccctgccagtttccccagcggacaaaagtggggatgcctttggggagaaaataatccatttcaatagaaaaagcaaggggagtctcacgataactgcgcaggcgcggaccagagagctcttttctgaggatccggcaagatggcagaagtagagcagaagaagcagaccttccgcaggttcacctaccgtggcgtggacctggaccagctgctggacatgtcctacaagcggctgatgccgctgtacagtgcgcgccagcagcggcggctgaaccggggcctgcggcggaagcagcactccctgctgaagtgcctgcgcaaggccaagaaggaggcgctgcccatggagaagccggaagtggtgaagacgcacctgcgtgacgtgatcatcctgcccgagatggtgggcagcatggtgggcgtctacaacggcaagaccttcaaccaggtggagatcaagcccgagatgatcgaccactacctgggcgagttctccatcacctacaagcccataaagcacggcgggcccggcatcggggccagccactcctcccgcttcatccctctcaagcagtggctcagctaataaaggcgcacatggttccagtcaaaaaaaaaaaaaaaaaaaaaaaaagaaagaaaaagaaaggggttcggaatgcagtgactggaaagcaaagcgaggccgtggtgccaccatgggtgtgggcttttgggtcactcatacatgcatgtgttcctggacatgcattgtgtgcactgacctgttcctgggcatgagcctgaattcgctcttgcccctttgttgggaagcagaaacgtgtggggtttcgcagttactttctttagtcccctttaatctctagctaatgctgagcttctgcagagccagaagggtcttagggcctactctggaagagcctcactcccattctccttattccctggagctcttctggatttctagcctgtgtctgtcttgttataatcacagttttcatgttgtgatccagtctttatccttgctccttagagctatctactgagccccttctgtgtgtattacgcatgtggtagacatgaagacagagtaatgccgtatcttaagaaatgtcacagtcttaggtggggacagagtttaattatgcagtgctcagtgaaaggtggatctgagtacctgatggcagcatggagtcacaaaggaagcattctaggctagtcttagaggctggtgctctgagaatacgtcatgcggtgggaagagggttatgcccatatgagatgtgaaaagtgggtgggagagggcgtggcaggagagccagggaatggattgagagtgggttcccagtggaggggtgcatatgcagagtcctaaatgtgatcaggagcgggagagtaggggtaggagaggaaaagagtcaccaatgatgaaacgggagaggaaagtggcaattttagatgaattaaatgcttttcaccagagttcaactgattttcttcctaaactgtaactgaagctaaaccatgaatattgaaggtaagttttacattgagtaagttcttatgttttgaatgtagaaggaaaaagtaaattatgaccggttggatctgacaatcattggtcttgccatggcgtacatctaattcattcaaggttggtgtttcacataacaggacagacactaatggattttctgctttgctgtttcagcacttcagggagcatctggacaaacttttcgccaaaggaattggaatgttggatatagctctgaatgaggccttcaacattctgagtgatgtaagttcctctttgatttgcctttctcatcccttggagaatagatgggtgttgttttagaaaattgtgggccaggctgggcgctgtggttcagacctttaatcccagccctttgggaggccgagatgggcggatcatgaggtcaggagatccagaccatcctggctaacacggtgaaaccccatctctactaaaaatacaaaaaattagccaggcatggtggcgggtgcctgtagtcccagctactcgggaggtggaggcaggagaatggtgttaacccgggaggtggagcttgaagtgagccgagattgtgcactccagcctgggtgacagagcgagactccgtctcaaaaaaaaatagaaaaagaaaaaaattgtgggccagctctggctgacactgagcagatctataggcatgggacgggagagtgagactggctggccatttaagtcatctagggaaccagatgccagccagtgaggtcaaaccagagcacagtggggaagagagaatgctagggaatgagaccatggaagcagcaggagccaaattgagtagcgtcatagagacactaatgagggctttgactgtggagtggaaagccattggagggtctaggcagagaactacatggtcttgaactcaacagcatttttctggctgctgtatttagaagcaaccctaggagggcaaggacaataacagggaggccattaagttatctgggtaagataatggtgacttggactagggagatagcagtgaagatgttaagaagcagaaaaataaaaaccactctaggtattttaaatagtaggagtttaattcgggcaattgatggcataagggatggaaaagctgagaaaccagagaatgaagcaatccacagattagcatcagcaggaggcatctcctctctagggcagggggtacaacaggcaggaggggtgacatcagcgccgagtcactgtggccattcagatgggccattcagaagtgtggaggaggctacccaagaagaactgtgactatggagggaaggacctgtcctgtggaagttggaactatggaggagacacagtcacggccagaaaatgcctatcccctgagagcgtagagaaattgcttagaaagaccttgattctttccttgcttcctttcccctttgtatgatccttgtcaaactgttggggagcttgagagctgtggtttgcaggaagaaggcatgggatagtctgagaacaaacaggcactaaatggagcaacatcatcttgaggtgtcaagcaggagctgggagaccagcagagactcccaaggccttgctgctgttggtctgcaggcagctctgtagggcaggctgttgtcattttgcaggtgagcaagcagaagcccaggcaggtgagtcattcactccacagttcataacttggattgtgggttagttacacctgactccaaaacttgactttttactactcagctatactggcctctcaagaaaggctaggccctaatttccagactctcttttaccaataatacctgttgccacgaagatgactgtttagatctcagtcctgagccagtgtcatgactgcagaggagaagagaaaaataaggagagaaggtgccaagtcaacttcctcagtacaaatccaaagccccggtcacctaatgagctccaaggggctgttggctacaggatgtaaacatttatgtaagagtccgtgttttggacagtacatctctgttgacagcaaagtaatagttttagtgacacagccggcgaggacagaggactaggctgctgggcaggtgccttcttagggcttgggtctctgcatctcagcaggctctttccaggtggtgatattgaaaagacctgttacagtttgaaaattccctctcgttttatctcaaaaacctagtggccagagcagggggagacttctctgagctgtggagtcccttgtttggaagtcttccctgcagtgaatttctctttccctgttctctggcctaagtggcgaaggagaaagggttaggagattgttgtatggttaagtctgtggcccctggagtaaggcagattggggctgagaagcctgactcagccagagtttacagggtttcttgttcacagttattgagaattttaaggtaatggtagcaaagccttgaaccaagtgcggagctttcttagtgtaatcttgtgcagctgtgcatgtcacacacccgtgaggtggtcctggtggtccctttctcgtggggttgagattcagcctgatgaggcaggacctggctccctttcagcagtgctgggctgggtgagaagtgccacctctgtgaccactgagaacccaggtctctagacacagctcccactacaaatgctttggttctctttgcccaagtcattaggagtgtctgctccccttcctctattttctgttcctttccctggtaccctttctctgtccatcccttccatctgtcacctttgttctcagaccctcctaagacactatttcccatagcatgcgcagtttaatgccggcctgccaaggtactcccacatgggggttgtggtcaaggtgaggagatgccatcctcctcttgcagactcacaaggtacttgcgcatatcaaaggccttgagaagtcctgcagtgaacaaacctttaaaaatgtgtttaaccacacttactaacccaggaacactttatatcataccatcatctccgtattagcatcttgtagaagttacagctcaccaaccacattttggggcataatattgtatgctccaagaaggtgtattcacactttcacagggcctactaagacccagagaaatcaccaacacatggtggacttttttatcctgaatctttgtgagggaagcatttttgaacaggaaaaccctccatacccctgtaaaaatacctctggagtctggtcagtcagataaccacatgagctgaatatagatcttggaaagcaaaaagccgaataaatgttttttaaaaaaacacaatgataggccaggcacggtggctcacacctgtaatcccagcactttgggagggcgaggtgggcggatcaccagaggtccggggttcgagaccagcctgaccaacatggtgaaatcccgtctctactaaaaatacagaaaaattagtcaggcatggtggtaggcgcctgtaatcccagctattcgggaggctgaggcaggagaatcgcttgaacccaggagggagaggatgcagtgagctgagattgcaccactgcacttcagcctgggtgacagagcgagactccatcaaacacacacacacacacacacacacacacacacaaagataaatgttacaaaatgtcccagcttgagattggttggcgattaacactatatttgtttgagtgcacatttatctcatagggagaaacatttcatatcatctattgccagtgagcttttaaatagctaaactctttgacaaacacagaggtggttaatctcccatgaaaatgaagctttgtctattaatattttctacttcatcaatatgacctttaagtgatattattatcttcctgtgtattatgcctgcctttacaagtcaatatgaaataaaaagttatttcttgaacacacacatatacacgcacacacacacgtgcttaaaattgtgatcgtggctggagcttagaatggttcagaggttactataattgaatggagtttattctgttttacagttacctgcatttcagttttggtatttgctcagatgacttaaaggcttgcagttcttgatacaaatggctttgaaaggagcattcaaataaacttctaagccccttcaagctcttgatctctgctgcattcattagattctgtaagaacacagagcaagtttgctacagtagttagcatctaccttgtcatgtgacaactgcaattatcatttttggcgatgaatgtgatctttgcagtgattaccttttaaaattttttcttagccaattaaataaaattcggtgacatttcaaagactgttaatcacaaccaaatgctctaaatgtcaggatgcattgaaaatttcactgctaactgatgaatcactgagctaattgtagttcatcatcaggcccttgtcattgttattattatggaaaacactttcatcactctcgctattcaataaagaaaagttttagacaaatatgaagagaaaagatattactcatcaaaccatttgaatttaattgcattcttcaaaattctacagctacagattgcagcagagaataccagggactcagccagagaagaaagtactgtttttaaataaacagctcctggcagctctttattctagtccacattattcagatatcttcttttttcctctctttctttccatgtgtttgggaaaatttttccaggatgttttcagatgagtttgtgaacaatggccctagagtattctgtttttttccccttgaagcttctgtgacctgaagcatagattacttttatgcattggcttgttgctgagtttattcaatggtgcgaagctgtgtttaatgcagtctccccagaacatctccagaacaacctgttgagaagaccagggtacaaggctgttttttcttctgcagtaaggacagagtcttagcagcttcccagagttggaaggacaatgtccagatatttattgagacttaagtttggttgaagatggaccctttaatgggagatgagggagggggcttggctaggatcaggtaagaatcctaatatttctgttgaggttggtgaacatagcaagggaaagattttgaggtcaggggttcagtcttagggtgtaaattgtcctttgatgctttctattgaagaattgatgggtctttcaagaagttcctggaataagcaatgaggttatttccgagtttgaccttcctgggcaagcattttctggaatagtaagttatattgataaagacagtagaatagtggtcgcgtggaaagctttgtggtgtgatagcggagtttccaggtgtttctacctactaacgtgacagtgtcaggggctgcgtctgctcattaactcagttgcacatgtgcagtcggagttgcaggagtggctgccagggccaggactaagatgaggaaagtgtctggggcaccacatgtaaggagcactcaccctcaggatcacagccctggtgactgccctgtgaccctgaaaccctaaaagggatggaggaagtagaggcaggaggaggagattaatacttttggagccctaccacctatccatttgcttactgatcttcctgaattactgaaaggccatattgtgtgctcaattggagagtagattctagagcttgatggtctggattcaaatcccagctatgtcagatagtagctgtgtgacctggggcaagttagctaatctctctgtgccttagtttcctacctgtaaaataaagataatgatagcgttggaagacttttccttagctcagctaaagacaggatcctcgtcacatggccacgaaagtttaggcttgcagaagtttgaagagtaagaaaaatcggatttattgggcaaaaagggaaaaaagggaaacaggtactagtcctgctagtacatgcttcttcccacctcacagattgaattccaggttcctcacaggaagaggagggaccaggctcctccccactgcaaacgacacaaacttctatggctccatcccagtgcacattcctcccagtgtacaggctggttggagttttgccaaggagtccttcccacctggctgtctcagtagtacctacctcagaggcctgtaaggattaagtaaattcgtattaatacacgtagcctggcatataacaaacattgaacatttaacctgtggtgtaccaaccacttaaggatgttattcttatcttgtctgtggaagaatgaaagctccggaaggaaacttatcccaggcacacagctgtgttgctgagatgacatcgagtgctttcccctatgccatggtaccccgtgcgtgattcgagttggctttgctgtgtctcagtatggccataaggcaattccattcatccatttatctatctatgcatctatccagttatgtatggtcttctctcaagttactgcaacttcagactccacatcagatgtctaagtgcctgaagactaggcattaatatctttaatttgaatgctttattacgtctctcattcaccagtggccagccagcaaagccaagagtagccaccatccctccccagtgtcatggttcaatagattgaacctgccaggcacactcccactcagtgcctttgcacttaacgtttgcccttcctggaatatctttccctcagatactcacatctctcaggtataactcaaatgtcaccttctcagtgaggtcttccctgactatggtttctagaattgccccctcccatttcttatccttctttgctttcttctttccccacccttaacatcaccattatcaaacatataacgtagtttacttatttaccttgtttttgtatgtcttccctttcatgcgcgtctgtgtgaagagaccaccaaacaggctttgtgtgagcaacaaggctgtttatttcacctgggtgcaggcgggctgagtcggaaaagagagtcagcgaagggagataagggtggggccgttttataggatttgggtaggtaaaggaaaattacagtcaaagggggtttgttctctggcgggtaggagcgggggtcgcaaggtgctcagtgggggtgctttttgagccaggatgagccaggaaaaggactttcacaaggtaatgtcatcagttaaggcaaggactggccatttacacttcttttgtggtggaatgtcatcagttaaggtggggcagggcatattcacttcttttgtgattctttagttacttcaggccatctgggcatatacatgcaggtcacaggggatgcaatggcttggcttgggctcagaggcctgacattcctgccttcttaataagaaaaataaaacaagatagtgttgaagtgttggggcggggaaaatttttgtggagtggtatggagagagagtggacgatgtttctcagggctgcttcaagcgggattaggggcggtgtgggaacctagagtcggagagattaagctgaaaggagatcttatggtaaggggtgatattgtggggttgttagaagaaacatttgttgtatagaatgattggtgatggcctggatacggttttgtatgaactgaaaaactaaatggaataagaaggagaaaaacaggtataaaaggtctaagaattgggaggacctagggcatctgattagagagtgcctaaggaaattcagcatagtcctgccagcaaagattatttatttacttcaagagttaagagtggcggtttggggatagcaccaggagatatcagctatgatggcttggagaaacagtgtaaaccggcagtgtaaacaagagcagggcatgtatgagtagttgagaatggaaaataggagtatgactagacagaaaatagtagggatgacaagtttttttgggggcacagtctaagttggtccggtgtctggaatgagactggggcctaataaaaaggagcatctatacaggagcttaaatgggctgtaccttgtagcattccgaggacaggcctgaattctgagaagggaaagtgataaaagtattgtccagtcctttttggtggctgagcttggtgaggtgtgtttttaaaagaccttcagtccattctacctttcttgaagatggaggactgtaagggatataaaggtttcactgaatactaagagcctgaaaaactgcttggctgatttgactaataaagactcatctgttatcagactgtattgaggtgggaaggctaaaatgaggaattatgtctgacagaacggaagaaatgactggtggccttctcagaccctgtaggaaacgcctttacttattcagtgaaagtgtctatttagactaagaggtattttagtttcctgactcgggcatgttaagtaaagctaatttgccagtcctgggtgggggcaaatccctgagcttgatgtgtagggaagggagggggcctgaataatccctgaggagtagtagaatagcagatggaacactgagaagttatttccttgaggatagatttccacgatggaaaggaaatgagaggttctgagaggcaggctagtggctagtactatagcatagcctgcctttgctggtatgtggcgattaggcctggtggaactaccatcaataaatcaagcgtgatcagggtgaggaacaggaaagaaggaaatatgggaaaatggggtgaatatcaggtggatcagagagacacagtcgtgggggtcaggtgtggtatcaagaataatgtgggaggccggattgaagtccgggccaggaacaatggtaattgtgggacttaacaaagagtgagtacagctgaaggagccagggagcagaaagcatatgcgtcaggtatgaggaagaaaatagattttggaagttatgagaaatgtagagagtgagttgagcatagtttgtgatttttagggcctctaaaagtattaaagcagcggcagcctctgcacgcagacatgagggctaggctaaaacagtaaggtcaagttgtttggacagaaaggctacagggtgtggtcctggctcttgtgtaagaattctgactgcactataaccatgcctaggaaggaaaggagttgttgttttgtaagggattgaggtttgggagattaatcggacacgatcagcagggaaagcacgtgtgtttttatgagaattatgccgagataggtaacagatgaggatgaaatttgggcttgactgaagtaatgggggctgtctgtgaagccttgtggcagtacagcccaggtaatttgctgagcctaatcagtgtcagggtgagtctaagtgaaagcaaagagaggctgggatgaagggtgcaaaggaatagtaaagaaagcatgtttgagttctagaacagactaatgggtagtagagggaggtattgaggataggagagtatacgggtttggcaccacggggtggataggcaaaacaatttggttgataaggcacagatcctgaactaacttgtaaggcttgtccggttttaggacaggtaaaatgggggaattgtaaggggagtttataggctttaaaaggccatgctgtagcagacgagtgataacaggctttaacctttttaaagtgtgctgcgggatgggatattggcgttgagtagggtaagggtgattaggttttaatgagatggtaaggggtgcatgatcggtcaccaaggagggagtagacgtatcttatacttgtgggttaaggtggggggatacaagaggaggacgcaaaggaggcttttgattgggaagaagggcggcaatgagatatagctgtagtccaggaatagtcagggaagcagacaatttagttaaagtgtctcagcctaataagggaactgggcaggtggggataactaaaaaggagtgctttaaagagtattgtctaagttggcaccagagttggggagttttaagaggtttagaagcctggctgtcaatactcacaacagttatggaggcaagggaaacagacccttgaaaagaaggtaatgtggagtgggtagcctccgtattgattaagaaggggacggacttaccctccactgtgagttacctaaagctcggcgtccatgatggtctgcggggcttctgaggcgatcaggcagcgtcagtcttcagccagtaagccaagaaggagtcagtcagagaaccttgggccagagttccaggagctctgggagtggctgccaggtgagttgaacagtccgattttcagtggggtcccacacagatgggacgcggcttaggaggaatcccgggctgcgggcgttccttggcccagtggccagatttccggcatgtgtagcaagttcctgggggaggaggttctggagaaacgtctggctgctacagttcaggcgtttggaagttcttgtgtgctggagatgtggctggggtttgtctcacagtggaggcaaggaattgcaacttttttctgttatttcacaccttgaaggtgaggttaattaagtcctgttgtggggtttgagggccagattccagtttttggagttttatttaatgtcgggagcagattgggtaataaaatgtatattgagaataagatggccttttgaccttttaggggctagggctgtaaagtgtcttagggttgctgccaaacgagccatgaactgggctagatttttatatttgatgaaaaagagcctaaacactatctgatttgggataaagaaaaaggagcattaaccttgactatgcgtttagctccagccacctttttaagaataaattgctgggcaggtcggggagggctagtcacggaatgaaactgtaagccggagcaggtgtgaggaggggaggtgataaaaagattatagggtggaggagcagaggctgaggaagaattgggacctagctcggcctggcaaggagcagcctggggaggaagggagaggtcagatgggtctgtagaaaaggaagattagaaagactcagtgacgcttggggttggtactgaggggacaggcgggagggaaagaaggaagatttgggacgagttgcactgggcacagagactaggaagggactgatgtgtaaaagaatgcctggacgtcaggcacctcacaccatttgcccattttacgccaagaattatttagatcttgtagggtggaaaaattgaaagtgccattttctggctatttggaactactgttgagtttgtattggggtcaagtggcattgcagaagaaaataagacgcttagattttaggtcaggtgagaattgaagagattttaagttcttaagaatacatgctaagggagaagaaaggaatggaaggtggaagcttgcccatagtgaaggaggcaagcccagagaaaagagtagagacacggagaaggggtgggggtttcttcccctccagaaaagcagagaaagggttggggcgcggaaataagggattggggcgcagagataagagattggggcgtggaaataagggattggggcacagagataagaggttggggcgtgaaaataagcgattggggggttcttgccccctaggaaagcgggacttgctgctaagggtgaaggagaaggggttgaggggtacttgcccctgccccagaaaagcgggacttgccgctaagggtgaaggagaaggggttgaggggtacttgcccctgccccaggaaagcgggacttgccgctaagggtgaaggaccaaggcaggcatccctgcgtggtctgaaacgtgaaatcagagaggcgtccctgcaatgattaaacaccaagggaagactgccttcccagtccgtgaccggcgccggagttttgggttcacggataaaacatgtctcttttgtctctaccagagaatgaaaggaattgaaattaagagaagggagagattgaagtgtggcgccaagattgaaaggagaaagaggttgagggatagtgagggaggttggagaacagagtaaaaagaggccgcttaccggatttgaaattggtgagatgtttcttgggctggttggtctgaggacctgaggtcgtaggtggatctttctcacggagcaaagagcaggaggacaggggattgatctcccaagggaggtcccccgatccgagtcacggcaccaaatttcatgcgcgtccgtgtgaagagaccaccaaacaggctttgtgtgagcaacgaggctgtttatttcacctgggtgcaggcgggctgagtccgaaaagagagtcagcgaagggagataagggtggggccgttttataggatttggttaggtaaaggaaaattacagtcaaagggggtttgttctctggcgggtaggagcggggggtcgcaaggtgctcagtgggggtgctttttgagccaggatgagccaggaaaaggactttcacaaggtaatgtcatcagttaaggcaaggactggccatttacacttcttttgtggtggaatgtcatcagttaaggtggggcagggcatattcacttcttttgtgattcttcagttacttcaggccatctgggcgtgtacgtgcatgtcataggggatgcgatggcttggcttgggctcagaggcctgacattcccaaagagaatacgaagctaagtgagggaagagatttttttatgtttcattcctagtgctgtgtgggcacttagcaaataattttagaacaaatgaatacactttgcagattttaatagagaaggtttttacttactgaaggttgaagattttgtatgtgtttcccatctcgcagcattgacatgtaattgtagggattttaaaggacatggtattactttcaattgcatcattaatagcattaattaagggaatttttcaccccgattccagggaaggacattctgctctggcaaccatattcagtcactctagctgcctaccactcacaaaggctgagagctgctaaaatcttacataaagctgaaagttgaagaagtctagggttttacataccagtgagcgcaatcttagaacttcagcatgccatacatgctaacgtataaactaatatgtaagtttacatgccaacaatataaatttgaaatgaacccttattaagaaaatacttgggcttctcaagtgaattgtcatgttactgactttctccctatatgcctaaaacctccttgattttattatatgctgcattctgtactcatcagatccacccgaactagcctcatttagattttgaaagagatattgtctctcaagtagcccattgtttgtataatgtgttcctaaaacatttctgtgccaactcctttgggcttatttcctaaaacacagtccatacctgaaggtaagagaggttgtgcaatcctagactcttccttcccacctcttgtgtattttttgaaatccccctgtgatctgtatttggatctattggaaaaaaaaaaaaaagccaagctcgatgaagtatttaaagatatttattctgagccaaatatgaatgactgtgtcctggggtgcagcctcaaggggtcctgagagcatatgcctaagttgtggtcatgttacagcttggttttatacatttaagggagactgaagttacaggcaaagacataatacatgtaaggtatacattggtttagcctggaaaggcaagacatttcaaagggataggggacacttacaggtcacaggtggattcaaagatttctgactggcagttggttgaaagaattaagctttgcatgaagagttgaagtcagcagaaagaaatccttgagttaagaggggtgtggaagccagggttttgttatgtagatgaagcctctaagtggcaggcttcagagagaatagatggcaaatatctcttttcagacctgaaaagatgtcaaagtcttagttgaatctctcctggattaggaaaagacctagaaagggaaggaaattctctagcgaatgcaaatatcccccacaggagaagactttatatgaccatttccaaataaataaatatattttggagtaaaataccttgatttccttcagggcctactatctgcctttcagtgctatgccagagtcaggttggaattttgtatattattgctacaaagagtctgttttgtcagtcttatgattgtggttttaacattagtgctgatcagttctcccaaaactccaaagggagggggtataaccaggtatgtctgacccttcccccacttcctggcatggcctgaagtactttttcagatttctttgggattcccttggccaacagtaaggtctgttcggttggttggagggcttagaattttatttttggcttaaagatccaatttgtcagagcaaatgtggtgatctgtgtggaaagactttttgtataggttgttttggtggtggacagtgtgctgtcattttaaaaggcttccttagtcccaggtctcatgtctctgatttttcactgatacacagaattctctgatatgtatactattttgaacttatttctttccctagttcaaccacacgggacaaggaagtatctgcagtcaggccatcatgctcataactgatggggcggtggacacctatgatacaatctttgcaaaatacaattggccagatcgaaaggtaagttgatgctgatcccgtctgtgcggtggactccttgagaatctttactgtaatctccagcttgtccatgagtaagtgcctcatgtagacttaatctcataatgatctgtggtttctcagccttgtgttttttggttgaccaaaactgaagaccggcttttcttgttttcaaaaaatgaaacttttggaggagagaagaaacttgtaaagacatagtggacgtattctgtgaaaagattcattgtgaagtgtgcttcatccatattgggttgtgcttttctttatttttatttgcccttgaggcagagctgcatgttgggcccagcatctatacaatggtgaaatcagtcatggtagccctgcaggcctctcctttacatattgtgtttgtatagttcctcccacggcccccattaccacccagaaacttctctctatctcccactgctgttcttcaccattgtcagaacttgtctgttctctattctgatcctgcctttgctttccacgttgacagttattaaccttttgaggccattgtgaggttattaattgactgatactaatatttttggtgtattctgagtgcctgaactcagaggtttctcaagctgttatcttgcctgagttccctggggagatctttaaaattatgtgtatcctaccccacccctccagcagcaaaatctctggggatgtggttcagtaatccatgtttttaacaagtttctcagtgggcaccagccagtagactgacaattggtggtcactgtctcacctaaatggtggaattttagcagggaaaagacatcaaagtgggtgctcttctgggggtatcacaaaggtgtttttctactgcatgtgccagtagtgttatcctgactgtctataggtacacgagtcagtccaggccaagtccttactgctttatctgttttgcatacttaatttctgggaattaaacacactggtaaaaagaaacgggagacaaatgacagctgtgtcctcaactctatctagggagcacatactctgaacatgagatgggaggtgtctttctatattcccttagtcactgttggtccacacctatcactgccatctcacctcaccaagtgtgagcctggtctttaagactacgtacattttgtgcaacatggtccccaaatgggtgccaactccttcccctgctatccagtcttgaaaagagccatcacctctgaagctggagaaaaagctggcggtgctgagctgactatgtgggattctgagatgtctcctgcccagaggatatccaggaataaatttgatcaaccataaacactgagttcagtccaacccttgaagtagatggaggttcactcttagacagggttatattagatgtcagcagtagttcatgtggtaacttccagagacaggtagaggccagaattagttcataataaacatacatgatgtgaaaggaggagactgcttgacacagttgcacctctgtagcacacggcccagtgctgagcgtctggcagggcctaatgcacagccctgccaggtggctgagtgactgagggtgctaagagggaggctccagtataagtaaacatgagtagggccatggacattttgcagccaaatagaatgttcacagatgtcatgacatctcaaatgatggtgaaggatattttgcattatttagagccatttataaaagcagaagaaagtgaaggggagttttaataagcagctctatgaacagcaagtgttttttcatgtgagtctcacatgttgtatcacatgaatctttcccacttggtgacattcaatgaatagcatttacccaagaatattgatatttaaatgccctgtccttacttgtagaggcataggatgagggctgcaaagtcctaattctccagacaaaacacaaatttcagtgtatctttccaaatgaatagtattcattttaggccagatgcgttcttggattaattgaaaccagaattctggaaatttcaacattacttaaagcagtttcatctacttatcaagtattatcaagcagaagtggattttctttctgtagcaaaagggtcttcttttatgattacaagttaactgcagtctttctttccctctgccctattctggagagttccacgacatttttatacatatacattctcttctttatgaacttccatgtgaaggtgcaggtaatcaactcgcataaaaaccgaatacgattcagcattgtgttaaagtgagatgatgagcaatgtctgagcagtcatctttctccattattttgaatgttagctattcagtagagagttgtgccatgttgtaattgacaatcttcaagattgtaaaaatgggaaatgggttcaggacagaaaaaaatgatctcaaggctggaatgtgattcccataaaacagtagttctcaaacttgagtgagcttcgggatcacccgagggcttgttcctctacaacttctgatgcagtagatctgagtgaggctgagagtttgcatttctaactagttcctgagtgctgcggaggctgctggtggggaaccacacttgtggaactactgccacaagaaatagcctgaagaatagggtttagatactctgcaggctttgccatattgctgccgtctattgacttttacaaggactcatttcctcagttgaattcactgcacaggtttgtgtttcttggttcatattctgtcttaaaaactgtcaattaccaatcaacattaaaagtcaagatatttgtattagtccattttcacactgctataaagaactgcctgagagtgggtaatttataaagaaaagaggtttaattgactcacaattgtgcatggctgggaggcctcaggaaacttacaatcatggcagaaggggaagcaggcacatcttacatggcggcaggtaagagagtgagtgaaggggaaagagcctcttatgaaaccattaaatctcatgagaactcattcactatcatgagaactgcatgggggagaccactcccataatccaatcacctcccaccaggtagctccctcaacatctggggattacaattcaagatgagatttgggtggggacacagagccaaaccatatcgttattctataaaattttagagttgtagtttctctcataataggttacacctggcagtttgggtccaacattcctatatgacaaggccgctgctggcgctgagcagcagctgtccccattaggcagcaaatgcatgcttcctttggacatgaccctcatcaccactcttcatttcctctcagcccacttcactcatatggtttccctcccacaggtgtggagttcctgaccactgctctaggggaacaggtacttgctgttccccagcctccggggatttgttcccttctcttaggtttgcccggagccttccctcttcttctccagccagaggccatttgtccttgcctgagccctaaactcaaaactccctaggaactgtcttaaggaagtatagctttgtgtccaatacaaatattgtttctggacctgtctttcatcttcattctttggtgagtccaagagagcaggttctctacttctgagcaatcctactgcctttcactatatcccatcctgccaagaagtgtggtgtagagggcctagggtacctgcctgagcccttccccctagtgtttatgtcctgtgtaatctctttaccttctgtgtgggcaggacctgtggcttgcttttaaccaatggaatctcgtataggtgaagggttttgtttcaagtcagttgatttttgagttaatcagaagggatatcctgggtgggcaggttttccttccttccttccttcctttcttccttccttccttccttccttccctccctccctccctccctccctccctccctccctccttccttgcttccttccttccttccttccttccttccttccttccttccttccttccttcctctctctctctcaatcttttaagttctgggatatatgtgcaggttgtgcaggttttttacataggtaaacatgtgccatggtggtttactgcacagatcattctgttacccaggtattaagcccagcatccattagctattcttcctgatgctctctcaccccacaaaggtgccccagtatgtgttgtttgcccccatgtgtccatgtgttctcatcatttaggtcccacttataagtgggaacatgtggtttggttttctgttcctgcattagtttgctgaggataatggcttccaactctaaccatgtccctccaaaggacatgatctttttcctttttatggctgcacagtggtatatgtggtatgtgtggtatatgtaccacattttctgtatccagtctatcactgatgggcatttaggtcaattccatgactttgctattgtaaatagtgctgcagtgaacatacacatgcatgttatctttataatagaatgatttatattcctttgggcatatacccagtaatgggattgctgggtcaaatggtatttctgcctctctagctccttgaggaataaccacacggtcttccacaatggttgaactaatttacactcctgggtgggccttatttaattgagaatcctggaaagagggactggaccctccacaagggcagagagactctccctgatggtgtgatgaagcctttatggccagaaactacaggcagccttgaatgtgagagtggcttccagctgacagccagaaaaaggctggaccctcagtcttacagcaaaaagaaatgaattctgccaacaatctaggtgagcttggaggcagattcttccccagtcaagcctgcagatgaaaacacagcccagttagcacctcgattgtagacttgtaggatcatgagcagaggacccagcttgtttgtgccccaactcctgacccacaaaaactgtgagataataataactgttctgttttaagccactacatttatgatcatttgttatgtagcagtagaaaactaacacaagaagcaaggagaagggagaaagggaaggaaattacttacctagcaatgctataaagcatccgcaagcctagtggcttaaaataacaataatttattatttcttgtgattctatgggttaactaggtggtggttctgtttcacatggtatcaggtggggtccctggtgaagctaggagcttgactgtctgcctcagttctcctctccatgggctttctctccacgtggtgtctcatcttccaaggcaaccctgtgtgtccactgtcctcagtacagtagcctggattaccttacagtgtagcagctgggttccaagaaagggaaagcagaaggaagttggggaacagaccagggggggcatttgtgagtgtcatttgtaaaagctgcctaccatccaacagggccttgctccaagcaactgcttaataaagcattttagagtgagttggaagaaggaatgcattattggtgattttaactgtgagcctatgaaggcagcatcatgattgcttatgcaatgtgtcccttgccagtatttcatttctgagagcagaaatgaggagctatttattcatttattggatgccatttacttttgcctaatatccattggttatgacttaacagcagctcttacacacttggaataaaatatgaactccaatatgagaggaactcattccaggacctgctcaggaaataaagctgcattcactttatgtagctgcttttccaagtgaactaaaaaaaaggaaaagtcatggaattatttatcattacctcccccttgttgcacaagacagagaagcaatggctggataggtaagaaaatgattagccaggttatttaaaggagaggttgacaaactgtggtccatgtgccaaatctggcccattgcctgcttttgcagcttatgagttacgaatgattttcacatttttaaatgttcaaagaaacagtatttcatggcatgagaacattatatagaattcaaatttcagtgtccacaagtaaggtattattttgacatagccacacccatttgtttactattgtctatggctgatggcagaattcagtagttgtgacaaagaccagatggcccgtgaagcctgaaaaatttactatcaagccctttaagaatatggtttcccaccactaatctaaaggaaccttttaaaaatttagaccaaccagcatattgctgaaagtcattgagataccctcagaatttcatggctctgctgaattcaacagaagatggtaatgacggtttttccctatttttccactgcttttttctacttgaatacatgattgtgttagtccattctgcgttagcataaaggaacacctgcggttgggtaatttataaagaaaagaggtgtatatggcacgtggatctgctggatgtacaagaaatatggtgccagcacctgctctgcttctgttgagggcctcatgctgtttccactaatggcagaaggtgaaggaggagcaggtatgtcacatggtgagagaggaggaggtaagagagagaaaaggggtagggccaggctgtttttagtgatcggctctcacatgaactattagaatgataactcagtcattaccatggggcagcaccaagccaatcatggaggatccaaccccatgacccaaacacctcccaccaggtcccacgtccaacattggtggtcaaattccaacatgagatttgtaggggcaaacatccaaactatatcagttacactagccagataataaatggtggagggctgggagacttgatgccgaatactccttttcatgctggagcttctcttaccaaaatgtttagcggccctttctccttttccctctctccttgcttcttcatcagtgctaccatcaagactgggatatcttacatggtaatggggttgcttagaggtagagtaggctgccaggctgcccagccttggcctggaatgttgaaatgtagggtctttataaatgctagacttgactgccccttgaacctggttttggtggtgacatggacacaggacagaatttcacagctttcaggtcactgtggtaacagggaacaaacaccctggagagaaattaggctccctctacagaggctcgggaaatcagagactccctatctcagtcagcttgcgctgctatgacaaaatatcaatgactgggtggcttataaacaacaggaatttattgctcacagtcctggaggctggaagtctgagatcagggtgccagcatggtacagttctttttgaggcccctcttttgggttgtaaactgctgccttctcttggtatcctcacctggcattgagtcaaatgaggaagcaagctctctcatgagtcttataaggacactaatcccattcatgagggctccacccttatgacctcatctaatcctaattacttcccaaaggccccaactcctaataccataacaatgcaggctaggatttcaacataagaatctttgggagacacattcagtccataacactgtctgttcctgtgggggcagagttgacctatccataaattaacaacccttattttgccttgtgttacactttagggagtgaggatttggcctgtaactgtcaaataacagagcccatcctaactgcttctactgtgggtaaaataatgacatactgcctaggtgtgcaggtggatggtgacccatctacacctgttagatgtcactgcatgaactgaccctcacctggttgtgttttgagccacagaagcagtactagaatgttctacttcgtcttcatttccctgaacctgaattttcctcagtgagctaatttttttttttagggtgatatttcaaacaattgtagggtagcttgtttttttgttttttgtttttgtttgtttgtttgagacggagtcttgctctgtcacccaggctggagtgcagtggtgtgatcttggctaactgcaacctccgcctcccgggttcaagtggttactcatgcctcagcctcccgagtagctaggattacagtcaggcaccaccacacctggctaattttctttatttttaaacagagtcttgctgtgttgcccaggctggagtgtagtggtgcatgttcttgactcactgcaacctccgcctcctgggttcaagtgattcttctgcctcagcctccccagtagctgggattacacgtgtgtgccaccacacccagctaatttttatattttttagtagagatgaggtttcaccatattagccaggctggtcttgaacttctgacgtcaagtgatccacctgcctcggcctcccaaagtgctacaattataggtgtgaactaccgtgccaggcctactttttgtattttttatagagctggggtttcaccttgttggccaggctggtttcgaactcctggcctcaagtgttctacctgcctcagtctcccaaagtgctgggattacaggcctgagccactgtgcctggccctcagtgagagaatgttttaaaccaatttcttataccccaatttataaaccaatactaatgatagctaattcctactgaatgctgagtgtcagagactgttctaaatgctccgtgtgtatctaattctcacagaaacctcatgagaagtatactatcgttatcccctttcacagttgaggaaactgaggcatgaagaggctacattcaggattccctgactagcatttggtggacctgaaatgaccactccagcactcaaatgctgagcctagacccttaaccaggatgcagacatcttgagaacaaaacaaggtaaaatgaccataggtcagaggaagagctgtccacactctatacattgtcatcgggacagtaagtccttttccttggcctcctgcccccaagtacaggagggtctgcagaatgtcaggaactcgttgatcttagattagaacccactggggctacagtcagagagcaggagaacagcaaattgtggggcctcaggatgaggctctctagatgtgattaaatgattttcctcttctaaaaggacaggagaacttcaagatgagtgcgatttccgtgctgtgtactgtgcgttttatcttcagttatctcgagaaaaaaaaaaaaaaaagcaaggatggtagctttgaggccatgtgagaggctcagggctgctggaggatccttggtagcctggtgaggactgcaaggagggcagaagcagctcttggtttgagggtaaagggatgcccttgatcatggaatggcttaggggacctggctcagggcacttttggaactctgttggaagtgactgtcctttgggctggtgtcacatgcatcttcgaggaggggctggcttggggattttgtgccccaagcctcccccgtgctataacttggaggataaagcctcaagccagccttgccccagtggcctccggggtgctgaaaggcttagctttaccgtggcgcctctgagggggttttgtaaagctcaggaatcccctcttctcctgatagttctgtggggcatgtgccattctgagggccagagttcctgagctgattcagggattattcttttaagaacccaacccttcactcatcttaagcaatttggaagggatgttttgttctttcttccccactaaactgcattgttctcttctctgactttaaaatcattttacaaagcattttctttgcctccctttgactggttgagaggagaagggatttgcccaactccacaggcaacttggaaaggcgttaagatcatactgtgcccagagaagcctcacaaaataaatgctccacccaccccctagcctccacacgaccgtcactctggctgtctgtattcttcatcccataggactggattaataagggatgttgaaggtggcaaacgttgctggcagcggaaaaaaagggaaggaggtagctgtcttagggtaatgcattcatgcaacaggtatttattgagggcccgctgtgtctcgcagtccattgtaatggagcccaggagtagggggctaagacacctccaatgagatcacatagagcagataacagatcacaggtaaccagcaaatgaaaagaccaaatcatttaatcataagtcttctgaacaagacaaacaagaacctgagacagagaatgggtaatggcagctctcctagacagggtggccaagacgagcctcttggaggagagcatgtgtgagggagaggagctgggtggggaaggcattcatggcagagggaacagtacttcagaagccctgggtaggaaaaggtggatgtgtatgaggagcaggaggaagtgcaggtggctggagcccagtggacatgggaacagggtgataggaaggctggcagcacaggcagcagccaacttctctgggcttcagtgggcacagtgagatgttgggatgtgatccaaggggttggtgaggagccatgggaggctttttttttttttttttgagaccgagtttcgctgtgtcacccgggctggagtgtagttgcgtaatcatggctcactgtaacctccgcctcctggattcaagtgattctcctgtctcagcctcccaagtagctgggatgataggcgcacaccaccacacccggctaatttttgtatttttagtagagatggggtttcatcatgttggtcaggctggtcttgaactcctgacctcaagtgatccacctgccttggtctcccaaagtgctgagattacaggcatgagccaccgtgccggacatatgggaggcttttgaatggagaggagtgaactgactgttttcagaagggctctctggcaactgtatagggaattgtcctaggagacatggacttgggctgcatgtaccgatggtattaactctcctcatcacacctgattaaaaagggtggggagtgtaggtagtagaccttttcacttctgtgaatgctccaagatgctcctatttctcactgctgtttcattccaggggtctcttgggtgctgacatttctctcttctctttttccctcctttcctctttctctttctttctccttccctggctgaagtcacatttggtccaaaagttttgagtgagtttgagtcattgctgtgtttcttcaagggtgataaatcctaaagctatctcaggaaaataggaacactcatttctcatggtcagtcaacagcatgacaggaaaaggcattttcagtcactggggtgagagctcacgcaggccctccctgcagctgaagggagagttgagatggttcattgtctctggtttaattacttctgctggtattagacatcttgtgactccagcaagaagaacatgacaagacaagttaggaacgaagccactgatgcacggctgctgccagccattgaaaaatcacttcatgtcaggggcccacgacagatgcatggtacttcccctgtggtggaaactgtggtttctcttcctgggtgtggcactggggccttgggctccatccaggtgctgcggacctcagaaagcaggtgggaggacagtgtacattctctccaggtgacctccaccatcctctagtaaatggctatctaggtagccactcttaagggaatcctctcctctgctggtgttggggaagagtcaaactgttaccttagttcactgtgtaatgcttagccccacccaatggggagcacttctagtagcattcttattttgcaggtgagagagctcagaggatttaagtcccttgccactgagcccacagcaatgaaactggaagtctccagtttcaacccatatccagctgtctccatatctactactcttaaattgtagcacattggagtcaccgaggggttggcagtggggggtcttgccaaaagtgattcgtgggctccattttctgcaggcagaaccccagaatctgtgttcataggtggctcatagatcatattttggggttttgagggggttagggtgccctccggggcttggcaaagagtgtttctgcaagccagagcatgtccagaagtgccactcagtgtggttgtattcccagtgaattggacaggaatcagggacaggcatctaccagttatttgaacagagagaatttaatgttaaaaattgcaaatctagtattgatgagatgaaaggacaaaagataactctaggttttcttggaagtagcaactgcaggcaacagccaccacctcaatagttcgtatgggaggaggggcagaggaaagaaagaggttactaaaatttagaagcttgggggagaagctctatcaggctgggacccggacctctggcaagggcatgccggcgggcaagtgctaaggtctctgagctcacaggagggtcctgtggggatgcgaatcagactttttaggagggagttctggggtctctgaaggagatgcaatgagactgattctgtgaatgctggcgagctaccacctaggttaatttactgctactggaatgagctgtccttgctggagtgaagaaaccctgctaggatgaaggcgttgggaatgagaatccaatgggaagcaaacaggaagatccctctccctcctccatggatgcaacatcctcctattgaccttattggccagaccaggcagaccctagccaggaatagctgacaaagcagaaacgtggtttgcagagccccagcgccagtcccaagctgggggcccagcctcacagagcccaatccaacgtgtgcttggtgctggacatgttagcttattggctggaatacccagtaatgactggaagcttgctgcatgaattctgtattatttgcaatctactgatatgtcaagttcttatttcctaggtttttatttctcttggactattgagtagggctcttgggggtgtgggtgggagcgcagtgctgcctaatggaaaaagggtagtgtctggatgctgacaactcaatttctccatctgtaaaatggggctaattatacatatctggcagtattattaagaattaaacaaaatgttgcgctcccaagctcagtgctgggcacacagcaggcacagtacacaatggctatatcattatcatcgttaccataattttcaaccactcgcattgttaaaatccgtctgctgtagttaaaacatagttgtactggatggatttggatgtgggaaatagaaagtgctcttttatcctgaatatggattaatcttgtgtgctgttgtggttgacttagaagaagattaaagtattctactgcatttccaaaacatacccaggtttttctttatcacctatttcacgaataaatatatgtgcattatccattttacctgaactcctggtatctatcaaaatatactgagaaatatttgaccagttggtatcattaattaatgataagtagtagctaatgttcatcaattcaaatgagatgagtttcaagaaacaagagcctgtctgtattagtgaaatataaaaaggaggtttgaaaagtagtgtcacttttatattatttgtccattttctagagtagtggtcaaggctcagactacctgggtgggtatctaggctttactgtttctgatctgagtgacttcaggcaagtgatttcctctccttgtgctgtggttccctcatttagaaaataggagacaagaaccatgtccccatcttgcagggttgtttttgggcagattagtagtgcccagtgtctactgagtccttgaggggaggcaagtgcacagtgaacattagcaatggagaagattatggtccatgggaccctggaccaggatcagcaggtgcctctgagtaggcatccttaggcagcctgtgctgctatgaacacagagaggatacagacttggcatggtagatttgggaatgtgtatggcctgatgattggttttcaaagcacttaattctccgaagtgaccttgcattattttcttatctcattcactcccttggcaaaactctcccagtaagtggttggatgggaagtctcccagcagcctgtttgtgagagaccatagactgtgaactggctgggaccccagtgaatggcggtcccctccaacagaggctgctggtctctggcagtcagaaactgcccagtggcatcccaggagagccagcctggctgagccccatcctgcctgtccatgaactcatcgggcgagctgtgcccactttcctgccatttcctttgtaggataggccaagaaggggagctgagcagcactgagaagagagcagggcagcctctcccagctaggaaaagtgcccagtgtgcagaaaattaggggcccacaggcctggcagccagctgtgcttccccactccctgacaccctgctacctgcacacaaggtgcaatcaaatcgcatgacttcccaattctcagatggatttgttttaccagaagcaggcaggcaccctggcctgttctccacacagcagcagagtaacccttcccccttccccagttagaattggtacacaaaaattgcacataattatacagttggtgcatgcggatgtatgtatatgctcatgttatgatcacagtttcatgcgcgtccgtgtgaagaaaccaccaaacaggctttgtgtgagcaacatggctgtttatttcacctgggtgcaggtgggctgagtccgaaaagagtcagccaagggagataggggtggggctgttttataggatttgggtaggtaaaggaaaaaggggggttgttctctggcgggcaggagtggggggtcacagggtactcagtgggggagcttttgagccaggatgagccaggagaaggaatttcacaagacaatgtcttcagttaaggcaggaataggccattttcacttttgtggtggaatgtcatcagttaaggcaggaacccgcggtctggatgtgtacgtgcaggtcacaggggatatgatggcttagcttgggctcagaggcctgacacacagcccaggtgataaacatatttatcacctccaaacatttccttgtgtcccttcttttttgttttgtttttgtgattagaacacttaacgtgagatctaatctcttaccaattttttgggtgcatagtaccatattgttaactataggcacaatgttatacagcagatcactggaactttctcatcttgtataacggtaactttatacacattcaacaacagctcccatgatctctctccctgccggcccctagtagccaccattttgttatctacttgtatacctctgactattttagatgccaggtagatgagaaattcatcacagtatttgtcctgtgactaacttatttcactttgcataatgtcttccaggtccatccatgttgtaaatggtaggatttccttctttccaaggctgggtaagattccattgtatgtatataaggtcaggtgcagtggctcacacctgtaatcccagcactttgggaggccgaggcaggtggatcatttgaggtcaggagtttgagaccagcctagccaacatggtgaaaccccgtctctactaaaaatacaaaaattagcctggcatggtggcacatgcctgtaatcccagctactcaggagactcaagcgggagactgggaggtggaagttgcaatgagctgagattgcaccactgctttcctgcctgagcaacagagtgagtgagactctgtctcaaaaaagaaaaaagaaattatattgtatgtgtacactacattttctttatccattcagttgccaatggacattgcattgtttccatatctgggctgttgtgaatagtgctgcagtgaacatgggtatacagataacctctttgagacagtgattttattttctttggacatataccaagaagtgggattgctggattatatggcagttttattttttaatgttttgaggaatctccatactgttttcataatggctgtaccaacttatatttcaccaacagggcacaagtgttcttcctttttctcatcaacacttgttatattttgtctttttggtaatagccatcctaacaggtgtcagatggtatctcattgtggttttgatttgcatttccctgatgatgaacaatgttgagcagctttccatttacctgttgaccatttgtatatcttctctggagaaatgcctattcaggttctttgcccatttttaaaatcaggttatttgtttgctatttttaggaatctcttatgttttggaaattaaacccgtatcagataaatggtttataaatgatttcttggagatgacaccagaagcataagcaacaaaaacaaaaaatagataaatgggactacaccaaactaagaagcttctgcacagcaacggatacaatcagcagagtaaagaggaaacctatgggatgggagaaagacactttgaaaactggaggcttctggtaccaaagatccccccaaacctccactcactccccgctcagtgcagagtttaagccaatgtcttggtgggagtcagcaaggcctggtgtgatgggtgcctgttccctgccttcctctcaactgctgccccctcatgccctctgcgcagcccactgttctcaggcatgcaagatacacaactactttggggtctttgtgcttcctgttccctctctctggggcactttgcccccagattgccacattgacttactctaacttccttcatgtcttttgcttaggtactactttttcaatgagctctatcctactagatttaaagttgtcccctgtcccctgatctccagctatcttagtcagtgcttttcttttactgatagcacctttcatcttgtaaaaaattagataaataacacaaggaagtaaatttttgttatgtcatctgctagaagcagaacactttgtgagctgggcactgcgtttgttttctccgaagtgcccagagtggtgcctggcacacagtgtgcgttcagggagcctttggcaggagggtgtgaatgcctgctgagcactttgctgcatttcctatgagcatcacttcattgatactcccagcacttttatgatacagatatttatagtatatcccttttgtaagtgagaaaactgagttgagagcaggttaagtaacttgactccaaagcccatacctttcacctgatccccagttcctcctcctcctctgaatctctgggggtagacagagatcatataagtctgcctacggcttccctgttgagcttccttgggaatgcagagagcatccagggacctggggagtgttgccaagaagcgtgtcctgaattttgaatggtgctggatgaactttcaggaaaactgccacggggacagagagagtgaccttggacaggaaaggctttcaggtggtagaatttccttgcaccttgaacatctttgtagtacgtaaagcagtggtgatgattgctgtcatttatctctgcggtgtttgtcttctttagtaaacaacaagatcagttcctgttttgttctcccccagagcttagtgcctggcacagtgctagatgcctaggtggtgctcagtaaacatttgtggaagaagatcagaacaagcagatttaggccaaagcatggtgtctgcatcctccctgcaaatccccaactgctttgtgtatttaatggcataggcagacaaaataatgacttaccctttgaagtcaatcctgacaacccaaagggaatgattcccaactcaaaacctgaccgtgagccttgcatctcctagtactgaatactttttccatgtcattgggtcctcatcagagaggagccttttggtttctttttttttttttctttttatttttttttatttttgagacagagtcttgctctgtcgcccaggctggagtgcagtggcaccatcttggctcactgcaagctccgcctcccaagttcaggccattcttctgcctcagcctcctgagtagctgggactacaggcgcccaccaccatgcccggctaattttttgtatttttagtagagacggggtttcaccgtattagccagggtggtctcgatctcctgaccttgtgatccacccgcctcggcctcccaaagtgctgggattacaggcgtgagccaccgcacccggctgctttctaagctaactttattggtagagaaatcacctttacacctcataaatgaagctccttcttcctgtagattttgggaaatcctgtattctcagtaggctggcccttacattctctcttcaaacatctggagataaaacctgaggctcccaatgccaaatggttttggccatcaacagattatctgccctacttaccttaccttaatcatttccataaaaatatgaagggaggagatttatagggcttagtgaacatgttccattactgcagcccagcacgccaggccctggctcctctcagacccttctctcggcccagagcctcccacaagagcctttgtgctccctccctcccaagatctccacgtgaaagtggagctcggttcattgtttgctcattcctaatgtaaaaatagattttgttctattctgctcactcctcggggattcctatctagaaaagaaaacagctgaggttggtgactgatgggcctctttgggggaggcttgtaagagctgcatgttaactgtccagagtgaatcctgctgcctgccgcttgccgagccttattgggaagcaaagaggcccatgtggaaatctgtgctggaatgcgaactgaaagtaagatgtcgagggaggattagccaaatggccaggaaggcttctgaggccccaccagaaccctggaacagatttccaaggtgcacttggatctggagagggtcagcctggctgggggacaagtgtctagagccttctaggtcaaagcctgaatttttagccctttcaacccttacttctatgaatcggaccctcaaagcccatggaaactttagggtttttaagatttggatcactttaattttgctttcagatgatgtgtttctatgcctcaatgggacagaaacaaaaactaacggttttagaatttcaaagaagactgttctggttcagaactccaaatgtctgtgtgagccaaggacatacttattgaaatgtgtttcgtctccacagaataattaccttaaccctcctaaagtactgactctttcccttcctcttgacttaggaaaggggctatatgctctcttcattaaacaaaactacaggtacattaaaaaaatccagagagagtcatcttaagctagggattgacagctggctcactaacatcaggaaaaaggggtggggtgcagatgctggggtgtggatctctgcttccacctcttgtaagcagaacacttaaagattcccagtttcctcttgctgcaatagattcaccagaggtggtaaaaggctgacttagcagtctctccaggctctcaagaaaatcccagaggaacagccctatggttcacacagacatctcagggatgtgtgtatgtgtgtgtgtgtgtgtgtgtgtgtgtgtgtgtgtgtgtgtgtgttaaaaagataactccacatcttcagtgaaatatcccccctggatcaccacttcttttcctgctacaggctttcatagtacctgctgttaatattttccttaatgacaccatcttatagttaaaattagatattattttggggtttctctgtattaactctatgcatcataaattacataagggcagatatcatgttcctctgggtcaccagtggatgcccaatgctcagttcgttagcacatagtagctgcctgataggaagttccttctgtgtgtgcgtttgtgtgtatgtgtgtgtgttttttatagatggattggcgagggtgctgggagcctctatgctactgaggactgaacacaaagcatgtgcttgcagggtagaaataactcaaactttcatggatggagcctgacactccctggactcgcctacctgtgatccctggaaggctagccttgttgaccacaacaagggagagtctaaagtgactaatctattaggactagccacagtcctaatagattaaatactgtgcatggcattcagtccagcaggtttaggcaccaagtgcctgactttgaaggctgtgaagggtttaggaagacctcttggacaggaacagccaagaattccctgtttctctgctgttggtggccccgtccataggtcgtcctccagaggccctcaccttctccatatccaagcccctgcctcctccctcagcctcaggccagcaagtgcgtctgctgggcttgcctcatggtctcaaggcaaggattttgctgcgcttgcttctctcctggattccagggctgttcaggtccacctggctggtgctgttggtggaaagtgtaagtgtacttagaagagtcaggaaagggaaatatcttctcagtgttaatgtggaagcggaaattcagtaggagtaaccaggagttagagtcttacatttgaaggtcagagaagctgagtttgatgaccaacttaggcttgtactatgtgatctcaaacaagccactgaatttctctgggcttctaatttgtaaaacagccttgctgatagtggctccttctcagttttgtgacaggaaccaaatgagcaatagcatgtggcaatatctttcggtccaggaaccaatgagggaaatgggataaaattattgaggagaaagaacaaggtgaatgagtcagaacacccgcaaaaagaccttgatgggacatgaggcctcagaatgtgaaagtgcttcagaagaaccctccagagctttctggaaggaaccctctctgtccttgctgcggctgatgttttcaatgacttagttgtagaatttatagccagaactgactagcctctctctagctgtgtgggaagatctgtggatgttggtgtctttgagccagagagggggtttggcttgttttagaggcagtgtggcacctcctgttgtcttcagcccttctggactccaggggcagtgtgagccgaggtgtccacccctcatgccttcatggccctgggcctctcagttatgtatgtgatgacttggccttccaggcaccaagactttgatcaacctgagtcaggaggtttgtgtgaaacccttcctggttttcttttttaaaacacaaatggggtctggaattgatcccagataagacatctgcctcttaatttcacttcagagaggcaggatgacaagaaaggcgatgaagacaactaaatgcatttatgatttatgccccctgtgataaatcagtggatgatttctccccaaaatgtggtcactgcctgactaactcataccagctgacacatctgtgagatgcaccagcagatgggggctgagccccttccttgccatgtgcacaccagtcctggaacccagcaccctgaggactggggcttggatgtgtgagagagggggtcatctgcatgcagtgtggaagatggccacttcactgccaccctctcctgcctgtgttttcccttcttgcgtcctgatggtgtagtcatgttcagcctgtccttggttcatctccagcattcctttctgcgctcgccttcatgtgtggtgagttagatttttccattccctaaaggtgatttgagcaggcccagttctcaccagagtccctcaaagcaagtgtggagagtggaaaatcacattaactctttcattaactccagctgtgctgagccgaatcggcgatggcaaagaggttgcatccccaagggccagcttcaggccttctggggtagctttctggaatgctatcttggataggctttttagggccagtctggccagtaaagggaccagtgagcataacctgccctgcacaacaaggccagtggtgtccccgtgccatgggtaaggccagtagtggcccttggacagtgggtttaccacccgtttccccaaggtctccttgtatcctggatgcttgaccttgcatttctgaactcagaaagccatatctacatgttccaaaatactctgtcatttgaaattttcagaaatctgttgaaccctattttggctgcttggcagctacacagcagctggattgcttactcctcaccgccacctccccctttcagcatcatctgaagctaatttatccaggagtaacttggtctttgtggggaaatgtcacattttattttataagttaactgcaaatgaaaccgcctggttgtacctctcattttcctcttgttgaaaaatgtctttgttccatcatatttttccctttcttttcacaaacttgagaaagtctttggcaggtgccaaggccatttcgtgggcctaagactgggtggtgagacctcctgtagatgggaaagggctgagcagggggactcagaggctggtgctttctctaggaagtaagcaaggttgcaggagctcagcaaggagggagcatggggcaaacccgtggctggaggtggaggctctggctgtgtgttggtacatatggggctttagctggaacccctgactctgggaccagattgccctgctccatgcaggctatgtagagaaggaaaaatgagccagctagtaaaggttcatttgatgtctctgcttttcctttgtattaccattgttccagccagaaataatatacctgcagctgtgtttctgtaggacaatggggacatctaataatatatcgggctgacctaagctgccttttctccagcagtgccccaaggggaagatatatactccacctttatgttatccagtggtactaatcagaaaccattgctgtggaaacgacatgtcctgtttggttcctttctagcagggaatcgtaaaattaaaagggagcttgatagattccgcttaatgccaaaatgaaatcctgacatactttgctggatattacataattagttgacttctcaaaggagttctaattatgcctatggaataagctcaagataatgaaatgcattcatctctctggcaaagcggtctgtcgcatagcatggagtgccgagtcagtcctccagggttcgccttcttgctcaatgaacaaagctttatttacagccacagaacttggaaatgaaatacaaagttattttatagtgtacttattttttatttccattaagaaaatcagttttcctcagctccatatactactgtgtaaatgaccacatgtacagtaactgcactaatcccaaaacataaagatttctgctcctgaatgcattagacggctcataataccacaaaacctgccagagataggaagagactactgacaggggccaaagggaaagagttctttggccccaaattttatgaactgtaacattaatagtaagggttgtagcgatgggtgggtgggtacatggatgggtgagacagaggatggttatttttttttttttttttgagacagggtttgctctgccacccaggttccgccacccaggctggatttgcactgcacaatcatggctcactgcagcctcaacctctcaggttcaagcgatactcctacctcagcctcctgagtagctgagactacagggatgtgccaccatgcccagctaatttttttgtagggatggagtctcaccatgttgcccaggctgagaatgagtatttggatggatggatgaataatcagggaggggtatagatggaatagaactaactcagaaaaatctacctttagatatattatccagtatttgattgctagagaacatgatgaggaataagagggtttgcctcctaataattccttatttataaaagggaaactcaagaatcttttagtttctcaacagacaactttaaaaggtaacagcaaagagatgtaggaaaagttgacttggagggaaatagaagaaatgtcttcaaagatagtcatattctaacagcttaaaatataagataaaatacaaaataaaaatatattctttacaaatatgtcattggtgacctaacaaagttggaacaaagctctgcctaggtttctcttagcagtagattgttccctaacatgttagtgaatggaacccaagccaagaaggaaccattcagaatggcattcattggagcgttactgcctcagtttctatatttaaaaatgaagatgctctgtgtgcagagatctatccaatgccattgctgacatagtgataaagaaaagtcagggatgcctattagttttcttcctccaatataaggactcattaatctcctctgatgtctgcaggtaccaaagacattttttgctgtgaagtcacctcctctcccaacttgtcctttaaaatatatgtatagaaagaaaggccttaaaaggcgttaaaccacgtttttctaagacaaaagatcagtcttattttgtgacatgtgattcagggtgactgggggattacctggtagtacgaggggaacttggacctgtattgtcaacctcgcatggttggaagtactttgtgctatcaaattcctctgtctggctcgtcacctggggcagcagaatcctttcaagactctgcccaggtggatggctgctgaattctagtggaacatttgagggcagttctctggctctagcggtcgattttcctcctgtcagaagagccattcatgaactctgttgaccaaaaagttaattccttcatgtttttagcagaagcagctcattccagcttaaattcccaaagatcaggtcttctcatgttaattactcatctatattctggctggcacagtataactggtacatgaacactgttttaaaactctgctgattggatcatttatgagacattcatgtaaaaaggaccctaccttgaactattttttttcaaatataatgttggaaccctaggacctcaggattagaagaaaacaaagagtgaactgtatgaattggttttcaagactaacttatgacacctgcgggccagttttgttttgtgcatgttggatccataatctgtaaccaccctccaaggcagaggctggaaggaggtggcaagaagaaggtcagatgccatttgtagtggatgcatctgcttgccatggttagataaagaggttttcattttattcctgttccatcagagacaatatccctaccatcactcaagccagggtattgaaccttgaaaactgatgcattgcctgtcatcacacagaccactttctgctgagttaaagaaaagacacagtctagtttgttggaaaatggtgatgaatatttggaccagatattaaaagagtcaaaataaggtcaggtgccgtggctcacgcctgtaatcctagcattttgggaaactgagctaagggaattgcttgagcccaggacttcaagatcaacctgtgtaacatagggagacccagtccctaaaaataattttttttaaaaagccaggcatggtggtgcatgcctgttctcccagctacttgagaggctaaagcaggaggatcacctgagcctgggaggtcaaggctgcagtgagccgtaattacgtgactgcactccagcctgggcgacagaatgagacccccatctcaaaaaaaaaaaaaagtcaaaatagatatttttatattagaattttatatcaacatgaaatggcaagcagaattgagaaaaagaattttcttattccgaaattcagaaggctatttattataaccttgctgtgtttaagaaaaactattttaagagcaaatatcatcagtaggccttgggatacaagactaaaataaaaaagcaaatcctctgagcatgggagagaatgccttaaatattagtaagaagttagacctaattttaaaaattgggttaatcagacatacagtgccttgagttttttctcttttctccaccctgagtcattagtgtgtctgagagggaaaagacctgagccttcattctccatttgtacaataacatttaatcaagtgcaaacagccctgcagagttcaggagtgctgctggagctaggatgatgggtctaatactctagggaccaagaacaatgaagctgacatgtgggttcacctccgccattgttcaaggaagcatccgtggccttttgctgtgtttaattacagtggcaaaatctcagtcactgtttacacaggcttattgctcaggtgtggaaatgcactctaggctcacttttggcatttgctttgtatcggggagttcttagtctcttgaattaaaaatacattcatccattccttctggtgttacaaatgtaaatatcttcaccaaccctgcagggattgccgtagtggtagatgggtttgttacttcagccacttcacacaggagacagggaacctgtgggaaccagtcaattctgtggtttctgcaagtgttccttcaagatggcagtggtcatgcagcctggaaggccgtacagtgtccaggcatctagtctctgtcagggcttacctcaaatgtgggcttttcctgctccaaggcacaagtgccttctgtgagatagcatttttagatgctgttccacctcccacaaagttcctattactcagtggaacacatacaccttccagatttcaatagcctaggtcatgttcctttttcatgttttcacatgggattatattccttttcttcttggcatttatctctgattcttacattctcattagagatgtcttattgtttggctccttcctgaaactgtgaactccacaactgaagagtcagggctagcttcatgagcatgctactgtacagttaaacacggttccacattcagaagggccccatgcttggcttaatgctctgctattttcatcttgaaatccttaatacttttcacaatttcattttgcaaaccacatagtcagtcctgggttggggccatgtccatttctgttggatctccagcacatggtgtgtgctcaaggagcattgtgtaaaggaatgtttcagtgacaaaagatgatctcttttcatgagggcatgaagcataaaatctctaatacctaatatcgagtcaggatgtttcatattttcctggtggttcacaacttaatctcattgttttcataaagtttggcaaatgcagccaaaattgaattaaagagacttgtgtattatgatctaagaaaaagaattggttgcaaactgtaggaagtataaaagtggactggtctgttgttaattttttgttctatatttagaacctaaaggatgatgtttagagatcaaaaatgttaatcgtcttgcaaagagtgctagacactaatgagctggggcaaatactgcattagagaaagtatccttcagatgatagaggaagttgggacaatgactggggctctttaaaaaaaaaaacttttaattttatttttaaattttaatctatttatttgttttgagaccaggttatgagactggctaatttttacatttttggtagagatggggtttcactgtgttcccaggctggtcttgaactcctgggctcaagctatctaccctcctcagcctcccaaagtgctgggatgacaggcatgagccactgcacccatcctggtgactggggctcttctgaaatgcaaaatgtgttttccattgtattaattcaggaccaaggaaacactgaaacaacaaaatgtccagtttgatttccccatcatatagctggggaaaccttgctctcccccacaggaagcttggcgaaaattctgctgtagagttcatggaggaattgcaaggcttcacagttctgtgcagcatgcccatacgttttctgtcacttgtctgatttggacatacattttcctattctctcctgcccacccaaaaggtgactgccacagattgtgaagttggcaggattttccaggctgtgtcggcacaagctgttaataaattaggtgcacagacgtgtgctggcaaggcgtttcctcctggagttcataggccttccagaacatttatgtctcattacagcccatacagcagtttatgccctaataaatcagagaagctttgcggagatgggctggaccataatgaatctttctgttggcattttccctttacaggcgcaaataatggagcaaaaccgccccatctggccactctgtaagagagaactcacagtgggaagttgttttctcaagcatgacaaaaggtcatcccaggtagcaggagtgaggggaggcagctagggctgtgagtgacaaggtggaatgaagccatttatgagcctttatcactgcgattataggcattagctggactgtcagggtcctgttctttcttcctgtgataggtcttggtctttgctgatttttcacatttaattttcagacctgtttgttgtcttgcaaatagcacaagcagacacacaccctcagcctggggtgtggacctgcttactttgatttatgttttattaccttgatgagatgcattcctggctcactgggaatggctactgagcagagtgaagggaatctgcccatcaaccccagatcagcttctctctccctgccttccttcacccatgtgacggcatgtgagatgaaagccaagttaatatggaaattattattaataatctggtggtggacagaaatgtattttttgagctaggaaatcaacttgtctagtggaggtttaccagttgtaaacaaacaaacaaaaaacataaatcattttaaaaaccacacctagaaagaagcaaaaatttgtttttggtacttcacgcattttcacaagaaggcccatcctccattttggaagttaacatatattaatcatttcctttgtatctagtagctggggtctcatttcattggagaaaaatttggatctcattaagtcaaagaaactgtctgattgtttccctccatttccagtctagttggtctgtactcctaccctttgcagggctgaaggggagcttcagagacacctgggctgcttggttgtgctcacagagaggctcttgggagcctgtgagagtgtaatatatacagcaggacctatttctattctattctgtaaaggcttggctggtgcctcttcagtaatcactttgctgttgggaaggcagaggagaaagtaagtgagggagtacatgatttatcaaaagtgacaaggagaacagagctcctctatcagccctcagctaccctcctatttatataacacctttccttccagtgtttcccccagcagatggccaggtgaggttcgtggtctctgcacggaaatacagctgctccagggcaggaatgggggatcttttgggctctctcccagcagaattatgcaatagtccatggagggaggggacaaagtcattccctagctgaagcagccctggaaatgtagacttaaagccaagtgctgcttgcaaattgggaggttgccaagacctagcaccctaagactcaggggttaaagtaaaatcctggaggagttaagtaattgaccacaagtgggtctgcccccatctgcccctgcataatgagaaagtcagtgagacttgatggggtcacaaaagcacagcaatgtgttgactgagatgactgtgctctgccaagggaaagagtctgcccttcaaagggattctccaggtgtactctgaaagtttccccattgtcctgttttatcaagatccaagaaccaaaggaggtccttgtcctgcttgagatttttgctctggggttgagcatgtgagtatcaggagacctcatttggtacaggatgttgaacacacacagctgcttttttaaggtttccatttgcaactggttgagccgtaacaggtaattagcacctttgctgttggaccaagcggtgcttttattggttggagtttcttaattaggctggctgctttgcagttttggggaagagaatttagagggaaagcaggaatgctgtgtgtctcagaggatgaggccaagctgagaaaacagccagagggtctgagttcagtgccccagcccttcagtgccatattctaatcctaccctgcaagttctaacctcccgttggcctttttctgagatcatgggtagacctcagaaatggttcttgtatccacacttctctgaagtgtgctgatgaggactctggcctcattttaggggttgtttccagaatgaaaactaaagatgaaatggatttgttgggaatagtatgtgctattgtggacctgaacacgttggttgtttaactcagcatcacatctatggattagtcaggactgaggaaatgtcctgggagcaacttgtttggctttgccaagatgtcagctaaggcactttcaaattaggtgaccttgtgcaagacacataagggatctgtgcttcggctgtcccgtgtgtgagttaggaatggtcgtgttcactctctcctagagtggtcgcaaggattaaaggagatagtgcctgtaagcccatagcatggtggctggcacgagtaaatcctcaagagatgacagtgtgataccaatgacaacgattgtgatgatgataatgacgatgacattgttactttagaaacccagagtccaaacacgtggaagccagtttaggaatgacaagtaaatttactctcacatgccagcttctgttgatggggtgactgtgttttacaagattctgagactacacatgggcttagggagagagagctgaagtcctttagggatatttgtctttggagatggaatcaagggtgatgccacacatacttctgtctttaacagctgtgtaatctggggtaaattcacctctcttagagtctagttttaaaaatccatataatgggaaatttggaccacatcagttttcttggaagtattcagccaaatgttaaaaggtgtttggggtgggtgtagaaaagattatttgagtaggttttggaaatgctgtgtgtaacagaacaagttaaggcaggtttcttcattactggacttctcagcacctttagtgtgcttgaaaattccaagaggagaatatgtcattcttcccaaacttatctgatcaggaaaacatttgttttgcaaaacgcaactcatgagactagtgttgcacagaatggatttggagaaattacatgattttcaggatccatttttctctccaaattagtgaaatctgtaagtctcaaaaacttagatgagttaatgactgcactgcctcaccatgaacttttcacatgttatcaaaaatgaaactcctttcagggcacacttaaatgacaatcttttgttctttgaaataactttgaaaaatatcaaaggtaatatctggtaggacattaatccttaacatctataaaccatcctgaatctcagcttcaagtgcaaattatgctgatgggtttggcacaccctttggctaaaaagcttctttctcaatatttgaccttcctctctggactagggtgcagtgaggacctgtgaggtgaaaggcccttcactctctcctctccaccctggaatccagctgccccttcacctgccagcctgcctaagaggcagaagaaagcctcatgtgtctctagacttaaaccgccggcagctgtgtcttccatggctgatgaagcagagcaagggaggcagccagaatagcctaggaaatctccaggtttctgttgatttctcatttgtcattaatagtaatagataactttttactttgcatggcatttgtcagctgtcatccctgaaggctgttgaaactatttgggagcagtaataacactctagaataactttgggtaattgttctcttttagccagcaaaagctttgaagatgcttggaacataaatgtggtccccagggttcctttattctgctgatgatacagagcattattttttcaaaggggagccacagagcctgagcctcattcattcattcattcattcatccattcatttgtgagggagttaaagaggggagggtgttggaagttagagtgagtgagaaggggaaggaggatggaagtttgaggagagaaacaggtataattgttgccttaggagagttgggaagataattgagcagggaaaagtagaaggatgaccggcagtggggaggagcccctggagatttttaattataaatttaaagtgggactggccaacagggttgtgtgtttttctccagccatatttagctgcttgggtgcaggtacaaaggaagtagaaagttgggtttaaagggttggggttcaagttggttggaaggatagttaatagaattgagtgtagattcaaaaggagtgagccttggaatctgaggtgggtaaaaaggaagtgaggataagagagaggtggtagacagtggaggatcaactattttgaggtcccaacatatgggaagtgagctgatggtctgatagctgagttcagaaagttaagattttgtagggaatgcagtattgacaatgacaatgccttggctataaccatgggagtaggcagtagaagtcgggtagaagacaccattattgagagagatggtgttaaggagctcagaggctaggattttaatatcactaagaatgacaacaggaagagactagagagagccagtgagcccaatgctgaagtattcatgagtgattaggcagtcaggagacagcagcaacaagagggccatggttagtctagcctgacaaaaagcgcaccacaggatctgggctttttcagaggaggagggggacatttttggatttggcaatacctagcagagaagatactcccttgaatttacaggctgcatggtatgcagggtttgggagacagggccatcacttgataggaatggaggaagcagaattttccaaggacagacagacttggacagccagatggagcatgaaggtgaagatgaagttgagggtaggggtggaagatatggtggattttgctgatgctgaaccaggaatgacagaggacacacacaaggagtttgggacaacaaaggaacggctggacagaggcagtcatgtggggataaggatctaggtgttgagggctgacctgaagggcctgaccttttctgttgacagaggaaaaaagtggtgaaagcctctcctggcccctggggaaaggtggtcagtcagtcctcttcatcttctctccctgaagttcatggcttaggcagtgggcagggatgagtctaggactcatttctgcttagtacagtgctgaagtagagggaggagacgcagaggatgaaggccatcatgctgctgtgcattcctggggtgccactcatatttcagtcttgtaaatgcacctccatagttgtgcttgaggcaaactatgagtaaaaagtctcaacagtcaaagaagtttcggagatactgcttctagtgcacccctctgaagagtgacgaaagtaaaggctctgagagacctacaacaggcaggcctgttcagctttgtttgcctcagcatttcccaaacctgacctctccattcctgaacaccatcccttccaagatggtgtcctccacaccacttccaccgcctactcccatggttatatccttgtcttgggatcgttttgtcttccctaaaatccctttgatattctgcagaaatggccttctttgaaacatgcttgtgtaagtgctgggttttcatttcagtgcaatcacgagctgaccaccccttacttccctgagcctccagttcctcgtctttagtaacatcaaccacgcacagttgttgtgggaatcatgcattaacacaggtgaaagacctaacacgattcttggcttatagcaggccctcaataaatcttagcccctttcctcccctttcccagcagttccttatttatccagacattgaaactgaaatggcaaagtccatgttaaagggaccatgctctttacatataaacagagatgattgaaagaatggttttattgctagcttgtgtttacacctggtgggacctgtcttgtgtctctcccagcacttagcatggttcctgggtctcggtaagacctctgtaggctctgactaggtacctgggtactgttgcgttgttcaaaccctcctgttagacatttattgttgggttgtatgcaggggtgtgtgctgggcccctacctgttgggctgtgtagagggcagaagggttcagataaatgagccagagagatggcatctggaaaaatgcccttctgctgcatcttggtatccagatcattggaattgcccttcccataggctggcaggaatcccagtgagcagagactgaatccactttccctaaggagcactcctgaagttcgattagttggggaaggtcggaggtgcactgtcagctgcctgccaatgagaggggagagtggcttaattaaacctaaaaataaagttcgatttagattgctcttgtaggcagaggaaagatagattggccagggctaagaattttgaggccatctcccttgcatttaactttgaccccccaaaacaactgaggtaaaataaattttttggcaccaagtagggagtcagatgtccgtaatgcattagttctggttcagcacgttcagggagttggtaattagttacagccttttaaaaatctctctttaaactcaaatgatgtgtggcatttgagattcagaaaggagttgatatgtacgtgcccttgagcacaatctcctagtgtttaataaatagatatccctggaataaaacttacatgattaagtttacaagctttttttgtgccccccaaatatgtaactttacttgctaaatttaaaactgttgtaacagtacttggtaccatgagtcttatacccatttactagaaggtaacctcagctgccttattttatgcaagatagtctggttttggtagttctacaggaagagggaaaataaaaaggaaaggcagacctgagcatatgtgatatattctaagttttctccttttttcacataaatggcaagattgagttgatatttgaactaaggcaaaaattagctatcatcacctggacttataaatggtactcttcaataaaaagaacaggcctctatttaaagacagattgaagttctcttcaaataagcattgtgatttaacattcctttgaaagcaatgtattgattatggatatatagagtgagtagatgaaaatttgattaatgcttgaaacaattaaaacaatgatatttgaatagtttttgttttttttttggggggggggcaacgtacttactcgtctagtctctctcccaggaatatgttacaaatcatgttttattatcatgaaatattactatctttgccccagttgattcattatttgggtgggaacatagtcaagtctctgaaccaaagaggatattggaatcttgttgtagtgaccacaggagtaaagtttgattgattaagctgtgggaggaggagagagagtaattttagtcttaaaaatagatactcatcagagacaaagaaagggcaatagaccacagtatttaggagggaaagttgagttacctttagagtcctgagggacacatgtgtgatgagagagagaaatgaagcaagaggtgaaaaattcacagaacaaaaatgtcgattattttaaaaaggcacaaggaaaagacggagggagtggtagatgggtcttgtttttggagacttcttttgaatagaatgatctgaatctaaggggtctggaaaaagttccaggagcttagatccctgggaagggagggaatatctaggcagtaggtttgccctctattttagacagacctttctgtaataatttagcttgatgtttccaagagagaagtagtggtgtggttatggagaagttaaagtgccttctgcattaagagttggtgattgtatgatttgaggtctgctgtttacatagaagaagctgacaagaagagggactgcaaattgaagacaagagagagtttaataggaaagattgggcgtagaggaaatcctgaaattctaaccacacctgagggaaaagagcacaataaaaaagtagatgactggccgggcgcggtggctcacgcctgtaatcccagcattttgggaggccaaggagggcggatcatgaggtcaggagtttgaggccagcctggccaatatggtgacaccccatctctactaaaaatacaaaaattagccgggcatggtggtgcgcgcctgtagtcccagccacttgggaggctgaggcagaagaatcgcttgaagccgggaggtggaggttgtaatgagccgagatcgtgcaattgcatcccagcctgggtgacagagtgagactcggtctcaaaaaaaaaaaaaaaaaaaaaaaaaaaaagttgatgatcaagttaattaattgcataaacatttctttgtttggtaaaatttgcttttttctcaggtttaaaaattaaatgataatgaattaaagacaaaaacactggcgttatgattaggcaagtgtagcagtggtagctcaacgaacagtctgaattggaatcccaaggaattttgttttctataatgcaagatttcaaaattcaggaataggtttcttctttgtggagagtggcagaaggaaggattaaagaccctaacatttggtcagccaagaacacagaatccagaagatgggaaacatggttcaagacttacctgtcagccaggcagcccctctcttgccctttaagacccaaactcctctctgtctgagttcccttcctctgcggtcccattggtccttttccttagcctccttagggctcccttaggctccatactggaaggggacggtctttgtggcttttgaatgccctgggtgtaacagctgcaaaataattagctctttagggctgcaaagactagcctgctctaggcattttcttgggtattatatattcaaagaggctctgtctcttcccaagtctactcaaaagcatccttttcttatctcaccttagatagatgctagagcggttgagggaataggaagaagttcagggcctactgaggcagcgactgagcactccatatcctctctgtgtgcatcaatccctgggagagctggggcagcaaggggtccacacatggtcaagctgcttgcagttttccagattgtggtaggcctccattctttgtgcaatgtcatataccctctgcctgagatgaccccttatctctgtgtcacactcttactcatccttcacagctctgctcagaagtgcctttgtctctggcagttgctgacataggaaatagattcaggaccatgcagaccattctttgaaaacatgcttcgcagtgggttcaaggtcagcaaaatgtcagacttgatcagtgttgagtaggtgaatatggcgtccaaaggcaaaatcatttcttatttttaaataaaatggcagagctactgtgaatattttccatcatgaataaaattacctttttggcaattgccaaatttgcaaattaattcaaagtttgaaacttttaaaatgctgcagcaaatcgtttattgcttgaaccagtgtgatagatctgagtgaacatttttgttgctgttaatttaaattctaaaacctgtactttatgaaaaccagtaacagcggaaagagatacttttagttcttctttcctatatgaacaaaatataattccctcacacaaacaacttttgtaagggaggattgtagggcatggttgggggaggttggaactgtaaaatagcctccagattcattgagaagctaaaaaaaaaaaatggtttgctagggaaaaataatcaccagctatgtccctggatcaaatgtgtggatacttccaaagatatacattcacctaattgtggaaaaggagaagctgataatcttgctcagctcaacaacacttcctttttattctaaggttttgttctcttggctacccagatgtttctcatttttccagatgtgtttatatgtttgcaagtttctgaggctgtgctgatgaatggagtttttattgaatttttatgtagctttcagatagtaaaaatgtgcttaagcttcttcaacatggcccctacccccagcctgggtcttgcctgaggagacttcttattctgtctgggtatcctcagggtttccctggcctgtgtgtgcctccagatgctactataattaagatatttgcaaagaggaaaaatggcatttgtgaatgtagcaggaggatcatgagctgctggactcattgttgttggtcttctcctttgatgtaagaattgatcgaggagaggctgtcctccctgagtgctctcattgtgccatcctgtacagagacacatgtttactttcagattgcatttaagacctttggatgcttgggaggtttttcagggttatagctatgttgctgcattttgaaaatggagttataatcaataatgggtagaagtgaaagagcccttcctctgatccccagttattctccaggggtagactgagcactcactctgtgtgccaagtgcagggctggtcctggggctgacaaccgaggggagaggtagacacctttcttaagccatggaatgttgattctaagtgtgagaactctgttgttaagagagagaacatggctttttcattgattatctaatggcttttttccctaaaatctgatggctatatggagttcccatttttaaaattttcctctgtgttattatctaaggagagagagagagagagagacagagagagaagagagagaaagtagacaaaactctgacttgtgaccatatctctcaagtctattataccatgtcatcatggtatactgtgtcatgtatggatagaaagaatagtgagaccaggcacggtggctcacacctgtaatcccagcactttgggaggctgaggcaggcagatcatttgaggtcaggagttaaagaccagcctgaccaacatggtgaaaccccatctctactaaaaatacaaaaaaaaaaaaaaaaaaaaaaaaaaggccaggcatggtggcacatgcctgtagtcccagctacttgggaggctgagccaagaaaatcgctcaaacccaggaggcggaggttgtagtgggccaagatcgcattcactgcactccagcctgggcgacagagtgagactccatctcaaaaaaaaaaaaaaaagaatagtgaaaatattaaacagaggtggacatgatgacatataggggaagatagaaggttggatctgtggagaaaagtattttaacatttaaatgtctatgtgatgcaagttttttgtttttgctttctgaaacagagtctcgctttgtcacccaggctggtgtgatgcaatctcggctcactgcaacctctgcctcctggggtcaagtgattctcatgcctccacttcccaaggagctgagattgcaggcaggcatgcaccaccacacccagctaactttcttacttttagtagagatggggtttcgccaagttggccaggctggtttcaaacttttggcctcaagtgatccgcctgcctccacctctcaaagtgctgggattacaggcgttgagtcaccatgcccagcccctgatgcaagcttttaattggtgaacaacttaggttcagagaaaataagtgacctgcccaaaaacaaatatgggggggatttggaatttgaatcatgtgtgcgtgattgcaaagtgtgatgtttatactgcattctggctgcctccttttgtgtctcatttatgcaaaacagaacagcacacacacacacacacacacacacacacacaccacaaaaccctagtaatgtcatgataacaaaagtatttaaatataaatatgagaaggaaacagaggcataattatatgcagacttaaagttcttctttatgttgtatatcattagaacgttgagaatgaaatcaataaggaatagaattagcccgggcgtggtggctcacgcctgtaatcccagcactttgggaggtcaaggcgagtggatcatttgagccaggagtttgagaccagcctggccaacatgacgaaaccctgtctctactaaaaatataaaaattagccaggtatggtggtgcaggcctataatctcagctacttgggaggctgaggcacaagaatcgcttgagctgcagtgagctgagatggtgccactgcactccagcctgggtgacagagtaaaactctgactcaaaaaagaaaaaagaaattaataaggaatagaattaaagaattacaagttcaaaaagtgagtatagtgaatgccttcagaatggcctttaaatatactctattttataaatacatctggaaagctacatctggaaaggaagattaaaatctaatcttcccacaaggtcatcagtgtgattcccaagcagtaggcttgggctgagcactgcttggagagatcaagtggagacttggtgtgttcttaccatcccaccacccactgccttctctgaagtcgagtcagtcttgatgacgtctctgaagctgagctattaattttaacttctgagttgattaaattttatgacaaaacagcacagtgaaaataggaaaagcaaaaattggatcttggttatcttgcaaaagcaactagataaagattctcataaacaaaccaatatagattgtatcctcttccccttcattcacaccccctctacaaagtttctcactgacaggaataaaaaggaatgagatataactagaaattcacttctgaaatggaacactcagcatcacagtagtaatgaacttcataaatgccaccatccttctgcagcctcaagttactaggagagaacttgcctgagatggcagctccccacagatagaggtgtgagttctctctttccctaggtaagaggtcttggagctagcttctctgtatggactgccttgctatgtctggaaataaaaacacaaaaaccagatatacagacaaaaactttcaatgtgggcttggtcagcagtaggaagtagtgattacaagcatggatttggagttcaatgcaccagcatttgattccaggccttgctacttgttagccctgtgacagtggacaagctctccaggagtagtttctttgactataaaatggaaattaccaatacttaggtcaaaggtggcgagcattgaaataatgcatacaatacacacagcatggtacttggtgcagggaaagcgaccctccagtgttcactgtcatgcttccccttcttcctttcttaggagaactattgccatcaatactatgtttctcagggatgccttgtatcacaaactagatggcctaaaacaatagacatttattctctcacagttttggaagctagaagtctgaaatcaaggtgttgtcagggccgtggtctctctgaaaactctagagaagagtttgttccatgcattgctcctagcttctagtggttgctagtaacccttggtgttccttggattgtggcagcataactccaatccttgccccttctttcacgtggccatcttcctctgtgtgtctgtgcccaaatttccacctttttttttttttttttttttttttgagacggagtttcactcatgtagcccaagctggagtgcactggtgctatctcggctcactgcaacctctctcccccaggttcaagcgattctcctgcctcagcctcccgagtagcacacgccgcaaccatgcccggctaatttttgtatttttagtagagagatggtttcaccatgttggccaggcgggtcttgaactcctgacccatgtaatctgcccgtcttggcctcccaaagtgctgggattacagctgtaagccaccacgcctggccaaaatttccatctttttataaagacaccagtcatttgatcagggaccacctaacccaatacatcctcaacttgactgtatctgcgaagaccctgtttccaattaagcccacatttacaggtactggggattaggacctcaacatatctttttgggagacacaattcagccaacagcaaacaccacctttattttaggctggagggagccttggcttcattctggatcaagcacatcatctgaagttacctgttttgccagctgctgtgtcttctcctgagtggacactgcagacaatgctaacatttgcttattgattacttcactgggcttgttctgtcttattttcccttggtgcatttccccttggtgcagtttgaatagatagtgtagatatctgatcaaatggcaggagacactctgacctttcacatttcctgagaagcccaggagacagcgtacaaaattaaaaaccattattaaacgtttgtcatgttaaaaaaaaaatcccatgttaagaagttctcaagtgaacacaaattgtgagagcagcccagtgggtccagcaggtttagggttggctgggctggctggtgtgattctcagtcatataagaggagggtctacaaagtcgcctccctcttcaatctcgtttacataatgcatgcatcccactgcttggagtgcaggaaactgtggaaacatgtgtttaccttcaaattcagcaagacatgaaaaccctgactttgattaaatgtcaccttacaatctatcaactcctgcatgtgcgtcttggcagctgagacaaatatggaaaatgacgaggctccagagaacaaaagcctgtggggcatatttctgagggtggttcaacagccgaaaaatgcagagggatggacttcctgaggccagaaggtcatggactagctctgaaaatgagaatgaatgaaatcaacaacaagaaaaagaaaaaccgttcaattgaatgaatgaatcggaggtcctcaaagtttttctgcaaagtgccagatagtgttttaggctttacaggtgattgcagtctgtgttgcagttacttaagtctgctactgtagcattaaagcagtcatagacaacatgtaaatgaatgggcatagcagttttccaataaaactttatttgcaaaaactggcagtgggccagatttggcttgtgggctatagtttgccaatccctggagtgaatcagtcagtcaatctgattactttccttctgaatgcctttttctagaagctgtatattacagtgactaagaaacagatcctggggaaaatacacctgccttcaaatcctgctgttgctcttgactagcaatgtaatcttaacctccgttgtctcatctgggaaaataatataccacctataatgtgctcagcattgtggctgacatcgtccctacctagtaactgttcatggctagctattagtacagacaactgcaggaagacttcttgttcatagagaccacccctggtcattttgtgttttgggagttgttttctttggctatcacctgattccttcctccacctcatcaggtgaaaatcatcactcatctgtgctttcctactataatcattaacttatatacacatgtgcctccttgtagactgtggggtgctcatgggcaaggacaacccttatgcttctgtaccctattcctgcacctgccctgaaaggggatcagtaggtgtttgctgcattacatggcttttacagaaatacttttaccattgcagtttgaattgtctcgattctcatagcaggactgtgttaatacaaataatgaaatagagcaatctccctatctagctagaccatggtttgctaaaatacaatctgtgggccaagtctggcctgctgcctattgatataaataaagttttattggaacacagccatgcccattcatttacatattgtctgtggctgctttttcactatgtggctgagttgaatagttgcaacagagaccaaatggcgcacaaagcctaaaatatttagagataaagcttgctgacccctgaactaacaacctcttcaatagtactctgactagcacttgtcattaaactgcagatggttcagatttttgcaggaaggatataaatttgttagtctatctcaagattcatggtcaaaggttaaagtaatgttaagactgaatctacaaaacaacaggaggtaagagaaagaaaacaggtgtacgtttgaatgtcttcccaattcacagtgtagtaggttttagatactctataatttaggcttagtacatggctatgtttcccaaactgtgggccgaggtaccctttggtatgcagcaaaatcaccagggctctgcagaatattttacatttccaatgaaagcacagcttagcaacactatttgacatctcatgaattagtaatttcagtggattatgctttctccttttagtgatgtcatagctctgtgaagatggctttttggcaattgctgtgattaaaaaaacaagtattatggaaaaattaatgtggaataggaaatgagggttggtgtccagtctgatttcaaggctcgagaatttatgcctgatctatcaggtgtaaatatggttaagggtgatataaaatattgttagtttttcaaatgcctattgagttgtcagggcataactacttaataaaaagggctgttagacatttgttttgacccggagtcattgtaaatcaagaaaaatttggaagcttggatatatggtctctataggtggcatacctgagtgctaagaagaagcactcaaagtattctgttattcaaatcggatttttctttttctttttctttttttttttttgtttttttttttttttgtttttttgacactgggcctcaccctgtcacccaggctggagtgcaatggtgccatctcggctcactgcagcctccgcctcccaggttcaagtgattcttctgcctcagcctcccgagtagctgggattacaggcactcaccaccaagcctggctaatttttttttttttttttgtacctttaatggagacggggtttcaccatgttggccaggatggtctagactcctgacctcgtgatccgcctgccttggcctcccaatgtgccaggattataggcatgagccaccatgcccgggcaaatttttacttttcttgggacaaatttttctaagttttttttaaggaaataaaacttctagtagatagaaggggaaacaggaaattgatcttctgaaagctaggtggttgatatgcccaaaagttttgaaatagactatctaaaccaaaaggaatcacttgggttcagctatttcagtaaaggataattgaatacttattgcatgttggagacacaacactgaacagagaggcatgtgtttgcaggaatcatggaaagaatcattttgacatagcaacttggctttctaaacccttgtgagtcccatatctggctgaatttgattttcaaaggaggtatttagtgcagagctttgcaagctcctcttcctaataaatcacattggtgttagatatatgctgtcactagaacgactttattactgagaatgattcttctgcatacagacttcagacaggtaccctttgtctcaaagacaccttagccaacaggttttttttgttttgttttgtttttaaactcatgagtagaactctgtgaatctacttgtctttgcgtcgttattaaccagaatgttcttacttagtgatattatttccttctcccggttttattatctttcatgttgtataagcaacatcacatgttttattatttaaaagaatcacactggcctttaaaaacagaagaaaagaattagcaggtgaatagcaaacatgactctttgtccccaagagcatgaagctcttatttcttactttgtattaattggtcagatattcattttaaatgtcctgtgtctcccaaattacctactgatattagctcaaatagaagccatttgtatctataaggagtccctaatttatttccttctttttttccttgtctccatactcattttttatttgttacctttttcactttctctttttcctgtgccttttttcctatgaatgttatgaaggacaggaaggaaggataaagggagtgaaggaatgaatgaacaaatgaaggagggaaggaaaggagaagaaaggtagattattgagtgaggtttctattcgcatcctttctcctgcttggccgagtatactttacttctccaaaactcaatatttaggtctgcattatgatgacagtgaaatgggctctgaggacagttgtaaagagtgaatgaggtcatacacataaagcacatgacgtggttcctgacacagagaaagagctcaaaagccatagctgcaattattaatgttaataattgtaaggccgggtgtggtggctcatgcctgtaatccaagcagtttgggaggccaaggtgggcggatctcaaggtcaggggttcaagaccagcctgagcaacatggtgaaaccgcgtctctactaaaaatacaaaaattagctggacgtcccagctactcaggaggctgaggcaggagaatcgcttgaacccaggaggtggaggttgcagtgagctgaaattgcaccattgcgctccagcctgggagacagtgtgagactgtctcaaaaaaaaaaaaaaaaaaaaaaaaaaaaaaaagaatgaggttgtatacataaagcacatgacgtggttcctgacacagagaaagagttcaaaagccatagctgcaattattaatgctaataattgtagtgatggtcgctgaaaccagcagttcattttcagtgtttcttctgcttcacttagcagcagcatttaacacagtcgatctcgccctctccttgattttcttggctgccaggatactgaggcctgttggtttcattcctctcacgagcctcttctcagccttcttttggttcccgctcagttcttccagcctacatgctccaggcacagtgcttattgctactttctcctctatccacatttattcccagggatggtgtgatctggtccaggcccatttctttcaattccatctacatgttgacagcccccagatgtgtatctccaggacagacctctttcctgaagctcagacttgtgcatcaaattgcctccctgcatctctgcctggatgtctaatgggcatctcagacttctcttgtccaaagttcagctcctcaactacctccccaactggttcttccctcagccacccccagtgtgttcgagagcaaaaccctccttctcactgcacagatcagcagcttgaagtcatccttgaagactctttctctcttaaccctcaacaagtgaattagtcaatcctcgtggctctacctccagatatgccgactctgacacacacacacacacaccctacccactggtctggtcacatgaacactacactagcctcctaactagtctccctgcctctttgacaccccttcccctataatctgttttcagcacaacagccagagtgatttgtttaaaatgcatgttagctcatgtttctcctctgctcagtcctctggtggcttccattttctccaagtagaagctagttccttagaaaaaacccatgtctctttcctttcattcatgtgtctccagcctggacaacctccttacaactcctgagacaagcaggcactctcctgcctctacaactttgcactggttgtatcatctgcttgggacatttttccctagatatctgcacatccaactatctcatctcctttaagtctgcccacttgtcactttctctgtaacatctaccatgatgacccaccacgcccagccagtaatattaatttctattgatcttgtcatcagatttatttttctctcctctccactaactctagttctgtccattgactctggttctaaaactccaaatgcttctcaatttgcttaattttttttcccatagtaattttccttactactttcttacatactttataatttacttatttatagtgttcattgttcctctccaatagaccgtttgcacacagggatggggatctttgtagcttattcactgattaagtcctaaatactcataacagggcccagcacaaagtaaatattcaataaatatctgctgaatgaatcattatcatcatcatcatcattacttttatctcatttgtgtgaactgcttatttttacctatattttccatggagtatgttatctggctagtggtatttgtattgaatagctatggtttttgacagttaactagactaaatatccttttattctgggtggcctgtgatttgataacagaattgtatctgactgaagaaccagtatggatcctgcaatttgggagaatgttatttcacagatagaatttatttgttaaaatatgacaaataggttttgtgcagtttgattactttgttttcccttttcatttctcctgtgtctagaataagaagggaaaaccttacactcatgctagaaggatttaggctagtcttctgggaaagtcacctctgaggggtagtgcagcaaagccccactcaatcgagggctgtctttttaccctatgattgattattctattattctattttatggtggtgtgtggcctacaaatggcaaggaagtatgaagttttttggttgagcttttctctgattgtgtgtgcgtgtgtctgtgtgtgtttgaagatgcctttagaagatgttagctgtctactctaatggggttgggctttgtcagttcttaggagaagaggcctggttcccaacccgccagagccttctaccacccatgatggctcacccctgtgtgaaagaaaacgaagctacgctgcagagttttatgtgcctttgaacactcaggccatggaaatagcctttctcttggctaacagtgtggccctacattgcactgactcttctgctcccctccccaagatattctggtcaaatttcagcagcagccaggctctttgctaccaggggacttcccaatggctcgaagactccatacaaacagctgatatgtgtaatcaacaaaggaacatattgtggtgactcacttgcttagtttccagctgcacatccaggcaatattcagtcaatgaggagagaaagagaggggcagtgatggaagactgactgtatttaaatcacttgcctagaggaggttatcagaatgccaaaaaaaaggtgccgaaagtatattgccagcagacagcttagaaagaaaagtaattataatactctctaattcaaaatccttagtttattaacatgaaaatgagcaagtgctgaattccttcagaccccagtggcttggagaggagccagctctggggcctatgtgagtgaggatgtgttgctgtattttcctgtaggacagagtttttaatttatctattgtgtgcttagtaaaatgttcacatttgcagtatttcatttatttgtcttttcagcttcaggaaattaaagagaatgcagtggatgccttcaccaattgttctttatcttttaattttgactctgtgaatagccctcaagttgtcacaatgtcatttattacaaacagctgataactagttaaagtaattaataatattaatttctttcttcctttttttttgagacagagtctcacttgtccaggctggagtacagtggcgtgacctcggctcactgcaacctcgcctcctgggttctagcgattctcccacctcagcctcccgagtagctgggactacaggcatgcgccaccatgcccagctaatttttgtattcttagtagtgacagggtttcaccatgttggccaggttggtctcaaactcctgatctcaagtgatccacctgccttggcctcccaaagtgctgggattacaggcatgtgtgagccaccacgcccagccagtaatattaatttcttttgatccatcagacttgtttttctcttccctccactaagaattccttttaagtcatgccccttcaggtcaggagagcatttcagcagaatgccagcccacatcctctctccttagtccaccacatttctggatgctgtgcctgcagagggagcaggggaccatgaacttgtatgccagactcagggcctgggtgcccagctctgggctgacatgctccctgcttgcttttcttttctattcttttctttctttcttttgtgttcagactctggtgaccctcaggacactagctagaactgagcttccatttaagtctggatcctacgaaaatttcttagaaattcccaagcctcagctctctggacacaacccatcaaccagcaaaatggatccccacccagttacctgtatcaactcaccaaaaggcaggatgggctgtagaccagttacaggtttctttcattctgtgggtagatgtgtgtgtctctagcagcctttttggaaagaatgcttgtattctacagatgtctctgccttggcaattctgttcaactcaaaagtggtaatctatcatcctctgctgagaatttacccagcaagtgcctgaagaaaaaaagccatttagtttttgcttccacacatgaaatggctaactctttttaagtgaggcttggggatttaagagttggatatcagatacctggatttcatggaccagcaaaatgtaaaaaaaaaaccaccaccaccaccaccaccaacaacaaaaaagccccaaagttgtgtagtaacacaaagctgcaggttttaattttgctttgtcaatatgttaagaaaaccaaaacagaacaactggtatttattatctcatcatctcatagaaaaatgggcatcttaacactaaaatgtgggaaggtcattataggaataaaggataatcctttcagtgaaatacagtcatgctctgcataacgatgttccaatcaacaatgaaccgcatattcttatgcggtttttccataagattataatgaagctaaaatattccagccacctaggctgcagccatcctgacatgttagtgcaacacattactcacgtgtttgtggtgatgctggtgtaaacaaggctggcatcaacagtcatataaaagtatagcacacacaattatgtacagtacaaaatacttgatgataactatgttactggtttatgtactgtactatacttttatcattattttagagtgtactccatctacttattgaaaagaaaatttagctgtaacacagcctcaggcaggtccttcaggaggtgtccagaagaaggcattgctatcataggagatgacagctccatgcctgttattgcccctgaagaccttccagtgggacaagaggtggaggtagaagatggggatattgataatcctgaccctgtgtaggtctaggctaatgtgggtgtttgtgtcttcgtttttaacaaaaaagtttaaaaagtaaaataaaaaaattaaaaattttaaaagtagaaaaaagctaataaagatataaagaaaatatttttgtacagctgtacgatgtgtttatattttaagtcatgttactacagaagaatcaaaaggttaaaaaaattaaaagtttataaaagtcacagttagcttagatatttattattgaagaaatacattttaaaaaataaatttagtgtagcctaagtgtatagtgcttctaaagtgtacaggaatatcctaggccttcacattcactcaccgcttactcactaactcacctagggcaacttccagtcctgcaagctccattcatggtgagtgccctatacaggagttccatttttaatcttctataccatactttccgatatcttttctatgtttaggtatgtttagataaataaatacttaccattgtgttacagttgcctacagtattcagtagtcacatgctgtacaggtttgcagcctaggaacactgggctgtcccatatagccttggtgtgtagtaggctatgctatgtacacactctaggtgtgtgtaaatacactctatggtgttcacacaacaaccaaatcttgtaataacacatttttttagaacatagtatccctgttattaaatgacacacaaatatacttataactttatagaaaatactatacacactgattttcctcattttgccttggactggtgaaggtatgctgtcctagatgggctgctctgctattgacatttggtggcctcaggaacagttaacaggaagattcagtccacccactgctcaaatcctgtgacaagacagttggtggatgctttgcattcaacatactcaaaataccaaaacttgaattctcaagtagctcttttgaaaaagtgcctgaggtattgctagctgtatttgggttccttccctgtaagagggtccacatgcttaccccctcctctgttttcattcccttttcttcttttgtgtcttctgatacctttgttatattctttttattctgagaaataatagaaaaatataaggagaaaaataaggttttccagtgaatgcatctcatagggaatgcatagttaaaatcccaatgtagtaatttctagccttttttctataaacgcttttcacaaagtgaggatcattctacataactttttatcttgagccttcttccctatcatgtcattaccactttgtcatgtcataaaatattttttttttgagatggagttttgctcttgtcacccaggctggagtgcaatggcacagtctcggctcactgcaacctctgcctcctggattcaagtgattctcctgcctcagcctcctgagtagctgggattacaggtgcccaccaccatgcgcagctaatttttgtatttttagtagagatggggttttaccatgttggccaggctggtcttgaactcctgacctcaggcgatccacctgctacagcctcccaaagtactggtattagaggcatgagccaccacacctggctgaaaatattttatgaaaacttgatttcagtgactgaacagtattcaagtttagttttttttttctgtttcttgttgctttttttttttaaaccatcatctttgtgcatatcacaagttgtttctaggatgcatacatacaaatgcatgagtggttccaaggttacgagtattttaaagctatggatacctgtttgcaaatggccctcaaggagagttctattaatgcacatccccaccagcaatgtaccagtgctctcttccccttacctgctagttgttgctagagatgaacttttaaaaaaccttagccaacatgataacagaataaatgcaacctcttcttaatttgcaattctttcattaccaataagattttatagtcattcatattttcttctctgtgaatgactcaagacttttgcctccacttttgttttaaattgaagagtacatccttctccttattgatttgcaagaagtcttttcatagatggatattaacttttgtcattgttcacaaataattttctctgttatttgccttctgatttttatggtggttttgccatgtcaaagtttaaaaatgttgtgaagtcagatgatcagatattcttttcttggcttttgcgttgactactgttcctgaaaaggccttggttttcttattttcccttctttctacatcttattctcatctgtctcttcacttgtctcccccagtgtggtcctagagactgggagagaggtgggaggcatggccagggtcggggagtgggttgtgttcctgtctggcttctagtaactccaccattatattcagagaaaaatcttcttagtagtttccattatagttgccatcagttgtaacttcacaaataattgctggtgttatttggaccagtgactccctaggttagcagattggagagggctccctgcagccttcacgtttcatctcaagacggtgggctggaaggtccccccattccagcagcagtgatattctgcatggcagggcaggaggagtctgcttcctactacactgacattaggaaactattttcaaatgcctatgaggtccgatgctatttacaatgcatagaaatgagtttgacttctgtcatcagctgattttgtaattcactttgtttgcttttccttgtcataggatgtttccttagaagagggttttttttctcttgttcaggatgtggttatcagcagaggggtgtgtggtcagggaatgtggtggtagcgagtacacagaggaaagaatggcacagttccactgtcccccactcacctttcttcttgtgtgtggtcggtggctgtatgtgcacctaccatcatcacattacttagcaaacccagttgtcctgtggttccacttcatggaagaccctattctctgctctagcactgaaccctccagaagacattttaaagaatgctaaaatggggctaagctcataaattagccagcagtattatgttaaaaatcatccttgcttacttcccattgtctcttgactcttacaagtccaagagtatgcagagttttttgtttggggaacccagtagtgagaagcagtgtttttgatcctgttgtttgtttacaagatttgggggtccctagctttagtgctctggagctctcttaaaaaaatcagattcttggccagacgctgtgactcacgcctgtaatcccagcactttgggaggccgaggcaggtggatcacttgagctcaggagttcaagaccagcccaggcaacatggcaaaaccctgtgtctaccaaaaatacaaaacattagccaggcatggtggtgcatgcttgtggtcccagctactcaggaggctaaggtaggaggatcacttgagcccaggcagcggaggttgcagtgagctgcgattgcaccactgtactccaacctggatgacagagaccccatctcacaaaaacaagcaaacaaaaacatgagattcctggctctgtttctgaagtttctaactctgggtccagagtcagactcaggtatctgcatgttaacaagcacccaaggtgactcttatccacagtaaagtttgaggaccactgtcttagggaaccgccttcatttggctgaacgaactttagagcatcagcttttctaatcctacagtttccaaggacaagcagaaatccctatctgaccattttgatggaatcctcactcccaagaatacatgttcactgccctttctccacctcttttcctctctcctgtttcttctttccctctggctgcaaggtgccccacactcctgtggtctggaaggaatggagccatgtgcacacttaacttatttttcatgcattccagagagagggagttggagcaagagtgctataggcaagatacttctagttattttctaactaccttccatgcattcaaatcaccgattttaatggatgctaaagctactgctgggaagagggtaggagatggaaggaggaagaatcttggctaaatatcttgaagatggagcaattaatttagttttcccttagccagacattttttttttcttccagtctcatttcacttgtgggcatggtaatcttcactgttggcctgccattcattcttgtttttaaaatcatgcacaatatgttacgttagcaacactttgcacaaacagaaaataaggtttattgccgatatttttagctattgtcatttttgctgctctctctccttactttcatttaaaatgatgaactgcaaacaatccaaataatattttcaagctattttcagatcctggcgacaattgactactatgggtgctccccaggagactgcctgtcagtgtggaactaaagaacaacaatagcagatttgtaaccaaggggtagtctcaggaatgtgaatagcaaattagggggtgtaggtttggacatcagggactgggggatggttaacttattgacacacagggatgatgttgtttatttagaaagggagtcacagttcagttttcctttgaactttttcaaaagagctggcttccagacagagggaaatggaatacagctagagttgtctgttttcataaactttaaacttgctttgttgccagtcctgtttttaaaacttgccttaggaaaacataaggcgtgtttaatattctgctctgaatgatcttgatactcattttgatatgtttttggtccccattgattttgaaaacgctaaacaccacaaatacttgacattcggaagggcaagcgagggattaaaactcaatctctgcctcctgcttgacgtcatctttgaagagatgagaacgtacaagtaagcagaattcttatagttggaataaaacatgattagaacatttggagaaggagatgtgatatgactgagggaaatgtgaacaacatagaaataaacacatttgcctaacacttttcatatcttatgatgcattttataaattggtgcatgggcaatggcctgcctatgtatttatctcccaccctgtgtgttttccccaaatgtaaccatttatagacatacaaggacgtatgggagagcgagcaaaagcttgtacaaatcactaacaaccacgtgaatgcaggcggccctgcaaggacttcagagtggaattattgaaatcataggagacatttaggtaagaagggtgtaattaccgttattatttagtgattactggtgctgacagtgtgcttcattgaaaagacagaggaagaccctgaacctgctcagaagtcttaagacgaaaataagaccaaggcatcaagccatgacagaacccaagtcatagggagctggtggcatctggtttccagtttcaaaaactgttcctttggccccatgccagcctctctctgataggatgcttgggagacctagcaggcaagagagaatcaggaggaggaagaagactgcatgggatgctggaggagcaagggggaaggggctggaggtcagagggaggctcatctctccagtcccgggcatctgctgagctccttctttaatggggcagaagagtgtcccatgcttgtcatgattaagcaaagtctttccatcctttgggaaacagcctgcttccccccagtcactaacaagttgttcagaagccagcgtttccttcttgccccttctcctcttccctgtgacaatgtatgtctcactcttagttttacgtcctgctgccttgtgtttatgtcttatcttctccgtgagactagcagcattttaatataagggcacaccccatttattgttctatttctcagcagtgattcttctgaattgggacttttatcagactggattttggttccagcttgctgtgttcctttgggtgagtgatttaaccactctatgcctccgtttgtagcctatataaaatgaggatagtaatattgacttcatcctggctgccgtgagattaaatggaaagtacttaatatgtgctaaataatattaatttggcttttcctctatccctttgggcctcaccacacagtaagggtgcttactggacagtttatattcttactaaatgaataacccaaactatgccaacccaaacaaccatattaaccatgaggttaaatcgtgtgtttgtgtgggtgctgatgtgcttttaacctgtgcgtgacacaggtacacacaaggttgtccctcctgggtttccttagggagcagaatccactcctagcatttattatctacgtgcactacctagtcatagcccctggctaagaagaagctaacagattgacctagctattacaacgtgtaagtgatagatccagaatttgaattcaggacagtctataactcccagctcactttcaccttcacgactcatggaacatctcaagtgtttgctgggtgagtgctaagtaatcattctcatccaaatgtggcttttcccactgatactgatttctttgtttatttatgctctcctgtctattttcctcatattccagaggtgactgagctgcccaacatggtggccatcagccacttgtggccacttaaaattcacatttaatttaattaaaattaaaccaaattaaaaattcaattccttagttgcaccaaccaaatttcaagtgttttaataatcccattagctggtgacaaccatgtcagcacaaatatataatattttcatcattgaataaagttctgttggacattgtttctccagaggatgtttcaaataagtgacagtcaagatgccaagtttttatttttatttttaatatgtatggttatagccttagaattttataatttatgagacttgaatcaataaccagttggtagaagaatggtaaatagttatactataggaatattaagtttttatttagttgactttatcctatgcattgggctctatgcaaagtgctttccaggagttgcctcatgtaattgtcatggcagccctgtgagacaggagctatcactagtccctttgtatagggctggaaaactacttgcccaagtctcaaaactgttcagtgaaaaaacgaagacctaacaccaattcattagactccagagctataggcttagccattgaaccacctccctctgagagtcccagcatattctcaaaaagtaagagccatcagtaattattctaaaagcacaggctgcagaattctctgttctaaatttaaatggaactgggccatattggatgaaagaaatcaggttcttttcatgagtgcttgtcaagtgcctctgattcctaaaagaaaccaatttggccactgatctgaagtttctttctaggctttacaagtcatctctaatcctataatttgtctttatttctaccaactaagatgtgtgcactccaccaaaaaagatcatctaatgtttgaaagtggatcagaagcaaattatatgagaaactggtttgtgtcattaaagctttgaaaactagtgatcttaatgaaagtaaaatcaaccctaccatgtacaggaagcctaatagttgtttgtaaggaatttcaaggagtctactgagatttccccctccatcctctctatatctaatatatctagctcctgttcacaaggatgtgcttgaaagatgtaaatatgtgttataaatgtttttttccctacaaaaggtcatttaaaagttttaggttgtaggaatacagctaccgagggaggtgaaatatctctacaacacgaattacaaaacgctgctgaaagaaatcagagacaacaacaaacaaatgggaaaacactttatgctcatggatgggaagaatcaatgttgttaaaatggccatactgcccaaagcaatttatagattcagtgccatccctatcaaactactaatgtcatttttcacagaactagaataaactattctaaaattttcatggaaccaaaaatgagtctgaatagccaaagcaatcttaagccgaaagaataaagcccgagacatcacactacatcacactgtagtatagacttcaaactaaacctcaaggctgcagtaaccaaaacagcatggtactggtacaaaagcagacacagaccaatggaacaggtcagagaacctagaaataaagccacacacctacaaccatctgatcttcaaccaagtcaacaataacaagcaatggggaaaggactccctattcaaaaataaatggtgctgggataattggctatctgcatgcaaaagattgaaaccaggccctttcttttcaccatacacaaaaatcaactcaagatggattaaagacttaaaagtaaaacctaaaattgtgaaaaccctagaagaaaacctaagaaataaccattctggacataggccttgggaaagaatttgtgatgaaaactctcaaaagcaattgcaacaaaaacattgacaagtgggacctaactaaactgaagagcttctgcacagcaaaagaagttatcaacaaagtaaacagacagaatgggagaaaatatttgcaaactgtgcatctgacgaagtctaatgtccagggaatctataaggaacttaaacttaaggaacttaaaccactccattaaaaaatgaacagaggacatgaacagacacttctcaaaaaaagacatgtgcatggccaacaagcatatgaaaaaatgctcaacatcactaatgattacagaaatgtaaatcaaaaccactatgagataccatctcaccagtcagaatggctgtcattaaaaagtttaaaaataacagatgttaggttgcagaggaaaagggagtgcttatacactgctggtctgaaagtagtttagccactgtggaaagcagttggagatttctcagagaacttagaacagaactactattcaacccagcaatcaaagtactgaaagtatacccaaaagaatataaatcattctgccaaaaagacacatgctttcatgagtgctccttttcacaagagcaaagacatggaatcaatgtagatgcctgtaaatggtggattggataaagaaaatgtggtacatacacatcatggaatactacatagccataaaaagaatgaaatcacatcctttgcagcaacatggatgcagctggaagccattatcctaagcaaattaatataggaacagaaaaccaaatcctacatgttttcatttataagtgggagctaaacattgagtacacatggacacaaagaggggaacgatagacaccggggcttatatgagggtggagggtgggaggagggtgaggatcacaaaactatccacctggtattgtgctcactacttgggtaatgaaataattcgtacaccaaacgccagtgacatgcaatttactcatgtaacaaacttgcacatgtaccccctgaacttaaattaaaagttggaagaaaaaaaaaggataaaaaaataaataaaagttttaggttggacaaggtgccacagagtttatttgtattaacctacatgtgattcattttatccatttggagctagaatttacttataagaattttacaggcctaatcctactcaaacaaactaaatgtaaaagtagtttctagattcttgggtggtattacatttttttaaggataactagtgtccctacaattggaatggtggccaccttttgttattcacatgtttagttttggacaaaagtattcctgaaagcatcttgctcagcgctggccacatagtgaaggttcaataaccgttgactatcctcctaccaggttttgattggaatgacctaaaatccccctacaattatcccatctttgtaaggtctcattttcttttcaatatttaggaagaaggtgccacatgaaaagctatcaagtttaaaccttgttcataccttcacactgatgttgtatcatgagtgtcacccaagcgccaagttgcaaaatgtcggcaagctcacagtagagcacaaaggaaagtgatggttagataatgaaacaagggctttgggatgtaagcagagatactaacagagagccgcatttgtttgtagcacttttaactactcaaggaatcttgaggtgacttaatttgtagttcagacccctacctctacccctagttaatcacaggggtgatgaaaaatactacatgctgtctttcttttcctaagctctctttaatcttgatctttgaaaagcaagtggtttttcttgtgcaaacagcttcatagaaatgtcaaatctggcacccacagtctatgctgaagggggagacttggtacaaaaggctcagtgctcagggcccaggctttgaaatgactccagctgtattgccaatgcaaatgcaggaggggaaaaattactggaacaaattgaaaggttattcagactggaatttagaatctcaataaaaaaggcttttataagccaaagccttggagtaaccggatcatttaaaaatacatcttttctgcattaaatgtggtgtgacagccacattagaaatgctgcagtttaagtatgttccttaaacatttttaactgacttgtaaggacagctaaaaccttctattggggggacactggatccccagttcatacatagtttccatttctttatttttccctcttttttttaatacctggctaataggtttttgccttttccctgtgttgattgctgcaggctcagggatctctgtgagctgcatgtcttgataaaaatttgttgagctagtcattttcttttttgacttgccagagaacagtcttcctgatcactcagacgttggtgataggaacagcacagctgtacgggggtggaatccctttaacaagaggtgtttaggccaagagacacaaatattaatataccccatctaacatgaggcagtgtcacagatgtgggactccttcctattgtttaaaatctgttatttcatgatcttttgaaagatatgatccaagtccagttgttcttggtgtgcattgcagttttccacccctacctccctcctacccaacaccattacttccttgacccaaaaaggagattctctaccccccacccccatttctacagggaaacaaccctgtagagagtggagagtgcattgaagtcaaagtaatggactttcctggggggctttctgcattctctgagctctgctgggtacagagctactgtggaccatggagtgtagctggcccagcccctgcactgtcatctgcacgggtcttcctgcctgattatttccaaaaatggctcagtctccaaaagattaagttcattgtttttaatttgtgaaatatttcaaatgtactgaatacccactatctggatttagcaaatattcacattttgccatatcaatttcaattctttggccttattttaaatcctcacttcctttctccttctctaggggtcacattatttcctttcccagcaaagttagctcttggtgctgccaaattatattgtttgtgtcagtgtcttaggagttatatcattgaactagaattataaggtaacttatctgtagcctattctagattcctcacttgttgagaagaaaaacttggcctttgtaaagacgttgtccccagcccctggtaacatgccagtgctgcaattggttctcacaggttttttcttgttgttctgatttgctcctttgtttgttttgagtgaagggatgacttcacagtagaaaaatccaaggactcaagggttatagataacacattgacagactttcttcttattgaggttcaatatttttaatgagtattttagcacaggattgtagagttatttaattcaacagtttgggcctcccaatgttcctataactaaaagctttgaattaaccctgtttgatatctgatataattatagcataatagggcatcttcctggttagaagagtataagttgcttcaaataatgtgctgatcctaacttaatgagttttgatttgctatgcggatatgtgtctgaagcctattgtcttgttcatactagaaagcagacttggtctgagacaagcacttcagtgatactgactctcatgcctcataaagtgatgatggagatgctatgcatggcccctcttctcctcgtatagttctcataaaacaatagaatgatctgttccggcttctgtgctcctttgaggcagtatcactagcccatatgttttaagaaccatcttgttcacacaccataaggccaaatcaactggagcctcattcccacattgaagtccagttcttccatggatccagcattcctttgactagaagcatttgcgtgaagacccagcagtgcactattttgatgtatccaagtaaagtcatcttttaacataaggagataccttcttgcactttcttcagctgagatggagtttggggatggccatgcatcctgttctcttctggggatcaacatttcaatagaaggttagcctaggggctttatcccaacattttcttcccaaagtcgtggcagttcttaacagtgttgttcacataacattaacaatgcatgaagccaccatgccaatgcttgcctagggttatgcctcagtcacccctttccctttcattcaggaacatcctttagaatgcaagtggatggctgacatattagtagaatgattaacatctgtctttatttattaaaaatggtatctatcctcaggctttggtgcttggactttcatgagtgacatgttgccattgagaccagctgtccttgaataacaacacctcagtagactgtaccttttactgaagtgctatgagtttgcttctcttcaaaaatgatcttgtaactggttgccaaggccattgtgagaatcgatgctctccagctttaggccctcactctcagggtgaggagcagtgggaggctgcgtgataacatttaaagctcacagagggaaacatttttgcactgactgtgccagaatcccatgctttgtggccaatataatggatttcatttggggccctgcataggccaattgtcatgatatggttgggaaactttccatcagctactgtgagatccatcactctgttccctacctctgtttctggcttctccattcctggtcacattttatgaagcagccaaccatccagattgggatttcatgctctgctgcacttctgcccaagttatttctcttacaaaggcctcctttacaaaatccttaatctaagtaatgcgtagaaggcgtattaatgggtagcaagtgaaagaaggcaagagccagctacttcctgaaaattattgtcattagagcatttccatgaaggccgaacaattcattagggtgagtccaggcaaaagccccatcccccaaaacatatgtaatgaattcagatctaattggccatggtccagtctagttctaagggtcattcttggcattttggaggtcagaagaaaggtttgatttgaagtttgttatgtttcccacatgttatatttaagtttgttcattatgttcattggatgttcccattggcttttagttctggacaaaggttaggtaaattattcaaccctggctcatcctgccatcaatccgatgcctcagtgcaaaagacattcacacccatgtcccagtacacgaaagggattcacagggcaacctaggatttgagtgggaaggaggccttgaatgagagtgatggtttcagattgacattggttttgttggctggaaagagatcctgattcttttatctgtggaattttctttgtagtcccagtatcagagtgtggctaatgtctccaaagctttaccgagaagctgtatgatgataaagcctttgagtaaggctgtccataggcttttgctgactgttgaatttccatggtctgctcatccaagaatttcactatgtggggtagcttgaaggagagggagattctggggaaatgacggcctgagtttttatttgcttgtttcacttcagcagaggagtgagaaaagtaagtggcacattgagtttgtgtatagaaggagctgtttatctgatggaaaggcccttccaaatcctgttttcattctcttttgctgttggagttagaccccatttataataattaagacttggttatgtgactttaagtccacctgtatccacagagaggctagagatgtgcattgtttaaagctttcaagtgctgaacaatgaatgaaggttatggtctggcaaggtaattgtttatttgaagccaaagtcagagatgtgggagacataatttaaagaactcaggggccttatattcctggcctcgagtcgatcaaagaacatataaaaccatccagtgaaacttttctggatttctaactgaataatccattctaattcactggtctttaatctctgagaatgagaagtagctgagtggtatcacatgatatatacaaaggtgttatcgaatttgatggcaggcgaaaactgttttgcctgcatgttctaatgaaacatggaagtttcaagtcagtgagataaattttaaggtttagattactagctgtgtggcccactctgtagagctaccaaagacaaagtgacagaaaaataaccctaataaacacttcttcgaaaggatggagttgaacaggatccttttggttggagaccttgtgattactgccaaattggttgtttataataggtaaatgttgattgagcagagacaaagctggaatcttagcattgaatacccccagccttggcccaagtatgcaggaggtagagagttgggctatttggaaaagagacagataattaaatcttttagaggagaatgcttttgaatgcatatttgtaagttaagccataatttaaatgctcaaatcctaggcggctccagaatttcctccaacacctgaattcatggtggaggggtgagaccctgacaagccttgacagtcttttaggcattcatttatttttcgccagaccagtttggttttgacttaaatcttgggtcttaagtttttctctttttctgtaaccctattgattgaaaagacaatttttttttcttttggttttccactaattctggtatgataaggtgaggccaattttaaataactattttttacatctgcttatcaaccctaaaacctaattctatacccatcttcatctttttttttttttttcaagatggagtcttgctctgtcacctaggctagagtgcaatgactcaatgtcggctcactgcaacctccacttcctgggttcaagcaattctcccgcctcagcctcccaactgactgggactacaggtgcacaccaccatgcctgactaattttttttttgtatttttagtagagatggagtttcaccatattggccaggctggtctcgaactgctgacctcaagtgatccgcctgccttggcgtcccaaagtgctaggattacaggtgtgagccaccgcacccagccttcatttttaaactccagctgcagactgcttaaagtcctctctctctctctttttttttttcttaaagagagggtctccctctgttgcccaggctggagggcagtggcatgatctcgattcactaaagccttagcctcctgggttcaagtgatcctcccactcagcctcccgagtagttgggactgcaggtgtacatcaccatgctgggctaatttttaaatttttttgtagagacagggtctcactatgttacctagacttgtctcgaactcctggactcaagtgatccttctgccttggaagtcttatcttttaaaatccatcacttgccaggcatggtggctcacacctgtcatcacagaattttgggaggccaaagtgggatggttgcttgtgaccagtagttcaagaccagcctgggtagcatagcgagaccctatccatacaaaaaaatttgaaaattagctggaaatgatggcatgtgcctgtgggtccagctactcagaaggctgaggtgggaggattacttgatcctaggagtttgagtctgcagtgagccatggattgccactgcactctagcctgcatgaaagagcaagaccctgtctctaaaataaaaataaaatcagtcgcctaccacctggtagaggtattattttccaaaacaacaacaacaaaagtcttttgttttcacacacgcacacagggagagaggtgggagtcaaaaatcagagaatcgactcattcatttgctaaatattcatttgttcatgcattgagcaagtatttgtggagcacctattgtgtaccaggcattgaattagcacctatgaatagcacaggtgaacagtggttactgagaagtcaggaaataaataagcaaaccccaaataaaatacttaatggcaaattgtggtaagtatgatgaagggaaaatcaatgtcttgaagaaatatttgtattaacgaggctaggctgacctgtgttgccataacaataataatgaatatgaaatctaaatgacttaacaaaaatgaagatttatttcttctcacattccaatatgatgcagattgaatagttctattgggatttgaggatccagtgtccttctgtcattggtgccaccaactttaacgtgcggtcttgacagttgtggcaagcgggagagaaagattgaggcaaattgcacaggcaggtttttagccagctgggaagtgggtatatcatttctgttcatattccattgtccagaatttagccacatggacccaccaacatgactaccaggaaaactgggaaacacagtcctcctgagtacataagaagagaaaatgggattggtgaacagcttgattttaatggaagatttcatttagaccagaggctccaagagcctctccctatagaaatgatttttaactggtaattagaatattaattgttagccacattgagtgtagtgggaatacattacattttaagtatgtttagagaccttacaaccattactatagatttgctaccagttaggaggatattacttagaatatttaattaaatctccttacctacaattgaaaatgttaaaaagtcagaggcccagctgaggaggcaatttaattacaatctgggtaaactgaacaaccagtgtcactgtcattcatctgtggctatgtagcatattttgatagaaggtaattgaacttttgccatcaaataacaaacaggggagaggctgtttgattggtgagcaaaggccaaactttggactcacagagggctgaactcttatcctaattgtgccataaaataacgtgatttttctcaagccagcttacctctctgagccagctttctctcgcataaaaaaggagagtaatagccactgttcactgggtaccatgtacgtaagactgtgcctcagcgctccacattgccttactaaatgacataaagtgaacagcacacacacaaaagacctattgcaccagttaggataagccaacttcaaacatctgtcacccggagacagagcagttctggagctggctaattcagcagctcaaagtaatttttatagcgatactctctgccattcttaacatgtaaacaatgacactatcatagtctcaggtgatggcagcagtttgaggagacaccagtggattttctgtatctctttttatcttataaaagagggagttcttccctacccccacacaggcacctctgtagatcccattggccagaaatgggtcacatgtttatgccagaaccaatcattggcaaaacagatgggattaccatgattaacatagaccaatcgtgattccacactgggacttgggaggaagccacatctctgaacatagaagagtggatatctggacaaagttgggactctgggaaaaaggagaaatagggatgatgttaggtagacagttggcagtacctgcccttcctcatctgctgctaccagaccacgtaagctctctgacatgcttgccacttggagtagctccctcatagctttctgcagataaatataaaatgcctaaagctagataaaggttgtcttcctcccctccctcccttccctttaaatgctatatggtgaatattaaacttatcaaatacagcctgtgttttaatgcaagaaataatagagacaattttgagtaggaggaggagctgccatggggagaaggcctactattataagagggctctagacagcctggttaaaattctaactctacaacttacttgttaggtgacctcaggcaagagtataaagctctcaatgccagtttcttcatctgtaaaaatggagattatcatcttgataaagcctacctgtattcatttcctgtttatgttgtaacaaattactacaaatgtagtggcttaaacaactccatttactatctgacagttcttggagtcagagatcagatgaaggtctcactgggttaaagtcaaggtgtcagctgaactgtattcctttctggagacgcaaggagagtaatatggtttggctgtgtccccacccatcttgaattgtaactcccacaattcctatgcgttgtgggagggacctggtgggaagtagttgaatcatggggtcaggcctttcctgtgcaattctcatgatagtgaataagtctctcgagatctgatggttttataagggggattttccctgcacaagctccattctcttgtctgccaccacgtgagatgtgcctttcaccttccaccatgattgtgaggcctctccagccacgtggaactgagagtctattaaacctctttattttgtaaattgcccagtcttgggtatgtctttatcagaagcatgtaaacggactaatacaaagagaatgtgttttcttgccttttccattttccagaggctgtctgaatttcttggcccattgccccttccatctgcaaagcccagccacagccggcttagtctatcttgcacggcagcactaactctgaaactctcttccactttaaacaaccctgtggttgcattggtcccatgggataactggccctattttaacatcatctgattagcaatcttaattccatctgcaaccttaattcccctttgtcatataacatcacataatcacaaactcctagacatcatggggacaggggtaggggaacatagtattctgcccaccatactactcataggaatgttgtgatgattaggtgagaagactcctgtaatggcttagaacagtgccagtcacataagcaaatgttcagtaattgttctttgtgaccccattatgtcttatcatttaatgagtttgttttatacaggaacaggctattgggagttctgtcttgaggaagcatctgatgctactttgctcactgctagaagtgatgatagaaggacagagatcttagtgagagccaactccttcttgctttctaaagccaaagctcaaggtctgagctctctttggaattaggtgattctccacagaaaacgtgtggtttgggcaaagccaattttatgagtaacaagaatgaaataaactggggaagatccaagcagataacattatcctcacataaaagtggccaatagaaagaagttaagagccacccttccctggatcacgttgtatagcctgtgtaagagaaggagtgctgtatgtagttaagataatggaccctggagttgaaattcctcttttcttctcattatctggatgacctcaagccttagcttccccatttgtaagatgtggataaaaatagtttctaccgcaggatgagatgaggtctggaaagttcacacaacgtaagtgcttggcacaaggagggcctggcagaaactgctaggtcagagataactctgggagggttcatacacagtaagggtctcattgcaaataattaaagttgagagagccactctcctgcctggctggggctaaggagtctgtagccttagagtattatgttcaaaattctactctcatgcagttaaatcttagcctgaatgtttattccattaaactttccctccagattgcatcatatgtaattacaagatgaaaatattgtgtggagaatgtagccattgttcaagtttcacatatgtgatgatggtttttgaatcttcttggtggggaggaggttagatttgttggttgaggtggattgtgacaagtgagcagagggacagacagcagaaagctgggatttcttggttggaaagaaatatgttgcaggtcctggactccacaggagttatatcttgtcttgggttgttttcatcccacagcaggaataactaaagataaagacaaagatgatgaaagacaagatgatattttgatgtcactgggcctggaaacaagggcgctattgtttgcaggcagcctgtattcatctgtgagagattagcaatggcattaatttattcaagattacagttcagaagcaaagtcatcaaaactgaagctctttcatttatggagcacgttgtacctctgggatggagggcgagtgctctggggccggggtatccttcagcgtgagttgtcttaacaggatgttttactcagagaacaagccttaggattcagctttttcagtcctgtagccactctcaggattccttcatggacttgatataccccaagactcttcagattcccaatggtgagagcaatggccgtgcttggaaagtggaaattggtaaggtcagtgggtttcacttagagctactgtgattcagcccaactcttccaacttgtttcgtatgtttacactcttgacaaaaattttacaatcatagactatttcctcactagaccacctctttgcctctggatcatgtacactcatggtcacgaggatgatggtagcactgtgttgaaggaaatgaaatcgatagcaaagagataactgcattcccatgcttatcgatgcctaattcacaatagcaaagtatagaaaccatctgagtgtccatcaacatgtggatgagtggatacagaaattgagttttagtgatataggaaaatccaaactcagtttctcttataatacttttacaacacagtacacttctgtgatcctggatgtctgagttttttctccacacaccaagcaatcaactgtccagcagattctccagtagatacgataccagctgggtttcctctaaatcaattcagttctgacactatctacctggagacaggttgaggactgtccctcaagactgcccctacttcagaggacagttgcaagtagtagattgtcacctatacttctgatcgaccagctgtgaattggggggttcccacaacctcatccttgagatctattaactttctagagtgggtcacagaactcagggaaacactttacttataataaatgtacacgtttattataaaggatattacaaaggatacagttcaacagccagatggtagagatgcacagggcaaggtatgggagaaggggcaccacggagctcccatgccctctctggatgcaccacactctaagaacctcccatgttcagctgtctgaaacctctcagaactcagtatttttgagactgagttttttatgaaggattcattatgtccacttgtttattaactcaacattcagctcccttcccctccccagaatatggggggggcagggggaggtagagaggaggcctgaaatttccagtcctctaatcagatggttggttcccttggcaaccagcctccatcctgaggctatctaggggccctcagccacaagtcatctcgttagcatacaaaagacactcctatcactggagatccaagtattttatgagctctgtgtcaggaaacagggaggaagaccaaatatatatttcacaatatcacagtagcagatatgtaatggaatattattcagccataaaaaagagggaaactctgccatttgtgacaacatggataaacttggaggacattatgctaagccaaacacagaaagacaaatatgtttcatctcacatatgaacaagtggttgccaggggctgggaagtaggggaattgaagtcatgttgatcagggtacaaacttgcagttagaagattaataagttctgggtatctaatatacagcagggatggcgatagatgtgttaattaatttgattgtaataatcattacaacatgtatatgtatatcaaatcatcacattgcgtatcttgaatatattcaatctttgtcaattatatattttaaaataaaaacacaaactttattttgaaataattttagactaacaagaaatgcaaaaataatactatgttcccatgtacgcttccccagtttgtcccctactgatacagtcttctataagtgcaaaccaaaaagcatgtaaacagatctcaaacagttgggaggtttattttgctaaggttgaggatacacccaggaaaaagagacacaggccacagtagtatgtgtggccgataccttttctgaagagggttttgagggcttcgatatgtaaaggggaaaagtgggcaagtggggaaagatgaaaaaaagagggaagatgtgttcacaatcttgtgaatccatatgttgcgtgtgaaaaggagggggtagacgttactgtcaattacgtattcatcttacactcagtaaatctgcactttacataagggaaaataaacagagtacaggaagctgtcaaatatacattcatctctgggtgggtgggggaggatttctggtctcctcctgtcctgtgtctatgagctgttaatttacattgttagggtggcccctgtcgagacatgagaagttctatctgtagctatcagtttaggaacaaaagtaaaggagtttttgggttttatttttggttttgtttttccatgtctcagcttccaagctaaacttttccctttgggcatagtgaatttggggtcccaagagtttatttgcctttcacatagcataataaattattttttaaaagactttatgtggagcatttcaaaaatgcatgtgataagggacgcaaaacttgtgtggcactttttttttttttttaacaagttccctctaccatgttaaatcatagcgtcaagacagaacctgccaggaccttcaagcctccttcatcatgcctccttctagtcattctgtcccctacagtaactacttttctgacttctatctccatgggttagttttacctgttattgcaccagaaccttatgtaacatactctctggtgtctggtttctttcactcagtgacatgtctttgagatgctgtgtgtgccaagggtttgtttttatcattgctgtgtagtactctggtatggacatatcattatttatctcatctagcatagatggatatgtagactctttccagttttagctatttcaaattatgctgctgtgaaaattcttccacatcttctgttgcacacttgtgtatacatttctattagggaatatccaggagtcgaattaccacctcaaaaggtatacatgtgttctgcattaagaaaattctgccaaacacctttccaaagtagtggtaacaaagagcattttagtttatctttgccaacgtttgcaatcccaaatgttcttaattttcaccattctggtgtgtgtgtctgtgtatgcgtgtgtgtgtgtggtgtgtgtgtggtgtgcatgtgtggtgtgtgtgtgtgtgtgtggtgtgtatgtgtgcgtgtgtgtgcatacattcgtgtgtgtggtgtgtgtagtgtgcatgtgtgtgtggtgtgtgcgtgtctggtgcgtgtgtatgcatgtgtggtgtgtgtggtgtgtgcgtgcgtgtgtgtggtgtgtgcatgtgtgcgtgtgcggtgtgtgtgtgcatgtgtggtgtggtgtgtgcaagcgtgtgtgtggtgtgtgtgcatgtgcgtgtgtggtgtgcgtgtgtgcgcatgtttgcgtgtgtgtggtgtgtgtgcgtgagtgtgtgtgtggtgtatgtgcgtgcgtgtgtgtggtgggtgtgtgtgcgtgtgtgtgttctgcatctgggtgttttagtatctaagtatcttaattcccatccctgtgatcactaatgttgatcagttttcatatgtatattagaaatgtatatgaaatacagatatttatttgtatattggctatgcctatgtattttttgtgaagtgttcaagatttttgacaatttaagaaatctcatgatatactttttttacttaatgatttatagtcattctttatgtattccagataccactcctttactggatatttagactgagaatatcttctcccaccctgtagtttgctcttcttttaatgctatcttttgatgaacagaagtttttaaaaattttggtaaagttcagtgtattgatcttttcctttatggacagtgctcttttatatacaatttaagacatatttccctgccccaatggtggatgatagtccacaatattatattttggaagcttaattattaagcttcactattaaactttattattaaaatccatctggaattaattatggcttatttttctccatatagttgatgcagcacgatttatggaagacagtttttcccattggattatagtagtactttttaaaaattaggttttttttttcttagatcctctgatgttatgctattggtctgtttatgtttgtactctgttttaattacttgagttttatgtaagtcctaatatctggtagtataagtcttccaatatcattttgattcttcaaaattgtctttgctcttcttggttctttatatttccatgcaaattttagagtcaatttattgatttctacaaaataatctgctgagactttgattgcgattgagttgaatgtaaaaatcaactgaagaaggattgacgtatctttataagattgagtcttccaatccattaacagtccatcccttcacttattttctttctgtaatattttgcagtttctgtgttggaagtcttacacatttttcctaaggtttattaccaggtatttaaaaggctttgctgcaattatataatatagagttttttaattttttattttctaatatttgaaagccatcaactttataatgatcttgtgtacaatgattttgccaagttcacttactgaaaagggttaatgatgactatatcttttttattttctgtgtatataatcatattgtgtttgaatagtgtctgctatatttctactttcccaatctatataccttttatttctttttcttaccaagttgcactggatttctttttttttttttttttatcttgttacaccaccagtacaatgttgaaagaataaggattagcacatattcttacctctttcatgatctcaggatgaatgcttttactagttttaccattaagtcttatgctgcttttgattttcatacatattctttttaaggttaaagaagtgctcttctgttcctagtgtggtaaaaatggatgtgaatggatgttgaattttgtcgagtgcttgtgcacctattaaaattatataattttttcttcttttttaatgtcatggattacattgtttgattttcaaatgataaaataactttacattcgtggtataaattcaactttgtcataatatattaaacttttatatttcactgcgtttgactttgtgcaattttaagatctttgtgtctgtgtcaagacagatactggtctgaaaatttcctttttgtaatgctgttttcagctttttttattagggtatgctggcctcaaaatgagttgggcagagtttcttctttttatactctctggaaggatttgtgtaagattgttacttcttccttaattgtatggaagaattcaatggtgaagccacaagggactgtagtttactttgagggaagatttttcgttatagattcaatcactttaatagatggaagactattctgactttaacatttcatcttgattcagttttagtaagttgtgctttttgaggaatgtgtccatttcctataatttttcatatttattggcctaaagttgtttataaagtccccttatttcctttttcacatgtaaaagatctgtagggcccttcttttttccatttccaatatgattaatttatgttttcactcattttttctaaatccatcttgcttaaggatttatcaattttatggattttcaagaagtaactttttggcattgtacatctgtttgctgtgtcatcgatttctattcttattttttatttcctttactccactttcttggggttaaatttgacctttttttagcttgttaaaatggaaccttagattattggtttccagccttacttttttattatatgtatttacagataccaacttccctgtagttgttttagtaatagtgcacttttagatatcatattttcattatcattgaactcaaactattttctaatttttattgtgaactttatttaaagtgtattatttaattctgaaacaatttgaataccaaattttctagttaaaattttatgatttttagtttattccactgacatgttgaataccttctatattatgtccatcctttcaaatacatttagacttgctttacagatgatcatacgatgtgttttggttaatgatccttgagcacttgtaaaaaaaaatgcattcagcagttgatgaatgcagtgttccatatatgtcaatgtgatcaaattgactaattgtaatattcagatctagtctctactgattgctgtatttgcttattctatcagttggaattccccactatgatattgtatttctctctgtctcattttagttctgcttaacatttcagctttttggtgttatatgttgttgtatgtgttattatcagtatacagatttaaggttgtcatattttcctgtcgaatcagctcttttattattacatctaaatacatagtatcacttataattacattgtgctttacatggtttgaaggtaaaaagaaaggacaagatatactaaaaaatagtggctattcaatgtaattattgtataatttaatcttacctataatcttgctatttttcttatctatgtttctagttgattaatctaaaaaaggcaaaatatttctattattcagttttgtcatctattagcttgttagtaaacattattttattatttacttcagtgattaccctagaggttataacatttattctcaatttaatattagagtctatattatattagcacttttcccacttatataatgtacataccttagaacagtttacctctatttaagctcacccgtccttggtgccatattaatcctccaagccatgattattgtcattttaaataggaaatatttaattagagtgactcatatggattttcccccattttctgtgttattaatgggatcatttttcatctgcctgaattatttctttaaattctgctgataaatgtgtctgaaaatattttaattttgctgtcattttaaagaatgtttttaatggggtacagaattccgaggcttacatttttttcagttctttaaagatatgttctgttgactgggcacggtggctcacacctgtaatcccagcactttgggaagccaaggcaggtggatcacctgaggtcaggagttcgagaccagcctggccaacatggtgaaaccccgtctctactaaaaatacaaaaattagccaggcgtggtggtaggcacctgtaatcccaactacttgggaggctgagaccagaggatcacttgaacccaggaggtggagtttgcagtgagccgagattgcaccactgcactccagcctgggcaacaaagagcaaaactccatctcaaaaaaaaaaaaaaaaagaaaagaaaaagatgggcttccctttgtgggtaattcgacctttctctctggctgccttaacattttttccttcatttcaaccttggtgaatctgacgtttatgtgtcttggggttgctcttctcgaggagtatctttgtggtggtctctgtatttcctgaatttgaatgttggcctgtcttgctaggttggggaagttctcctggctaatatcctgaagagtgttttccaacttggttccattctccttgtcactttcaggtacaccaatcaaatgtagatttggtcttttcacatagtcccatatttcttggaggcttgctttgttgctttttattcttttttctctaatcttgtcttcttgctttatttcattaagttggttttcaatcactgatatcctttctttcgcttgatgaattcagctattgaaacttgtgtatgcttcacgaagttctcatgctgtgtttttcacctccatcaggtcatttatgttctctacactggttattctagtaagcgattcgtctaaccttttttcaaggttcttagcttccttgcattgggttagaacatgctcctttagcttggaggagttggttattacccaccttctgaagcctacttctgtcaatttgtcaaacctattctctgtccagttttgttcccttgctggttaggagttgtgatcctttggaggagaagaggccttctggtttttggaattttcagcctttttgtgctggtttctccccatctttgtggagttatctacctttggtcttttatgttggtgaccttcggatggggtctttgaggggatgtgctattcctttctgtttgttagttttccttctgacagtcaggccgctcagctgccgccctgctggagtttgctggaggtccactcccgaccctgtttgcctgggtatcactagcagaggctgcagaacagcaaagattgctgcctggtctttcctctggaggcttcgtcccagaggggcacctgccagatgccagccagagctctcctgtatgaggtgtctgtcagcccctactgagaggtgtctcccagtcaggatacatgggggtcagggaccgacttgaggaggcagtctgacccttagcagagctcgaacgccgtactgggaggtctgctgctctcttcagagccatcaggcagggacactaaagtctgctgaagctgcacccatagccgccccctccgccaggtactctgtcccagagagatgggagttttatctataagtccctgactgaggctgctgcctttttttcagagatgccctgcccagagaggagaaatctggcagtctggccagagcagccttgctgagcagcagtgggctacacctagttcaaacttcccagtggctttgtttacactgtgagtgtaaaaccacctactcaagcctcagcaatggcggacgtccctcctcccaccaagctagagcatcccatttggatctcagactgctgctgtgctggcagtgagaatttcaagccagtggatcttagtttgttggctccatgggggtgggacctgctgagacagaccacttggctccctggcttcagcacccctttccaggggagtgaatggttctgtcttgctggcattccaggcgccactggggtatggaaaaaactcctacagctagttcggtgtctgcccaaatggctacccagttttgtgcttgaaacccagggccctggtggggtaggcaccggagggaatctcctggtttgtgggttgtgaaaatcataggacaagcacagtttctgtgccagagttcctcaggctcagtccctcatggtttcacttgggttggggagaaaattctctgacgccttgcacttccagggtgaggtgatgtcccactctgcttcggctcaccctccgtgggctgcacccactgtccaaccattctcagtgagatgaaccgagtacctcagttggaaatgcagaaatcacccaccttctgcgttgatctcactgggagctgcagaccgcagctgttcctattcagccatcttgcactatgaagaaactgcatcaactaacagacaaaacaaccagctagcatcataatgacaggatcaaattcacacataacaatattaaccttaaatgtaaatgggctaaatgccccaattaaaagacacagactggcaaattggataaagagtcaagacccatcagtgtgctgtattcaggagacccatctcacgtgcagacacacataggctgaaaatgaagggatggaggaatttttaccaaggaaatggaaagcaaaaaatggcaggagttgcaatcctaatgtctgataaaacagactttaaaccaacaaagattgaaagagacaaagaagggcattacataatggtaaagggatcagtgcagcaagaagagctaactatcctaaatatatatacacccaatacaggagcacccagattcataaagcaagttcttagagacctacaaagagacttagactcccacacaataatagtgggagactttaacactccactgtcaatattagacagatcaacgagactgaaaattaacaaggatattcaggacttgaactcacctctggaccaaggggacctaacagatatctacagaactctccatcccaaataaacagaatatacattcttttcagcgcctcactgcacttattctaaactggaccacataattggaagtaaaacactcctcagaaaatgcaaaagaatggaaataataacaaacagtctctcagaacacagtaccatcaaactctagaactcaggattaagaaactcactcaaaaccacacagctacatggaaactgaacagcctgctcctgaatgactactgggtaaataaggaaatgaaggcagaaacagagatgttctttgaaaccaatgagaatgaagacacaacataccagaatttctgggacacatttaaagcagtgtgtagagggaaatttatagcattaaatgcccacaagagaaagcaggaaagatctaaaattgacacgctaatatcaaaattgaactagagaagcaacagcaaacaaattcaaaatctagcagaagacaggatagaattaagatcagagcagaactgaaggagatacagacacgaaaaacacttcaaaaaattagtgaatccaggaactggtttttagaaaagatcaagaaaatagatagactcctagccagactaataagaaaagagagaagaatcaaatagatgcaataaaaaatgatataggggatatcaccactgaacccacagaaatacaaactaccatcagagaatactataaacacctctatgcaaataaactagaaaatctagaagaaatggataaatttcttgacacatataccctcccaagtctaaaccaggaagaagtcgaatccctgaataaaccaataacaagttccaaaattgaagtggtaattaatagcctaccaaccaaaagaagtccaggaccagacggattcacagccaaattctaccagaggtacaaagaggagctagtaccattccttctgaaactattccaatcaatagaaaaagagggaatcctccctaactcattttatgaggccagcatcatcctgataccaaaacctagcagagacacaacaaaaaatgaaaatttgaggtcaatattgctcattaacattgatgcaaaaatcttcaataaaaaactggcaaaccaaatctagcagcatatcaaaaagcttatccaccacaatcaagtcagcctcatacctgggatgcaaggttggttcaacatatgcaaatcaagaaatgggatccatcacaaaataaaaccaatcacaaaaaccacatgattatctcaatagatgcagaaaaggcctttgacaaaattcaacaccccttcatgcccaaagctcttaataaactgggtatcaatagaatgtatctcaaaataacgagagctatttatgacagacccacgtccaatatcatactgaatgggcaaaaactggaagcattcccttggacaaccagcacaagacaagggtgccttctctcaccactcctattcaacatagtattgggaattctggctagggcaatcaggcaagggaaagaaataaagggtattcatataggaagagaggaagtcaaatggtctctgtttgcagatgacatgattgtgtatttagaaaaccacatcgtctcagtggagtctccttaggctgataagcaacttcagcaaagtctcaggatacaaaatcaatgtgcagaaatcacaagcattcctatacaccaataatagacaaacagagagccaaatcatgagtgaactcccattcacaattgctactaagagaataaaatactcaggaatacaacttacaagggatgtgaaggacctcttcaagcagaactaaaaaccagcgctcaaggaaatcagagaggacacaaacaaatggaaaaatattccatgctcatggttaggaagaatcaatatggtgaaaatggccatgctgcccaaagtaatttatacattcagtgctatccccatcaagctaccactgactttattcacagaattggaaaaaactactttaaacttcatatgcaaccaaaaaagagcctacatagccaagacaatcctgggcaagaagagcaaggctggaggcatcacactacctgacttcaaactatactacaagactacagtaaccaaaacagcatggtgtactggtaccaaaacagagatatagaccaatggagcagaacagaggcctcggaaataacaccacacatctacaacaatctgatctttgagaaacctgacacaaacaagtaatggggaaaagattacctatttaataaatgttgttggtaaaactggctagccatatgcagaaaactgaaactggacccctcccttacaccttatacaaaaatcaactcaaggtggatcaaagacttaaacgtaaaacctagaaccataaaaatcctgtaaggaaacgtgggtaataccattcaggacatagacatgggcaaaggcttcatgtctaaaacaccaaaagcaatggcaacaaaagccaaaattgacaaatgggagctaattaaactaaagagcttctgcaaagcaaaagaaactatcgtcagagtgaacaggcaacctacagaatgggagaagatttttgcaatctatccagctgacaaagggctaatatccagaatctacaaagaactgaaatgtataagagaaaaacaaccccatcaaaaagtgggcaaaggatatgaacagacacttctcaaaagaagacatttatgcagccaacagacatatgaaaaaatgctcatcatcactgatcattagagaaatgcaaatcaaaaccacaatgagataccatctcacaccagttagaatggaggtcattaaaaagtcaggaaacaacagatgtgggagaggatgtggagaaataggaacgctcttacactgttggtgggagtgtaaattagtttaaccattgtggaagacagtgtggcaattcctcaaggatctagaactagaaatacgatttgacccagcaatcccattactgggtatatacccaaaagattataaatcattctgctataaagacacatgcacacatatgtttattgcagcactattcacaatagcaaagacttggaaccaacccaaatgtctatcaataatagactggataaagaaaatgtggcacatatacaccatggaatactatgcagccataaaacaggatgagttcatgtcctttgcagggacatggatgaagctagaaactatcattctcagcaaactatcacaaaaacagaaagccaaacactgcatgttctcactcataagtgggagttcaacaatgaaaacacatgggcatgaggaggggaacatcacacaccagggcctgtcagtggctggtgggggcagggaagggataacattaggagaaatacctaatgtaggtgacgggttgatgggtgtagcaaactaccatgacacatgtatagctatgtaacaaaactgcatgttctgcacatgtaccccagaacttcaagtatatattaaaaaaagatatgttctgtcattttagacctttcttacttcttttgagaagttcaattgttagtcttattgctttttagtatgtttttttctttagctgactttaagatttttatatactgtttagaatttgtattatgatatgtgtaagaatgttttcttttgcatttattttacttggagtgtgtatatcttcttgaatctatggccggaagtttgtcatcagttttgtaaaatttttgtctcacttcctccaaatatttcctttgccccattctttttttaaattctttaagaattccagttatgtatcagatcttttgaccagatcccatatttattttttgcttcttctttgttgtctagttttttctctatacagttcgacctggatatttctactgacttctccagttcattaatcttctcttcggtagtgtctaatcttctattaaatagatatgatgaattcttaattttaatcaatgttttcaattctaggaatttcatacaattcttttttatactttatcttttcatctgtttccttcaatattttgatcatggttattttagagtctgtgcctgtctgtaatatctggattacctgtaagtctattatctctttcctttttttatctcttgacttttagttatctggctctgtttcttggcatgcccaacaattcttgattgcttgcctgatggtgtatatgaaaaattgttgaggctttggatgttcttatcttcctcttagaaagaataaatcctgtggcgggcaaatagaatacaggcaaagtatcttgatctaattacaacttgtttatttataatttgtcctgactctgcaggcttagccatttcagaggtttcagctgaaagcttgtagtttctacatgtgctgtctcctccttggtgagggcttaactttaaattttgatttcccaccattttatgatggtcaggttctctgcttaacatttcagtcttttagctgctttctacttggttttattgagtcttaactaacacatacataacttagtcattatcaaatacattagggagaaattgtctgcagaacatggacttacttccctagagttcccttttcttctggatttttttctgtagcctgaacccatttttttggtcttcatcttctagtaaggctgccactaattctagattgctgtttcctgtttggctttcatgcccttccctatgatctctaactcctggcctcatgtgatccacccgcctcggcctcccaaagtgctgggattataggtgtgagccactgcacccagcctcatattcttccctattaattggcaaatgctatgagaggggaatgggagtgaatataggtctttactccttgtaattattttcagtataggatctggtggcaccttcaagccctcattgccctttttcttttttgtagtttatccaaccttaatagatagatgttctcagtattaggattcatctgacagtacatagtccatcatagctagaagcagaatttctccaattaatacttttaaatttattgtaagagttgctttattccaggagctgggctcgttggttctcactgattgtgcacagtcattgggtggtggcagacatctggatgcagctttgtcgatgaactagcacagaaatgccagctttcctccattcgagtgttatcaataagagtattgcttttgtctctgttcggtgggtcttcccagggtatgaagttctctgaatgctaattgttaatggtactctatgttttaaaaatcagtgtttatgggctgggcatggtggctcacgcctataatcccagcactttgggaggccatggtgggtggatcacgaggtcaggagattgagaccatcccgcctaacatgttgaaaccccatctctactaaaaatacaaaaaataagctgggcgtgatggcaggcgcctgtagtcccagttactcaggaggctaaggcaggagaatgccatgaacccaggaggcggagcttgcagtgagctgagatcacaccactgcactccaacctggacaacagagcaagactccatctcaaaaaaaaaaaaaaaaaaaaaaattagtgtttatggaggcctttttattttcatttaattttattattcttttaccaaatatgtattggaagtttagaaagccatagtcccacctgaaaaaatgtacactgcacattattagcatactaaaggcatagacctgcatctttgacacttacatgttcaactttgctgtccaggttcttagagcatagtaatgaacaagacacaaaatgtccactggggctactgaaattgcccagagaatccaccctggtggcacccatatccatgcaaagaagacacatttgtgaaactctgagttaaactagtctctgtggacaaccactgggccttacttctgcttccagtggtcactggctctgctggaaaggctagctagagcatgcagatatggaagcctaactaatggaaatggtcactttggagtgttttgcctcctttggggcaacaagttagattgaaacagaatctttctttctttctttcctttctttctttttgatggagtctcgctctgtcgcccaggctggagtgcagtggcgtgatcttggctcactgcaacctccgcctcctggactcaagcaattctcctgtctccacctaccaagtagctggaattacaggcacacaccaccacacctggctgatttttgtatttttaatagagatggggtttcacggtgttggtcaggctggtctcgaacttctgacctcaggtgatccacccgccttggcctccccaagtgctgggattacaggagtgagccactgtgcccgcccgaaacagaattatttaacatagcacagtgagtatgacttggtcatacattgcacagcttgcaacaagtgttgctgcattaccgaaacaaaattaatttaaattctctttaaacacatgttttgggttgattttctaatttgaaactgtcaagagatcaagtaacaatgtcatcataatgagaaagatggggaactgtgctttaaagactgtcagcccatttgatctaccacacagaactaggttggtaattaccctaaaaaagtcaacttgccaaaaaaagaatagtctgaagggtcagttagtgattgagtataaatccatcttgtgattttatgtagttataggtcgaaatgattgtatatataggcatagacacacatctgtatgtacatacttttttcaaattctcagactcacatttcctctaagtaattaggaaagatattatgcaaagtcatactgccttctgaaatggacacttaggatctttgacattttatacgaagcacactactattcctgttattggcatggataattgacacttgactgtatccttctcattcactaggttcttcagaccctcatacattgagctgtttttaaagactctatgtaccccaaaagttgttgatgaccacttgtgtacatttaagtgtcaaaaggaaaacaaaatgtaagcatgcttttccaggtcacagttatttacatcattggctctctcttcaaggtcacactgtgtgctgattttgcatttggtccagaacatgtctggggctcatcttggccctagaagagtcagaagtgtcatgatgaaagtaatagtgaaggatttgagagaattctgtctttactggggcagagtaaccctcatcttaaggaaatacctacaaattccacccttccaaaattttggttcttagcggcacccaggattctgtaactatgtgttaaaatgtctgagttctctgattttaaatgaggcatgactgttcaaaggcaggtaatgtcttctgtggagacaggtatttagacgaacacttcagaacaagcagaaacgtatagggcaatggcgtggatcaaaagcatcaccgtgtaattgaaactgactttgtattgggttccttcagtgtcaaggccctttttttcttctgagagcaacattttccctcttatcttcatttatgcctgtgcttccttaatcatcttcaaatgtttgtgggttgatgttcacatgtcctcattctgttttttaaatctcatttgttgccgtttttctcttacagggagaggaagtattctgtttaggctacgtgtttaagggtgaaaagtgtttatagaatcttcatctgtttcctttgagcctgatatatttgatgacatcactctgtaattttacatgatttggacagtgcgaagcacacagggcagaatgttcaggacgacaaagagaacatgtttttgtaattagccagggaacccaggctacaacttgtgatccttgttgaaaacacgcacatacacttacagatccaatgagagaagatggtccttgctaatgtgttctttggtggcccatgactgactttaagggctgtttggtttgaatgcttgtgtgtggacaagacacgggtctggggtgagagttcagcttttgaactctgggttaagaatttaatgggactaggtcattgataatagagattttggagacatttaaataaaatctcttcgtgtctggaatttggggatagcaatggaaggtcatattaattttgtgttaatgagtgttcagtgaataaatacatgcttaagccatttcccctgtgccttgttgttctttattgatttcccagtactttctcattctctcagtctgaagtgattattcagagcctccttaggaagtcccactgaatggctgagcacttctatttgagacaccattcactgactgctgacctttggggcatcatttcctaaggcttccacgttgtggtcatcagagttttatgtggaccctcgaaaaagtcaaaaggtcagagcacagaagaaagaattctgatgaagatttatgaaatgtcaaaaattaacaaatctaaaatctagtttaatttcagcaagaatgacagctttgagtggcttgtacttggacatcggtggaagtaaaactgatcagaacttctaaagtgggaactcactggggaccatccccacaggttctcccacggtaatgctttggcatctgtcctagcgagaagtcatttggtagaaacctcatgtttctgcctaggtgggacacttgcactttgagggccttggacgaatagatgggttaacccaagtgttgaacactacttaactatctcgggacttttgttctgtgttcatggatttagtaatcttaatgtaaacaggcacctcagcagctgtgtccccttaagcggattttatttagcagctgagttacccacgtcacttggcagtcatagattttcagtttttccttgtgccaagagggcagctggaatgatttgagtactcattaatttgggagaaatatgagctgtataaggcagacaacatgagttttctgtatggtgttgtaccaggataagcagatcagggtagaagcaatttgccctatcccaaaggggccctaggattttaataagctggttatgaaaattctatttctttgcaatttgaagcagctaattagagcctgtaatttctctcctgtaacgagagtggatgaaggttaacattaggcctcccgggccctttcacattcatttacagagagaaatcaggtaacagttgtagctaattagagcagggtattaaatatttagtccatcttgatttaacttagagaacacatgcatgttgttggggtatggaaaatgataaagggaagttaaatttaatttttaatcaaagataaacttaaaggcagtataataattgtagcactgactaccctaacctgacagccagagcagcagttgcctccagcggtctgaactgtcaagataaaggaagatgatgtcgatttaatttcatcagtgaacacgtagcccaagttcaaacagctgggatttatgccatctgcacaaagtacaaagaactcgatttttattgtagcagtgagattgaaaaaaaaaaagcaccttcttgatgtttcagaattcggagtttgactttggatgctatgagtgcatatcatttggataatagttttggggaactatcctaaggaagatatctcattcataggcatttttaaaagaggatttgtgtctggcgaaactgctccctggaaggaaatcgttgtccaagaggctgggcaggcttagcaacggggtagcattgtgttgagtaaagtctgactttgccataggctgatacctaaactgttgcatgctgaggacactaagtcattcttctcttgtcatacccaattcagatgatcttcctaaagcgggactcagttaagtcaggacatgcatatcagaaagaaattcaccccatgactccttttccctcagggcctcacacaagggtagagcatcttcgcagtgaagtcagttcacaggaaagctctcaggactactgcaacttccctggaagcaggcttttaggaggccagaataatataaaaagggcaaagatgtggggaaaagatgaaaaggcttataaaaatagaaagactctaaagagtaactctaaggcatgcatccctctaacttcactgatttatcttggtgcgtgacaccccatcactaccctggttgtttcatttggggatgctcgaagcatctttgcagatcggtaggaaataaatggcaactcacaaagaccatctgactttgctacattgtcttccagttgccagttattacaaaatggtttctgagggcagtaatcctttggaaatgcctgttattggggataataactggttgtcagagcattaacatcctcggcttcactctgggctattacataacaaaagaatgaactggtggtgagtctgccaggtgtgttaaattatatcatgcattatggaagttcggtgatggggattagcatccagaaaagactatcagaaattgccaaactcattatctgctgaagcaggagactggcctcaggcctagggatgcaaggtttgagtgtaaccattaaggcactacctccagtctttctctgccctagcgtggagacaggaagcacaccagcatttcttctctgttcttcagccgctaaagaagatcaaaaatactgtgttaaccagagtagcagcaaagctgtattgacaatgaatttacacatttcctggacttcttaatggcagaactgctgcttaggcagtcttctgtagtcacagaatttagtggattcccctagcacttttggggtctagattttgttccctggtgcccttaggacaatagagatggatggtgagccttcagaagccatgacctctgggaagctctgcccccatatctcagatacccacaatcactcctagcatttacacatcacattgagcacaggacacattttgggtcagaagttttccaaaggggtgaagcgtgaaatgcaatgaaggttgaagtcccttggaaataagctttgcactgcagacacacagataaatgaggacttgccagttctcagcagctctggatgacccttcgcattgctgttggtctaatccattgttgagatgaactgtggggatggtagtacttctaattaattttcagtagaacatctttatgcccatgagctccttttaatagcacatcacctctataatctatgcttctactcttaagcatctgtacttaagacatgcatgatgtgtttgctacctggatatcatctatatggagttggggattgggtcaccattatattcctagtacctcagagctgcacaggagatcctctgtaaatttttattaaatggaattgagtggaatttttttcttcaaaatacttttcttatagaaaacagcattacatgttaattctagaaaatttggaaaaaaaataaaaaaatagatactgggaaagaaacagggatcacttgttatccaccctcgagagattatggtactagacactttttgcatatatctttgcattatttttccatgcatgtatatatatatacatatatatatatgtatatatatacacatacatatatatatgtatatatatacacatacatatgtatgtatatatatatacatatatatgtatgtgtatatatatacatatatatgtatatatatacatatatatatgtatatatatacacacacacacacacacacacacagacacacataaatgggatcagactgtatatggggcattttgtaacctcttttgttcatttagtgatgtctttccaagtcattagcaatcggctttgccattatttgtgatggcttcatgaaagttcatgattaaatgtactataatttaatccccttctgtgatacgtttaggttgttgtaatttttctgtaatgtgaacagtactgcaacataaattctttctgctaaatcttcatttctttatatgattgtttccttgtgttgatttcctagaagtaggattgctgtgtcaaaggttatgcacatttaaaatatttaatagatgtggtcaagttattttcagaaaacttatgccaatttacatttccaccagccgaaaggatatttcccaatacccttgttgttaacacatcattttcaatttgataggcaaaaaacaaacaaaaatactttaaaccttgtatttgtattggtgcttaaaagtgagcttgaacatcttgttctctgtcttttgtttatttgtttttgttgccatgggtagtattctgggatctgctggttcatgcactttgccctgttattgtgttctcatgtcataatgtagcaattaagaaaatgagctttggggtcccacatgccttgaaaaggtccagtagctatcatttgcctgctgtgtgacctgggacagattctcaccctttgtaatcctcggtttgttcagctgttaaataagaatgatgacagtgaccacctcaatgcagtcgtatcatgtatggtaccaggtttggggctgatgttcaacatgctaggttttagtactttagtgctcatttaatccctctatttcttttagcatgttcttactccttataccatgatggattatccccacttagcttaattgtatgcaataaccttattcatttttggggtatttgctatggattagcagttgggaaaacaacagtgaacaaaactaatatatctccatcatgaagcttatatccatgtgtatatgtgtgtgtgtgtgtgtgtgtgtgtgtgtgtgtgtgtgtagggaacagaatataacaagaggacagacaaaataactgtaaattacaccatgtgctatgcagaaaaccaacagaggccaaggcagagactaaaaagggggacttatgatagataaggagaggaggaggggtcttttggaggtggaaagttcaatgatgagtcctaaaaaataggaaggagatagctgtgttaaaatgttttagtgcagagcaggcaggtgggcaatatgtgcaaaggccctgtgacaggaaagaacttcaggtgtcaaaggaattttttacaagtctagcctgggaagaagagggtggttgggaatttggcagttggggctgagtaggggggcaagtggaggtgagattacaaaacagggaaggggtcaggacattttgacttttattttaaataagggaaggcctctatagagctgtgagcaaaggcggggatctctatcctcttttttgagatggagtctcactctgtcgcccagggtggagtgcagtggcgaaatgtcagctcactgcaacctccgcctcctgggttcaagcgattctcttgtctcagcctcctgagtagctgggattgtaggtgtgcttcatcacacccagctaatttgttgtacttttgttagagacggggtttcgccatgttggccgggcttgttttgaactcctgacctcaggtgatccacctgtctcggcctcccaaagtgctggaattacaggtgtgagccaccatgcccagccagagggactctatcttattcctgttacaacaagctctctctggggctggatagcaatggaagagctcaggtaagagttccacctggttcttcaagtgagaggcattggtggcttggactaggatattagcagaagatatagaagtcacagaatggtattttagcaagaaggttccaaataagtcatttgtttctccactccatgttgttcactaggaccatttttaatactggctgtcattagaaattgcccagtgctctgaaagagtgagtttccaagtggcagataatctggcttctctcttcagtgtaatagggtactagtgacatgtcctcaaacttactcttctaggaaaagctctagtctcccaaaaagccatgtttaaaatggaagattgcagaacttcctgcagtcataagagccattggctttgatcagtccctagtctcccaactgaaggaaacattttgaaaaagtcaactcagttccagcacatggtatctttctcctctcttgattcccatgaaaaatgctgaccctagaaaaacaacaaacaagcaaataaacaaaactatgagggtaaggaaacaagatagaggccagctctcaagactgtttattctcttttaaaatacattgttcctcttggtttgcatttccctgatttgtttgctcccttgcagagcaccctttgccatcatccctatacatttccatgtaagttctgcctatgggtttatagcttctctactgacaggaagctctttgaagacaagaatgatctatgatcccatatgatcctaccttcttcagcccttatctgtcacaatgcctttttctcccacttattgtatgaccagtactgcttaacttttcttgcttttctcttacgtgtaagacttggggctgggcatggtggcttacatgtgcaatcccaatactttgggcggccgaggctatcttgagcccaggagtttaagaccagcctaggcaatatggcaagacctcatcaccacaaaacatacaaaaattagccaggtgtggtggcacatgcctatagtcccagcttcttgggaggttgagatgggaggattgctttgggctgcagtgagccgagatcatgccactgcattccagcctaggtgacagactgtctcaataggaaaaaaaaaagacttggcagagaagaagaaaagaatgtggaggcacttggggaggccgaggtgagtggatcacctgaggtcaggatttcaggactagtctggccaacatggcaaaaccccatctctactaaacatacaaaaattagctgagcatggtggtgtgggcatgtagtcccagctacttgggaggccgaagcgggagaattgcctgaacctgggaggcagaggttgcagtgagccaggatcccaccactgcactccagcctgggtgacagagggagagtgagactctgtctcaaaaaaaaaaaaaaaacaaaaaaaaaaaccacacacacacacacacaaacaaaaaataacatggagagtgcctgcaaggttatttctaggaacaaacagttggggaagacattgggattcttttcacctcaaattttcatcttaccagtgcactatgcttagaaaaggaataggatgattttgcatttacatgatcctccttatcaactggagctggggccatagagtccaagattgcatgtgtcctattcagggaaaccaagctctttgtggggagggtgcagtagcgacccagttctggaatgacaggcccttctcctcatatatgtgtgtgtgtgtgtgtgtgtgtgtgtgtgtgtgtgtgtgtgtggaattatatatatgtgtgtgtgtatatatataactatttacatttagttttatatatgtataaagaaatacatatattttcttcatattcctttgccttccccattctataaaaagtatttcaagagcttacaacttccgcaagggcagagaccatatggattttttcctccccattgtgcctccagcctgcagcaggatgtttagtatctagcatttccagttaatacttgatggatggaaggctaggtgggagggtggatggatgggaaacataaaacagaaaaggtaacacaagtcagttgtcagcagcaaggagaaaaggacaccaaagacaggggagccacagaacacgtagtctccgatggggtatttgagccctctgcttgagccagtttgcacttgcaaagagggaaccaggacagccgtacaaatcactgtctgagagattaagacacaatgattgcttaggataaaatacaacttttactgactgaaggtaagaaataaactttctctggggcttctcaaaaagaagataatggttgccccaaattctcaggaacattgacttgccttcccaccctattcacctgaggctactgctcactgaagtcctaccggcagcttcctacagtagggtcttcagccaggggcgcatgcttccatagtgggagttgaggatcttgggttattagagtccctggaagggcaagaggttggtatacagaaagtgagctcgtacagatcaccaaaaacccacaagtcattctgatctgtccttcccccttccacaaagagctatgtccctacctgtctgccttttggagaatcacaggtaaaacagagtgaacactgtcctcagcaatatccttccagttgactgatgagtccttgacttttcttactgacagaagtcccagaaggcagtaggtgaggtgacaggggaaactgctattttggactaattcctagtgacagggaggatgggttgggaaaatagaaatgacaagaacttgggaaaaggcaactgtgctatcttagaattcacaacagctgttggttttaatgagtctgagaatgatttgggcagaatccaaaactcctgactcctcgacctgtaacctgctgctgtgctgcttctgcagggtggtacgagaggggacactgtccagaggcatgcggcttcttactgtggggctttggccccaaatcccaatgagaaaatcacaaggactccagctgtgcccaaggccaagtgggtcttggttgtgtaccctgatgtgggcctttggggtctcactgatccagaggcagggggaggcaaagggagacaaactcatggtgggggtggatggcgggaagggagagcattaaaggaagaggagcctttctctaaggcctagagggacacacccaggtcatgtcatcaggcgttatactctcagacctttccctgtttctctgttctatttttctctctttagggtctaggcaaagggcacctttggagatctcctcttagaagacctctcttcctttgcagaattaatcctccctgcccctcaagtcccaaacattttactttatttgatccatttcacaacatcattctggttctatgatgttgaccaatttacaagtaaggaaagtgagacttacaaagatcaagtaacttgctgggcaaggtggctcaacgccaccctgggaggctgaggtgggtggatagcttgagctcaagagttcaagaccagcctggccaacatggtgaaaccccatctaaagaaaaaaaaataataagaaaaataaaaaaaaaaaagactgttatttcaccaggctctgcagtggtcctctttgttgtaaattagggatccatgtatgtgttggtctgctttggagttttccttggtggtccactggacaatttctgtatttgtacactaaagccacactgccttaattaccatactttacaataaaccttgatagccagtgagataattgtcctgccttgttcctatttttttaggagagtttttggatattctcattcctttgtattttcatataaatttattttattttttaatttatttattttttttttgagacaaggtctctgtcaccaggctggagtgcagtggtggatctcggctcactgcaaccctgactactgcccccgacaattcagtcttccaagtagctaggactacaggcgagtaccaccacacttggctaatttttatatttttcgtagagatgaggtcttgccatgttgcccaggctggtttcgaacttgtgggctcaagcagtctgtctgcctcgacttcaaatagtgctggggctgggtgcggtggctcatgcctataatcccagcactttgggaagtcgaggcgagttgatcacatgagcccaggagttcaagaccagcctggccaacatggcgaaaccccatttctactaaaaatacaaaaattagccaatgtggtggtgcatgcctgtagtcccagctacttgggaggctgagtcatgagaatcgcttgaacctgggaggcggaggttgcagtgagctgtgatcgagccactgcactccatcctgggtggcagagtgagactgtgtctcaaaaaataataaataaataaataaataaaatcaagtaacttaccccaaggcctcacagctcatttgagggaagactcagattctcaatatgggggtatccaattcttagccctgtttggtaaccactgctttgtgccaacttgtccacccactcagctctggcttccatgaaatgatgccgtctgtccactgttacaaagtgtagggaaaaggagagatttccactgaaagctgcttggaatagcaaccatcacattgctattttaagatgcagtcttttccctactagggaatccctgaagcaggcagttatttaaaatacaattggcttcaatctttgcatggcttccatctagaatcaagaggcaggcacctaagaagaaatattataatactgatcttccatccatgggaggccttgcctaagacaccttttttctggtccctgactatgaggctgtaataacacagatcagagcttttttatacctccatttcctcatatgttatcactgagcttcaggagaaaaagaaatcatgggaactgagcatagagaaagtaaaatctcaactgattgataacagatcagtctggaaaaatagaaaagtattgaaaatagagtcgcaatgaaggaatgagctctatgctgataaattcaagtatgtcccatgctgacttcccttaatttcccaaatttgtgaaaaggatagaaaaggtgggtaactaatattcgttgagaatctactccatgccaggtactgaattgggcacgggtgcctccttctgctctcacatctgtgtttcagcttggaagtagaaataaacataagtaaactaataaaccattaatataacttaagaatatactgagtatcatgaagaaaacaaaatgggtgatgaggatgacggtaactgggatgaaagagggttagccatgcaaacaggaggtgaggggcactccaggtagtgggagaggtggactgaaagtctagaaagccagaaggagttggtccagaaggagaaggtcaggaccttccagggcatcttagctgtggtgttaggagtttagaatgtattccaagtacaatgggaaggcactggagggctttaagctagagagtgacacagccccatgatgttttatgaacataaccattgccatcccaatttgtggaacaattaatttattcccctttgacataagtcaattttctgatctgtttttggttaatttgatggccttacacatgttagtttgactttttgttcatggtattgaatctgtaatccttcttgagagatggggcatacctatgaacaaatggctgtcaccacttgatctctcagtgttttggagggcaagggaagcaggacggggcttctgagccataaaaatcctaggccatgcagtgtccagcagcctgaagcttggagacaggtttgtttcaggatccctagtatcagcagacaggggttttatggtattggccaatcaacaagtgtttgagtgctggccctttgccaagcactgtgctggattctacagactcagttctgtctgtctgtcccttccatccctgctcctttacatgtggtcatgcaaaggcttaatgatgtgatgtgcatcataaaaacccaaggtccacagtgatgcctattctgtctcagggctcctgatttctccacaatgtccctctatgtagaggactcacttctgatatgactattctggatctgaatgtgaatagctgatatctgctctgcacaaaactgtcgcagaatgggcatgtaaatgaccaaatgaactttctcagtttggtgagcacatccactaagagggcccatcttgatcatccaaagaaaccattttgattttgaggaatttatagtgcaaaatacaagagatttataagacaagggttcttaacctgggagccagatgttcttagacagtcctgggttttggtggaggaaatgccccaaccctcatgaattttatctgaaattgtgagtgtatagactttggattttgcggggaggaagtcagaggtaggagaaggtttatagccactgccaagttctcagtggatcctttgactctccaagggttataaaagttgtaattgttattatagctctagtgttcctgattatgttagaaactgtcaaccccattatccttggatggcttgtcaaaacccacccctgtgaaaaatcccattcttcacccacaggagtcagcttcctcttcaaccaaacttctgggcaggctgagggaagtatctatggatggaagacttggctttccttggctccctttgtttagtttcactgcagcaagttatctgaaatgtgagtgggatgcaactctaactgaatgggatttggtgcttctggcctgtccttgcatccattgtctcatttgctgttgatcaccaatgtgaggtgggtgggtggaggatccccatgttgggggaggtgcatgcacagctcagtaggtttaaatacctctctcaagatcaccaagccagtaagtgtagcattgaacccacctggaacaaataatacttggtcgttttaagaatacctggaatttgttttagtcaggtataataaggcacacagacacagaaatgattgtcatgaaggaagaagtatattgtatccatagttccctagaagcagaaggcatgccataccatgaagggacacacagggaagtgccaaggcaagatgagtgggcagagagagagatctagagggcaggagcctttattgtgttttccatgggaagaaagagggaaagcaggccaaccaggcttagcgttggacagtcaatcatctcagtgggcactggggtagaggggctgccccgagttgtctgatacctggtcctggggtgattagggcaggtggtatgacctcgagtgtgagagcctgatgaagggaggtgattggaggcatgggctgtggattggttggtttgtgtatcagaaatgcacttgcaggccagttgcttactatctccaggaattagctaaccctaggagggggagtccctccaaggtcataaggcctcagacatcagagcaataatactacagaaaaatccaaagacatggttaatacactggccctgtcctctgaatgaattcagtggagctggatagtctaataaattgcatcacacacctttaaggatgtttgcagcttgacttcttactgctccattgagctgtatgtaatctcgtgttccattgtaccaaccccaggtcgtagtctctggatggccaagaaacacctgtctccttcaccttaacaaaacacatggccatagaactggacttttatccctttggccagaagattacaaagaataatttttttttctgaattggaatttttttttcaataccgcacttgaggtatcaggcacttgtgcttgggaaaaagagattgtatagactcttagagcgtccctaaggtgacagtccatttttcataatcatctatgatattcgtttgttgaaattttattacttttgtaatttaattcaatttatcccattttattgctgttcagggtagcgttaccatggttgcctttctcttccttctggataaggatgtttcttcttttattatgagcgtgatggcttatagattaaagcagcctgctcaatataactgtctcctttggagtcaaccttctttgagcccatctctactcttgtagaattttcatgaagataaatattggcagtgatttatgaagcatttatgtgagtaatcaggttccaacccttatcttctgcttaaagattaaggattttattcagaaatgcttctctgtaccagaaatcatagaaatgagcaaataacaatgaaagttggttagtaatatcttttgtgaagatatagattaagaacatattcattagctgcaaatggactttaaaacataaagatgtcaggagacccctttctaaagctgaagtcattcatcattttgagaaatcctggaaatattttagggaataactgagttgggcagtgagtccaaaaggacatgagcaggtgagaagacaggaagatgtcaggaaggcatgcctaatacggaggctgccacttagctaaattaaaatttagaacccatgaatgtgggcaccgataggtcatgaagagatttggtagcaaatgacactgacataaataattcatataacttgcttgcttttaaaggtagaaggaatggatttgtagttaaatgttttttaaaataaaagattaccttcttttttctataaaaatatagactgttttttgaggctcataagtgcttggtctccaaaccttcctttcctctgcatctgggagcaagagtggaattattataattccaaagattgtgaagacccagctcagcagctacagacagctgggtacagatctgccctttcttggggaaagaggaaagtatagttagctaatcctgcttgccaagtctggctgatgtctcatgatcctgccttcttcggttgacacaagctttttaaaaaatgtcattttgatccagcttctctatttttttaaccacccactggattgtaaactccttaaagttttgcctcaatctttagtaaattgtaggaatagctttcctggaaatggctccagtgatttcttaatgtttggtctcacttagacctcatctgcttggtggcattttttaaagtgttggccacagcctacctgggtcagaccccacggacattttttaaaatgtatatccctgggcctactttattctgaacctcgggagggtgggtgctatgactccaccttcaacatgtgattcaaggctcctggtgatactgatgccttgtgaagtttgaggactctcactgccctggccagagccacagtcatctctcacctggaacattgtagtggcctcctacttactacctctgtttctacccttactctctatggctgtggatgggacatgggcattcagaattataagattatcataggataatggaatggacagccaggttgagtgcactgttcatggcctatgctctatcctgcagccagaatgatccttttacattatgtatcagctcatgtcagacttctactcaatctctcctgaaaaaaaaggaaaagtggcttgcagggatccacatgatgtggcacccattgtatctccaagttaatttcctgcaacctctgctaggtgactgcattccattaacacgagccccttcaatatccctggagcttccctgtcgcagggaccttgtacctttggttcccttcacctggaatgctctttcccattagctatatggcttgttccttctcccccactccattttgtctagatctttgatcatatgccatcttatcaggaagaccttcccatcttccttttctaaaaatgcagcccccatcactctccatcaccttactttgcattattttctttatcagcatttaattcaacaaatacataaacattctctatgaatttgccatttattatgtttccctcccaagaaaatgtgaagtccctgagggcagaatttgttttgtttacccatggtagccctggcaccaagaatggtccctggcacatagtagtcactcatgagttacacgtgatagatgacaaactactcctcttggattctctcagaaacacaagctttcttcattattgaagggagatgtgcaggcagcagcagcctattttctgtctgtgcaattgccccatataactctcctggtagccacttccttcccctaattttaatggctgcagaaaggagaaaatttgattcattatctttacagactatctatcttcaccaaaggttaaaaagaagggtacccctctcagtttctgatagggattgcttctatgtgagtaaaaagcataatcggttttttgaaaaaatctggatgagttttttgtttgttccattggggaagttttatactaagtagattaaggtaagtgactttgaactttcaaagtctacatcttaacattttattaagcttaattgggtttgtagaacatttaaagaccatccaaacttaagtgggagatcaaaatgagcgaagaggctgatgcagacttttttttttttcacccctgcctttgagctgcattaatgaaagtggtgcgctccatgcctgcagatgatgagcatgaaagcctggctttccggggagctctggtgtattccagaactatgtcacagcaccttcccatggttgtctgtgccgtgcacctggccttcaggaccaccccagatttggctctgcttcacactccttgcatctgaaaagtagctgggctcaaggcagaccactgaaagtttgttacgtggtgcttcctagggaagaaactccagttgttggaaataaaatccattagggtacagaatctgttaatgatggaaattaggagcaatttgactgttgttcacagaggttttgctctcagttaaatgagcagtagcgtaaggcagtactaactggaatatgcaaggccaggacttaatttccacatgtcatctcttttttgtgtttgattttcactgaaacatttattcttcctatgttgtaacagaattgttcaggaagtagcaatgtcattactttcttttcacttaaaatgatctttaattattaaagcaatgctagtttgtaaaatggtataaaatttatgaagtaaaaagtatgaggccacttttagaaaaaaatagaattttgtgctacacaaaacccacaacttgctttttacctttaccagtacatcatggatgaggacatagctgctgggtagcccactacacgaatgtaccatgaacttgtagccagtcagctatcaataaagacttagaatttaacagtttttgacctttacaagtaatgaaggtgaacatccttgtacttttaattgtgtatttttgaaaatgtctaaatctgaattctagggcttccagaaaatatgtactctcttctaccacttctgtcctttttgttacctcttagtccccataagcattttatttgttattccagctataagataaatgcctgagggtggaattactgtgtgaaaaaaaaacctgcaaatataaaatgctattattaaatttctctccaaaatatttcctactttaaagtaaaatctcttttcttctgtggtcagttgaaaggcattactgtgagagatgtaggacgtgaacccagcatcctttgattatgtttattttgtaggcagacatgcaacaagtcattttcatgccatttctgctcagataaggaggtcagtgtactgggagccaaggactacaaatcagtggaaatattgaacattattctgattttctttcataagcaataaaataacatacaaaccaatgaaacaaatataatacccataaacccctcagtacattacctgacccaggggatggtgctgattgtagcagccacagtggtggtggtggtcgtggtaggactgtgctggtgaggtaggggacatggtgatggttttcattattatggttattgttagcataattattctgaagcagccatgtctgatctgaagtttggcacaattctactggttttccaaataggttgccatcttttaaattaggagttgtagaagttttgctggtgattcacagtattgttctggagttttaactatgtctccaagagaactcagtttatatgaaggctcttcgtctagacagcagaggaggctggcactcacagccacttttgctcaaaaatatgggttgttttgtgttgggtctttgcttatgaagatagactcatagcttcatttcctcagaggcatctcttaggcttcttgcttgccaaggagccagtggggatacaagtttttgtcggtctagtgtttcccctttaaagagcttaaatttgaaattaaagacaaagatttatgagaaagcatgggtctggtctcaagagacttgattccagttcatcctggattctgtgggtgctggctctgggccttggagctggttgggatcttctgtattgaccaaaccagcatctcccaaaggttgaaagcagataccagtgctatcctgaggtcttagaagtcttctctcatgagctgcaactttgatgaaatgaagcaaaacacttaactgggcctcagtttctcccctcaatcagagattctcagttaagtgccgacagtggacaggcagagaaagtgaacgggggtgcagctatatgaaggagggtcagtggtaatcacttttggcaatatgaggctggatctttgctttttttttttttgacataggccctcactctatcaccaggctggagtgcagtggcgcaaactcggctcactgcaacctccgcctcccaggttcaagcaattctcctgcctcagcctcccgagtagctgggactacagatgcatgccaccatgcacagctaatttttttgtatttttagtagagatggggtttcaccatgttggccaggatggtctcgatctcctgacctcgtgatctgcccacctcggcctcccaaagtactgggagtacaggtgtgagccactgcgctcagctggatctttgctttcttttccccccaagagaagccagaatctcccaatttaaaaaacaaaacaaaacaaaaaccgtatcctcactcccaaatgtgactctgatgggaatggtgtggagaagagccagaggactggagagaggtctgtctgcctgcccatccaccccagaaatccccttgcaggagctgtgataaataaagtaatggccttaccaagcacagatgagcacagactgacattccataataataacgtgcatttacatatccctttaaattaggaagaaaccattacctcacaactagccttcaagttataatgcccagattagaggatatgcataattaaaacagaatattcatttttataatccactgtaagcgttttttgtgttttttttaatctcttcatgtattgagtatcaatgttccaagtgcattgctccatcagggcccagccaggtaaaggagacacatcccttccttccctagtcaactggatactctagtggagcagatcgacttcacagaccagctacacaaaatgctagctaaccacaattgtagcaaaggctggggaggagcaataggagcacttgacccatcagactagaggagctggaaggacatcacctggtaaagcctttgataccacctgctgagtgtcattcatctaatgccatgtcttcactgacctcagtcacaaagaggtggccacaggctgcacatggcccatccgaagggttttgtttggactgtgtggcattgacccacataccattttaaattgaattaaaggattttaaccttttcattccttatctttcttccatttaaccttaagtaccatctggcaggtaggtcatgctttgtttcaaagagttctgacctcataagagagggttgagaaaccagtagaaaataagaaagccaggtttttacatttgttttttgctcttcaggaaccaaaagcttaggaagactagaaagagtctccatagatctcctggccacaggctgtgtctctcatcccagttaattatcttctaatatcatgccagacaccacagatggtaagagagtgtctgcagcctgtcctcaccattggagggaaatgtcgagggtctttcaggggcatttttattcccaagaagagcacactctgcatttcctgtgtgaatggggaaaatgcttggggatttggtccagacttagatgatccttgtccatatgtgtggagcaagcccaggcctgtgaggctgccagtctcccattcccagttattctcttctgttttgacttgcgcaccaaaaaacaaccaccaccagtgccatatggtttaaaagatcaaaggccccaattttgagtacatttctagctgactatacttcagatgtcttaaatatgttcctgcagatgggaagcatggagcattaaagaggtaagccacatgtgtgtgagccatgcatgtgatctgtgcaggatggcgaaaagtgaatgccgctcagccatgcgtttgtcttcccttcaggttcgcatcttcacatacctcattggacgagaggctgcgtttgcagacaatctaaagtggatggcctgtgccaacaaaggtgggtcttcgcattgtgctcggctctgaataacttccacctacttgtgcagaattaggaatattcatgagaaagtagagagttctaataattctaagataaagtctgggtatatctaagtgattactgatagacttgtaacggtttcttccaaattatgttttttttttttctgttctttttttttttattttttttttgtggacagaatcttgctctgttgcccaggctggagtgcagtaacgcgatctcagctcactgcagaccacgcctcccgagttcaagcagttcttgtgcctcagcctcccgagtagctgagattacaggtgtgcaccacaatacccagctaatttttgtatttttagtagagacggggtttcgccatgttggccaggctggtctagaactcctgagctcaagtgatctgcccaccttggcctcccaaagtggcctcattacaggcatgagccactatgcccagtgccaaattttgaggacatagtcaagtggagtggttaagcctttccactcttctgcttagtagctgagtagccttgggagaattgctatggcagagacatttactgtgcatcaaatatccgtatgctctctcatcattcctagccttcttgcctataggtggggcttcaagactggttctggccaatagggcgggagtgaaatcaacctgagtcatttctgggctaaagcatttgagagctagtgtggtggtgttggtactctcttctgctcttgtgaactctgaaggtacatggtccagacagaacagtcacgagatgcagcagccttcatcagcctgggtccctgagtgagcacatggagcagatgactttcactgccccttgcatctgccaacccacactggattataaatagtgttcatgacaaataaacttttatgttaagccactgagatttttagtttgatatgttcttatagcataactttacgtacattactaattaagttggtcaactttaacttgcctcaatgttctaatactcaaaatggtaatggtaataataattcttcctttaattttttaactatcaaataaaattatgtatatttatggtgtagaacatgatgttttgaagtatgtgtacattgtgtaaatgactacatcaaggtaattaacatatgtattgccttacatctttattatttatttgtgatgagaatacctaaaatctattcttttagcaattttcaagtatataacacattgttattaactatagtcaccatgttatactatatatctcttgaactcatttcttctgtctaactgaaagtttgtatccagttcttcctttaattcttattaacgaaatggtgcatattaagtgcctcgttcaatactaggacataataagtgctcaataatccttagcttttttatattcataaggttaattgattaccaattccctgttgcatgtcagaaacaaatagtttggggacagcactgggaaggaagtaatagggctgcccagtctgtgaaggccttcttttcattttacacatggccaagaaggcaaagcatagcaagttaatagggaggagagtccagactccttgtatccaagtcgtatccaagtcgagcagtcactatccaccaactatgtgcaagttaccaaacctatctgggtagatctgagtcacgtcatctacagagcagaggtagtgacaataccttcccctcacacatgttgtgggcatgacatgatgccatataaataaagttggtagcttggctctggtatgtaagtgccctgagttattctcttgtgttatgttgatctctgggtcctgttggcctcccttctgaggctacaagctccatgagagcagcctttgactcttatttcatcttgggtgctctgacacagcccagcctcgtaccagagtgggtgctcctttgatgtttgaaaaaataggtaagttgactctaagtactaataaaggaaggtaggtcctgttgcatagtagattggttcagtggtctgctttaaatgggtctcctaagccatccttcataaaagttccagtgtttggacttcagtggagaaaagaggactcagtgaagggtttgtgggtcttagctccagttttgatggcctaagacaaagttgttttaggtgcaagccaccaaagttgttccctgaaattaaaaaagggggcattttggagagaggggggtgactgagaactctggtaggaagggaagcttgggtctcacaagggagaaggaagacgtgtttgtgtttttctgttccttctcagtttcttctgacatgtccatggcattcttcttccttgtagatagaccttccgtactatggcatgcatacagccaggaatggccaccccataccatgcatgcccatccatccacgcaacaatactgtgggcaaggcacaatatcggaaaggagtatttatatcttttccgtttgaggctgactagcaaatctaaattctgatttcacgtccttctcctcacccctttgaagagattatggtacccagcttgggccagttcttcctccctgctgaattgggggtgggcagaggaagcccatggggaaataaatgcttctgtgggggggctcagcattgtggatgggagtgtgggaaagttctccaagaataggtgaacagccaggctcttaaacctgcacccatctttccctttgcttggcattttctttaattatctgcttctatttgaacagtcttttaagcaaggctcaatttcctcatctacaaaaggaagggctgcatggaagtttttaacatatccttgaagctctaaaataacaccttctgcaattgtgtttcgttcattgtctggcttgcttcactaaaaggtatcaataattctgcttgtctcagagttacacatttggcctcatttcagggagaactataggaagaacacaggcagaggagagggaggccgagtagatcccagatttcctctgagtgaagaggcctttcttgaaattagttttggaactttgttgacatttaaaaaccttgagttagctatacttttcccattttttcctttattctgtggtcttgaaaaaaagagttcctttccattttttaattttttttaaaaaaatttgctgttatttcttgccacatcagattgcaattcttccatcagctagtatgcatttagtcatgggttattgtttttaccactgtctgtgtccagctgatgaaaattactgaaattgaagtcttgtcttaatcaactaatattacaccataatttagttttagtcattgtttataagaatctttgaggcatccttttgaagacagtttagtcaactcagagtattttagggcctggctatagaatatagcctttaggatttataagttctgagtacagcagtgcagaaaatccagggaggtaatagtagctgcttggctggacaggctgtggattccataataattctccttcccttcctgtctacatccagttatttcccttcctaccagagtcagcccttcttgatcgtttcatcttcctcattctgcttctatgtaaagagccttgggaatgtcactgtttgccactcttcaaagtagcaatgccatcaaaatgtgatattccagtcatctgtgcccatataaacattggcttcacgttgcgtcagttaaggggttttggaccatgtaacatcggtgagcaagtattcttctatggtcattaattaaatcattgtttatagtctcagattgttatagtatggaggcagcataacatttttcatctcaagtgtcatgaggtccagagggcccccttacatattttcaccctgactcagccaagttctgcagtgaaatgaagcattagcattcagggaccagagcagacccaaggagcgtcgaaggaggcagaactaacgcactgggcctgaccacagaatgaccctgggagggagcaagaatcatgagggctctcacgttgtccctgagttagtggtcaaggacctgctatcagtgcaggacttcttccttgggagtctggtagccatggagacagttcttagctagcagatctcagacactttcctctggaaatgaatgtctggggacattcgtaccccttgcaatagttctctgcctcctccagtctaccagcaaaatccagggaggcctggagcttgtgagtttatttcattttatgcataagtaggtcctgtcttgagggaaccaaccctaatgagacaaagcagcaagccattttacatacattaaaacaatcattaccactgtagaatggctggtggaatttaaagttatgcgttcacactatttcaaaaataagcgaactggaaaacagaaaagagggccgactaccgactagcccagacatttcacaaagccatggtgaccttctctaacattcagtatgccaagattttaaataagcactggctgattctccttcagaaatcacagttaatggagtgttttccagctgtgcaaataaagaagggcctccatgtttgggttctcaaccgatcagtcatcgtcaggtccaatggaaatgccacatgtgttgtcgtctgcttagcttaccccttttccatgggctaaaggtcattctctccttatctgaaagagaactggtggcctgagacttcctggaaggtccagctcctaatcttttttcaataaaaagattcttaacctcattatatctttccacatgtagtgtcccccaaaagatagcttcacatttatgaggccggaatggtcataggcgacagcaggagaaaagtggcaattaaaacattttgctattttaagagaggtgaaggaaggcacaaacagcagctatttaaatacctttttgtagttcattgcacacattccttagaatcagagattttgagtgggaatgaagatggtgatgcttgctgttaccgtaaaacagcaactaaggatgacaagctgctcactaagtgccaggcatagaacagagtacatctgtgcattacctcttttgatcctcccaaaggctctatgaggtactgttatcattatttttgtttacagagaaggaaactgaggctgagcaagactagcaccttgttccagattaccagccagcaggcggtagagctaggatttaggcccaggtgatccaaagccccagcctgaactcttcatcagatgtaaggctgcttctctttggagaggagaaagctgtgattcatagagaactcttacatatctctcttcatttgaggtaatctaggaaaagaaaactagagagtgagaaaggatttcaatgtgccataattaacaaaggccagagctgggatttatgcccagcctgtatgttctggaaatggcactgcttcagcttgcacagtggtatggttcaggtcctgatgtttcagagttggggacattaaggctgtagataagacgagaccaggagaaaccacagcaaggtgtgatgggtgtagccacagagctataagaaggagacagcattcctatttccccagtgtgtacctttagattgttttcttctttttcttgtatttttaacatggagttagaaattaaaatgtagtcatagtcacaaaggaaaagatgtgtcccttgatctgaggctcaagctgattttgagagctctgctcaggagtgcggttctcccaccaagaccattgggctccctgccctcaatgtccattctctccaacaccatgaatatgggttcttctgctctcagcactcaacagacctcttgcttgttttttgtgaagtcagagaagacagggaggtaggaagctgtttataaattgtacctttttctatagaaataagtgtttttttcagtagtgtgtgatcttgacagggaggaggaggaagatgacacagaacacagtattgggagcgtcttccaagaacaccattgctcatagggaatgcaaaccagggaagccacagcatcaccttcactgccctgctaaatctcattcttacctcggcaccctctggagactgatattttggtgctggctctcaggttttctgcctgccttgcttaaggtgggaagagtctttggaaagactcaacaactcaaaggaatcaaaggaagctacacccgtcactccaaagatggaaggaggacctcactatttgaggtagacagctaggatctgcccactgaggacagactcctggtacccttggatctggtcattgcaaagtggagtatttaatgattcaccacaggagcttctcatgctcaggcagctttgaggcaaaagactctaaaaatccccaagtaagggtaatatctcagaaacacaaagcactgcgttgcatatggtttatcacatgcagtatttgtaacccagagttcacagaaggagctctgcaagggaataaggtaaataaattgatgttatagagaaaaacgagcagaccatttgtaataggtggctaacttcagcattaattgctccttggtaattaccgaatcattgctgattctgttttcttacatgatatatgaggtccaaaaaagcacattaaaaaagagaataaacattcaagacctagaatttaacaggaaaaaaacagagagaaaggggagggaaagtggccagctgagagaatacagagggaaaacaagggaagtgtctatggttacagccagattctagcccttagtgatttcctattatccatcatttgttaactaaaacttatactaagacatttaaaaaccaaaaaaaaaaaaaaggctcagaaagattttaaactttaatgagttggaatcaaatgtgcataagctttgcagcatacattgttattgtcaatattatttttaaaattttatcttttcttacctttttatacatctgcatccctggtctacatagtgaaatataagttggaactatagactggggtttgagtagatctttgttgttgctcattgctcaaaggacagtcatatattgccccatccccatcctcagagttccccagctacaatacgcaaatagcccattagagttaccctcctgggggaggagctctgagctgctctcctgtcccttcccagcagcgaaagaggcagtgtcttcagtggttcagagcaaaggctttggaatcaaatgaacctggattcgaattcatccaggacaaattactgactcagagtttgtgtttcttcccctacacggtgagcacatgctttgggccattgtgaggcccacatgcagaaaggcaaggtggatctcagtaagacctcagtgaatgttcccaccttactaatggctcctgcataccttccctccctgttcttggaatattgctcccaacaaggtggggatttttgaatcatttcgtggagctaatattccagttagagagaacacaataagcaagtgagaatccaatgatggatgagtcctctgaagggactgatgcagggtgaagggagaggaagtgacttcagacaggaatgtcagggagggcctctctgatctgagctgagccctgagtgacaaaaaggaaccaaacatggaaaatgggataaagggtgtcccaggcagagggcagcaagtgcacaggccctgaggaggggaacgcagttggcatgtgagaggcggggaaagaaggccagcaagcctgaacagtgagcaagagggagatggcagggatgaggtcacccaggtaggtggagccaattcagggagggtcttggaggtcagggtaagacatctggattttattttaactctaaatataagctattgtaggatttcaaccaggaagatgatgatttgctgtgacctcttagacaatctctgatggctgtgaggagcctagacaagggggagagggatttgtggggagactcttgtggactctgggtgagagatgatggcatcttggagtagtgaagcagtggagattgggaagtgaatttagatagattttagagataggaccagaagaacatgctggtgtattacatatggggtggggtgaggaaaggagggatatggaggataattatgttttggcctctctgggaagtggtgccattttctgagatgagaatgaccaactgggagaggaatggatttgggaagtgaagtcgggagttggctttggatgcattcggcctgagaatcctgctagttatccctgtggaggtgtcgggtatacagttggccgtgggtctgtcgctctggagagaagtcagctttctgtaatctttcagaaccttggctatgataagcaaggacaagtggggatgatttctcagctctgtccttttccaaatgtatgattgttttcccccaactccctctctatcctaataacctgtccctcccaccctcctccttaaattcatctttcttcccttggcactgtttttggaaaatccaaatcagagagctttactgctggctttgaggattagatgtgaatacaggcaaccaagaagaactcctacaagatcctgtctgggcccaagagcacaggcacctaaacagaattgtttgacactgcaaagcactcatccctgtatccttaaggtctggagctattgagttgtgtctccctactttaccatggtagcacccctcttagcttgtcctctgtgtcaagaccccttaacgcagagcccaagatttgcctactaaagaagagatgaaatattttctttcttatcaaacgctgattgcagcctccatgcttggagagatgataactgtgtatgtggcatgttccctatcctctggcaatcctttttaaaacctgtcctttccgaccatgcctctaagaggaaccatctaggagcattgctagagcagcattccaaatgggtctccctaactatggtgcctgatggctgagagaggtgaacataggccctgctcccaggtctcaaactaggacagaaactcacagcctattcctttggggccctgtttcccctgggatgggaaaggctctgacccaggccaggagggtggggcaggcaggagtgacaatgcatgctaattagcactatgcagagctgtcatcaggaacccagaagccacatggtcccaacctggtttggggttggcacaccaaattcaaaccagctggcctttgtttggaaatcctctgggtgggtcccgaccctttctggacaacagcagggctggtatttccttaccctgagccctattttagtcactaagagattctataaactctggagctagtgctgtgatggagctggcctcagaggcacacatactctctttaatttgtttggcgagtaggaggtggtatgagcctaggatccttatttagaggcacggggaggaaacaagaatctgtgtccatcccctgcttgaaatccttccctgactacctgcgtataggataaagtctaaactctttcccaagttctgtgtgacagtcctcctgcccatttctgtcatcttatgtcatcttaactctaccctctctctaccaactccttaactccagccattctgagctatttttagttcctagaaggggcctgcttctctctgatcctgggtccttatttatattccttgttttgctggacaccatctttaatcccagttcctctggctaactggtcctcatccttcaggttctagctacactgacccttgctcaaggtaaccacatttgattggctgtgcctgttgtaagttttagcttaatgttgaatgtgccattttgtaattgtctgtttactcagaactgccaggccccagggggggcaggggtcttgctcaccttgttaatcgctgcttcttcaatgctaaacacaaaggaaaccttcaataaatgtgtgaatgaagggctccctccaagggatccaggcctgtgttcagttcaccctttcccttttaacatctcctaacccacagcaaagctgatgtgaccccaagctctacagcagtacaggaacatagcagcgccctggaactaaagaccaaaatagtgtcaccaatcacaagacaacagcatggtgagaatgtttctgttgcttagaaatcatgtctacctggctgggcgtggtggctcatgcctgtaatcccagcactttgggaggccgaggcaggcggatcacgaggtcaggagatcaagactgtcctagctaacacggtgaaactctgtctctactaaaaatacaaaacagccgggcgtggtggcgggtgcctgtagtcccagctactcaggaggctgaagcaggagaatggtgtgaacccgggaggcggagcttgcagtgagcagagattgcaccactgcactccagcctgggcgacagagtgagactccatctcaaaaaaaaaaaaaaagaaagaaaaagaaatcatgtctacccaacatatttaaaaggcagcactggggaccacatcatgatatgggctgaaattttagcctcaaacatgcaaagggcaaaattcagtagaagtaaaagggacaaattaagagacttacaaacctggactcatcatctgtatttgctacttgatgcctgagagaacataggcaaaaaacatatcccccatctgcatcggtcatcttatctttaaaatgggcacagtcatctgcacttaaatatgttgtcacaaagaaaagggacaacgttgatcaagtgtttagcaaattttatggcacctagcactcaaaaattaatcataactattattgttatgtttataaaaatgaactagcctttaatttttatggttcctagtttttcccttggaaatagactcacaaaaatgaaaaaataaggttacaaaatatcatgtagaaagaactgtcatttgtaccagggaataaacacacacacacagtatgtctgtgtaaacatatactgtgtgtgtgtgtgtgtgtatatatatgtgtgtgtgtgtgtgtatatatgtatatatgtgtgtatatatgtatatatgtatatatatgtacatatatacatatatatgtgtatatatgtgcatatatatacacatatatatgtatatatgtacatatatatgtatatatatgtacatatatatacatatatatatacgtatatatatgtatatatatgtacatatatatacatatatatatacgtatatatatgtatatatatgtatgtggggggggggggtgcatataaagttagggaggatattctccaaagaattaacaggaacttcctctgggagatgagtttatggttgattttaattttattacatttgcttgactgtattttctaacatgaacttattactcataaagtgggtgatcggggagaggagctaacgttgaaaagaaaaatgggggagaggagctaacattgaaaagaaaaaagaaggaaactagctagagggcaagaaggcatggcatatgcatattcccagttgcaagtctttctgtctgttactaaacttggccctcccttgggttttgacaggattttttacccagatctccaccttggctgatgtgcaggagaatgtcatggaataccttcacgtgcttagccggcccaaagtcatcgaccaggagcatgatgtggtgtggaccgaagcttacattgacagcactgtgagtccacggggccctgggaaagaggctaagctttacccccatccccaaattgtgttaattccagaaaatagcaactgtatcactcttattttttgtgttcagtgacacttttcttgattgtttgtatagtgttggtcaccttgacaagcaaagttggtgaaaaatcataacgtactagaaagtatgacacgtacttcagaaaggtagctggtctgcacaaaagaaatcacgttttgcttgtcttttctcgttacttctgtcccactttttcacatgtgttcaaattctgtcagtgtagcaatgattacaagcattcttagattctgtcctcaccatatatgagccccagtcctggcaatgaatctttgtgtctcaattgggaatgtaaccaaagctcagctctaataatgaattggggccaccatggaggctacagttgcattttcttcccatgcataagtgagaatatgcttgaatggtggttcagtaggcactggattgttgtttgaactctgaccatgggcccattctaaagccgaattctaaacagcagattctgatgctgaattagctgaaaaggaggagctttgccaatcatcaagtaatggctcaatggctgggtttcttatgtaatctcagggtgatttttcatagtgataataagtctgatgggagtggtgtttttcatttattgattgtaagtgttctcacagggcctctctccagtcatttttgttgggattaacatcacattaatcactgtaacccagacacagctgtcctccagagtgatctcaatggctgtcatgggtcagcttttctctccctgggctctctcattcctgctgcacttctggcagctacaggcaaactcagggcaggaaaagcatgtgggaactcatttcaggggacaccatgacacaggccaggccacagcagcctgccccatctcagccttaaagtatgcaatgcggccctggaaataagaatgtatccccttgtcaaaaagggagactccttccccaggaaaagtcatcttgaataaagatgaatgttgagctgaaaaggcttctccgatgctagggagaccatgagcttttatcagcttgagtctgtccccagtttggttttaaatcatggaaacaaaataagctgccccatttatgttggcaccatattaacaatagcagccatggtgataacttcatcttttcttgtatgttgttgggtaaggcaggaaaaataggagtgaggaggaggaggagtgtggctagctagtattaaagtaaccaaatcactcagtggttttgtgtacaaaccccaaatagccagtttgttcagtcattttatttgtttcatcaatttaaaaaaatataagacacagtttctacaattaaaacattatggtagtagcacctggacagacagatcagtagagtagaaggtccaaaaaatcaactacatatggggatttagtatataatagaggtgatgtgtcagatcagtggggctaagatgggctttgtaatagatgcttttgggaaaatcagatagccatttagagaaaaatagaattagttcagtcttcacatcatacccaaggaagaaatccaagtggatcagacgtctaaattgtaaaaaatgaaaccattacaagcagtagaagaaaacctgggtaaattcctctgtgacctggattctgggaagactttaacaatgactgcaaaatctacaggcaataaagagaaagataaataagtttgactacaacttatttatcaacaacaaaaaaaaacttttgtaagccaaaaacacatcataagcaaagccaaaagacaaatgataaaataggagaaaatatttgtgacacatagtacacatgaagaattaataatctccaatatacaaagaactttttaaaattgaggagaaactcccaaaattgctataggaacaaaatgagcaaaaaagttgacaattcacaaaaaagaataaaaaatggcttttaaacataagatgtacaacttcataataagcaaaatgcaaattaaactataatgagataccatttcacacccatcagagtggcaaaaactaaaagcttaaccttgcactctgttggtgaggctatgggaaaagggacactcttattcattgattgtgggaatgcaaaatggggcaatctctatggaagttaatttgcatttaccctttgatccagcaatcttacttctaagaattcaaccctgaagatggacctttaacatcacaaaaatatatgcacaagtttgttctttgcagagcagcttgtaatttcaaaatatgggaagttacctaaatgcccaaacataagagattgaatagactatggtacctacacctaatggagtcaatattaaaaacaagaatgagaatgacctgcattagttgatagagagtgatttacagaatatacttctaagtaaaatgagcaaaatcacatatagcatactactttttgcaagaattatatatagcatactaccttttatataggaaatgaggaaaaaagaagatagatatgtaattacttactttacaaaaaaaaaaaagaaaaagcaaaaacaagaaacagaataaaccagaaaccaacagaactggttaccaacagaactatcattccctccccaagccatcttctctgcaccacctcccacatcttattaggatatgggaggtggtgcagggcttggggagaaaatgacacaactctgagtatacctttttgcacagttttgacttttgaaagcatatgaatgttctgtgtattcaaaaattaaacaagattggggggaaattaaaagtgaatgcaaacagaacaaaatgaatccaataatatttcaagtgaataaaaaatttctcagaaagggaggaaaaaaactttagaatatagtagtacacacaatattaaattttgaacacaatactttcactctctacccctcaatctagggaggaaaagagaactgcaaataaattctaaactccatttggtgtcatttgtggtaatatggttacagcaattctgaatccattttgtgagtatggaggtattgggcaaatgtgtaaatgctgaagacaggggatctgcctatgggattagacttgattggaaaatcccaactctgtctttctaaaggacctataagcagtggcacccaagtagcaatgagcccatccagtacccagattctggcttctaaaaaacactccccactaagaggagccagggacccttagagtaattgcttattccagggctgcagcagagaaggtaccaaataataataatgatgatgacaataataataataagcttggaatattttgtgccagaaactaaggaagtgctcaaaacaataatgtggtcatgtcaaaaggacacaggatcagcatgaagaggctctcattggtcaaatctgggacaatttgagcctcaaaataaggaatgacaataatggtttgtaacttgttgaataaaacagaaatccacatgtccttactgataataaataactaaacaaatcccaaacagatgaaccagatacgtaagtcagtgggtgagaagagtgcagtgtatgatggagtgctgactggcaaatgaggagggagtgatggagttggaaaatcactattttgcaaccattttggtaaagaccagttagggcaaaggtctgtcaatggatgctaaatctagggggaaagttcgatgatgagcagggtatttttatgacctcaaaatgcttccctagacttttcattagtcttgagggggaaaaagtggcacctgaacagtgggatactatgtacactgtcttagtatactatatattggatgaatctcagcaacatcttgagcgggtcctcaaaattagcaccaccaatgagaagcagatggacattgtgtgcctgcagagaaagacacatcacacttatgtattgttttgaccagggacacataacctgatgctcacggcagatataagttcatgaagcagatacagctttgcattaatatgatgccttgctttaggtaatgttcagcacttaaatcggttgttgtattagatttgctaattacatacagatataggaagttagagggggaacccattgctactcaaacttttgcgctgaagtacttttgtgaccacagagccaaaatatatggtctggggcagatctgggcatgtagttacagaggaaagtctctgaagtcttttgctttatcttaaacatttgcacaaattttacattctgtgccataatcattcttatttactttaaaataacatttcacgtggcccattactaagtaaacttggtatgccaagatgacagagctcatttattctacttcttaaagaactctttgaggttcataaaactaaacccacaaaatcaggttatccctaaaatgatagcccaacattgttgctgtgcttcccaaggttctgttgctgtatctttgcaaattgccctaataaatacatctcccggtagaatgttctgagggttccttctcctcttcatggtgttgagcaacctgtcaggccaggaagggcactggggagtctgtcttcctctttgttaggtctgccgggtgaagagaaggcagctgctgcttcaacaggtacctctgaccaggaagcagcagtttcttccagctccttatgtggacctggattctgccaggacacgaacaaacaaacaacaacaaaaccccatcatttatacggggtcaaaacagggttcacatggtgaactcatctgcagagtctaaattctgagatgcttaccaactttggaaccacccagaagatcaagggggagatgagcagttttgaatttatgactgtcctgacacatccaggacagtttcaagccagcattaccctaaggtgacccagcttgcagtaatgaaagagactagactccacgagcacttggcattaggaatgatgattgactccattttagtaacctgatgttttgttggtattgatagctctggatttttttttaagcatatttatcgtctaccttagtttattcactaagggcactgaatttaggttagaacagcatcccaggtttgaattgcatgcctactccatatttgctctgtgactttaagccagttacttagcctctttgagtatagttttcctcatttctaacatgagaatacgacctgccttccagggttcactctaaggattaaatgtctatgcatagtatgaatgcaataaatactatttattgtcatttcccaattttagaaaacctagtgtgagtttatttcctgggctgaaggaagtttttaaaaatactggattcttctttctttgagctgggtctcacatagtagctacatgattgttaccatattcataatagaacttggtagttaagtatgatgagtatcttggaaaacattgtttgtttaacgatactctttaattctttggaattcacttggctgtaattatgtgctgtgagccaggcactaatgtctgggggtgggtgcctgggtcagtgtccccagaaaacactgggattgtgccgcactagccaggcagaacctttcaccccaacacccttactgaggagagcccttgctgaattacacaaggaaagggaaatacggtagcagcccccttcaccctttgcccatttgccccgaaaatacttgctgccgacacttgcggctgcagctgttaacccgagataactttgccacaaaatatctcacttttattattatttttctataaatatcctataaagagaatgatgtcttctgtttcccaaaacattctgtttttagtagtggtatttacatttacaaaatatagtaattctcaatggctaaaaatgtcaaatcctagagaatgttgcattcctacacatgatgttaacatcattctcaaacagttgttggccaaagattcgtttgatgaatccgatttttccaaaataagcgattctgacgattcaaacaattttgatgttagttctgttttagaaataactccaagaacagtttttatattttattttcacattgaaaatcagtcagatttgcttcaacctcaaaaaccgtgtttatgcaaaattaaatgagtgctggcagcaagctgcactttttttgttgtttttctaaacgggaaaagggttaattggccacagcttaactgactcagtgtcagttaagcgcccttggcaatgcagccatttgtgcctgtcgcccacagcaccctggacatgtgatctggaaggccattctggtgcacgaagcatatgtctgttccccatgcttgagttgcaagcttacttgaagtcagttgtcttcattcccaaacctattgatgccagtggtaattttatcataattgtataaatgaattaaatattatttaaaccaacaaattgtgagtatgaaaagaaagtcattgtttctgtgaatctgtaaatgaatgctttggaaagactgtaaagaaagttgctaaaaaattaccactgtgctgaatacgggcaaagcaaccataaaaaactagggagaaaaaaaacatcttccttgcattcagagaaaactgatgcttaatttttctttccttctttctatagggtaattttccttgatttgtttgtgtcatccttggttgatgtggtggatctgggggctgggttagtgtctgctttttctcttattgtctcttagtggcctcgggcagctgtgtactccaagaaggagaacagatctttccagacacagagagaggggtcactaattggtgtgtgagcagctgtgatttccatctagaaacaaccaacacactcccattatgtgggtcagcatcacctgtatggctctgctagttctctactgccctttaacaaatcagcacagacttagtggctttaaacagcacaagtgtatcatctccaggttgccatggatcaaaagtctcagcacaagttaggtggatcctcagctcaggcactcacaaggctacaaggaagcgttggctgcactgcaggtctcatctgcaactcaggggcctcttctaagctcattcagcttgttggcagaattcagttctttgcccgtataggactgagttcccattttcttgcttgctgtcagctggggaccactcccagctcccaaaggccacccaaagttccttgccatgtggcccctgtaggctgtcacacaatgctgtttgttttcctccagcccagcaaaaatacatctctctgatgcttcactttcccttaaaagcttcttccattaagtcaggctgactcaggatcatttcttttttaattaactccaagtcaattgattagtaatctaattataccagggatatcccatcagcttacactcaaggagagggaatttgatggggtgtgtacttggggcagaaatcttgggggccatttttgaatcttgcctaccccagtggtctctgtccatgtgctctggtctgagagggaaagataatgccagaaggaaatgcaaccatatctcctgcaaactgtcaagagaaggttttaggatagctatgtccattcttcatcataacatttctacttagcactgatgtttcccagaggagcctggttctctttgttatattgcagtctgaaaggagctgtgattcctttaggaatcagaagatctgtgaccctgctgatgtgtattatttctactaaatactaagggagtaggtaagtatttgttgattatctagtatgtttggacacttgtacccaaaagatggcttaatatggtctgactcttctttctctgtaattatctgggtagttaaggaaaaggaattcctctttgcttgactcatcagtttttgtggctgaaaacccagcagcagtaaatataattatataactgatttaatgcttaaataaatagcttaaaaatgacccgtgagtatagtgctttcgctattaattatacattgatccatagttttggttctggacaagttcaagataaaagtttagctgtgaacagaagctgagtttgggttcttgcacatgagagccaatcattgcatttaaccaattctagaatcagaaactgacaaaacttcctttcagggcccattctccctgcttgttgctaccagtctgattaaatattctgtttcctgcttggctgttctgttcaatttgttttcctggtgaaatccaaataaatgacttaatgttaacaacattaattatgttgaatctaataagatctcatgtattaattgacaaaacagcaaacaccagaattctgaaattcataggcctctcatatgaatacaagtcatgcatagtcattatctcttaggtgcagagcaaaaaatcattaacaatggaatttgttccattttaaaagcaaatgacttgtgctttggagttgggtcttaatcagcttgggaatgctattcaacttgctgtgcaggatagaaccagtatcaaaccaaggaagcatcagcattcctgatcagcccctccaggggagtttacacagaccacagtgacacgcagaagggaagcaaagaaatgttttagaaacagtgggaatgtgaccatttaaaataatgagaattcattatcaagccctcttgcccctcccgtttgctggtaatgcaattcagtaggcaatttgtaggaacttttcaaaccaatttagttgcatttgcaaattggacctgtatccctccttctcagcccccactaagtccaacttggagaaaacactatgcatttgataaattgcacatttgtttcagtttcccatctaggaatggcacctaggccatttaggagtcatttgggtgattaagctataacctcttactgcctagaagcaattaaatggggtcaaagccatcctaaggatgttcttgggcttggaaatggaatttacagtatttttccaagacactgctgcatatcaaagaagttccaatcgtcaaaacaaagagacacacgtaaagagaaacataaaccatcctgctgggttgtggaacagagaatgccatctgcattacatggcaaggaggaaactgattatgttgggacctctatttcatagcagatgggttcattaaatttaatagcctccagagcctttagaaaccgtgttaaaaacatgtggagcatgctgtgacacttcacttctggccccgcagtcattataactctggcacagactataaatattacagtactttatttccattgaaacagattactgttatgattatttttttccaggagatgttaaaaatatgagtgtattcctgatttttggtaccacttatatgcatccaaatattttcctcttccattgattctagagttttctattaaacagagttggtattataaaaccatgaattgatgatataaaattattatcttcagaaaagatgtcctaaaactctatatgggtgactgtcaactagtagaaaagcttagggctaaaaatgaaaatgatttctagatttcaggtgtttattgttgtttctgcttttatggattaatgatttgcaactgtctgtaatgaaagaacagcctctatcctctgccatacaccaatggataagagcatctagcctgaataatcatacaacatgatggcttattcagcactctttgtttacaagtcacagcttccagtgcaaagtgggaatggtcaaaaaggcaatttgatgactcttggaaccaggatgtctgtgcagttctgtcttgaggcgtgactagattcaggggttgtattagtttcttctcgcatcactattaatataaagaactacccgagactgagactgggtaatttataacgaaaagaggtttaattggctcagggttccgcaggctatgtaggaagcatggctgaggaggcctcaggaaacttacaatcatcgtggaaggcaaaggggaagcaggcatgtcctatatgactggagcaggaggaagagagagagtggggaggtgctacacacttttgagcaaccagatctcgtgagcactcactcactctcaggagaacagcaagggcggacatctgcacccatgatccagtcaactcccagcaggccacttctccaacaccgggggttacaatttgatacaagatttgggtggggacatagacccaaaccatatcaggggttaatcccaatattattttgacttgctctttgactatttttttttttttttttttttttgaaatggagtctcactctgtcgcccaggctggagtgcagtggtacgatcttggctcactgcaacttctgcctcctgagttcaagtgattctcctgccttagcctcctgagtagctgggattacaggcgcccgccaccacacctggctaactttttgtatttttagtagagacagggtttcaccatactggccaggctggtctcgaactcctgaccttgtgatctgcctgccttagcctcccaaagtgctgggattacagatgtgagccaccacgcccggccactgttccttgactcttattggcttaattcccagacaggatctctctacatggtgccaaaaatggctctactgtttttggtatctaacataatgttgttaactttcattacatttataaaccttaatttatttgcctttcagcatttatattaagcctatgatagataggcctgtttgagtcacagccaaacgttgagagatgagacagacctatgacttaatggcctcaatctcacagagtgaggagaaatcaatccaaaaggaaattgatcctgggaagaccgagaagtaccagagtcctgcacaaaacttgttggtagaatccgaaaccaatccacgcctaagatcatgtaccacatcagcagggtattaattatgataccatactgttaagctatggagccctttagttaaatgtctttgtggaccctttcatataaagcatatagaagcagaggtcctctggtaggtattgggaaatggagacacgaagcccagttgcttggccacatcccagggagactctgaagcattgttttcatctttccttgcactgcagagcctaggtagtattctaagtaatcaggtgtcaacctctgagaatagtcgtataggattctctgctgtggattctctgttgtaccctttagtttacaacagagtgctgggttgagtccagttaggaaagatggctatggggattggcaggttgtgtctgtattcaaaaatcaaattgagaaagttagtatagtaatatgactattttatcatatttcggccttatttttcttcatcacttctgatgatcaaacactggctcattgtacttctgtcacctcttagaaagcattggctgtaggcaagagaacccactcaagctgtgagaaatttactggatggctcaggggcagccccaggagggataaggaccatcaaggagcaagaagccaccaagagcaaatgaccactctttttgttctttcttccttcttcctttgttcttttttcttgtccctcctacttgccatccccagtcatcggtgaaacacagtttcctggtctcctcccagtcctggctttacataatgccccagttgagatccaaaaaggatgaaatcagtgtgtgttgtgtatctgagtttacatttctgagcaaattatatacacaactcactctagcccatggttccattgaggtcagatgtccatcatttatccaatcagttatgtcccagaaggccaagggatagaaacagatcagccagggctatggataacattttctaagaggtcgggaggctgcctgcagtggcttatacctgtaattccagcacttagcgaggcttaggcaggagaattgcttgagcctaggagttggagatgggcaacatagtgagaccccctgtcgctacaaaaaataaattgaagaaatcagccaggcacagtggaatgtgcctgtggtcccagctcctcggaaggctgaggtgggaggatcacttgagccctggagatcaaggctgcagtgagccatgactgcaccactgcactctagcctgggcaacagagtgagaccctgtctccaatttaaaaaaacaaaacagcaaccaaacaaagacaaaacaacaaaacaaaacagtaacaacaacaaaagaggcctggataggaggaaatgcctagagtctgaaggagttggcatttctagacctctgtctttctgtctgaggtttctgtaacttacagcccggctgagctctgatcctaactctcaggagtgggtcttctttcctattctctgagccccaggctcacatcctcctttaagccccagtggacccaagtgtccccacagcctccccctggccccacatcctggaggatgctgcccttcctccatagactatccctgctgtgtgggtggtgggaagccctctcccttgtgccttccgagagctgaggaagatattttggccaacacaaccaaatctgtactgcttttcccccacttcatggcccagatatttgggtaacttaacttctcagagctgattctcatgctttgacatggtttagactaaaatgaacacattcctcttattaccagcatgaagaacaattaaaataatcccagagaatcagcctgtggtttgatatcagctgccagtttctcttctgttactgtacacaggattttctccatgtgaaagatttcattctttcacctttactccaaaagaatcgatgtgccaaatataaatgtgttatctatgaggccatggcacaaagacaccataggtaaggacatttcacctgacttggcctcttagcctgcttctatttaaaagtagcagagaatcactcttgcctcccctgccttcatgacctttcacacccacttatgagtgaaatggccattgagggctcctcctaaccttactctgctggtgacacatgctcttattagacgtacagagcagacatgactaagtctatctctcagtgcaaggtccttaggagaaatttctctcttgttctgaacaaagaaaggaaaagcaaagccagtagtttattcaggcagaaggaacatgcttttaaatcaattttcattatgtttaatctaaaaatctggaacatcaacatcttttctggttgatagaaacaactattaaacacgcttgtcattgatttctcttctgaagtgatcaaattaaaggcagcccaagatgaagcaaggctggagtactcatcctatagtctgtttctctgtcacttagccagctgttaaaggagcagttgtttccatggaaagagccttcctttgaggaacatggggttcaatggacccccatggtattccaatagcagggaccagtgggaaacactgtccacacaccttataagtgcagggacatcttgagaccacattagatgactttttctgtctgcctctggaaaatatttgaagacccaatttgaaaagttttcataaataattgagctattttaattgtcaactaataagttagagaatctaaaggctcactgctggcttaagtaggatcaccacgggcttaaaaccctccaggggagcctaaattcagagcatttgaagaccttgatgacctgactccagtgaacatctcagtcttttccttccacatggcagaaggcaaaggggaagcaggcacgtcctacgtggctggagcagaaggaagagagagagtggggagctgctacacacttttaaacaaccagatcttatgaccactcactcactgtgaggagaacagcaaggggggacatcagcagcaatgatccagtcacctcccggcaggccccttctccaacattgggggttacagtttgaatggggcctttccccattccgtgccgccatcctccagccttaacctactcacacatttatagtctctagaaccagccctgtattctctcacaccgagaccactgtacctgcttttctctctgcaggaagtgatctcttcctcccactccattcagaagcctctgggcttatcctttggtctcagtttcatcatctcctctgacctccttggatggacctccagtctagagtggggcattgatggcctgtttccaaagcatgtagcaccatcctagaacttcttgtactattatattaagaagtccaaataaactttttgccactgaactttaaattccttgaggagagggatggtgtctggttaactgtcgcatcctcaatatatgatcaggcacgtagtaagtatatgtatagaatcagatgtgtaaatctcatagactcagagatccaaaggttggagggcatgtgaaaatatctgcgttttctagctgttagataagaatggcatcttctccaacatttcactcagcatgtagcatccttgctcaaggccatcttcattaggcatgtgatgagtggatgcatcttcaccatgagactgggcttctctctcaggtacccagcaccaccaatccaacaaagattttgccacattcatcaaaaagatctgaattcatgtgtccacggtttgaggagctaagataatggcattctgacatatcagctgtgtcattgttaagataaaattgatattacttttgcccaccgttatgatgttacttttgcccactgttacaacagaagggcttttttttttgagacagagtctccttctgttgcccaggctggagtgcagtggcacaacctcagctcactgcaacctccacctcccaggctcaagtgattctcctgcctcagcctcccaagtagttgggactacaaggtgtgtgccactacgcccagctaatttgtgtatttttagtagagacgaggtttcaccatgttgaacaggctggtcttgaactcctcaccttaggtgatccacccaccttggcctcccgaagtgctgagattacaggtgtgagctaccactcctggcccagaatggaatttttaaacaagattttggcaagattggaatcaaatctggctgtcaagtaatgggcattcaggaaatccttgaaaataatcccttacagttgtacttgtaatgtgcttttttctgtatttcccccaagttcttaccatggtcaatagtgcctcaccatcgctggccattctccctcactctcagaacatcagctgtgctggtcaccttttagttgcctgaacaacccaaactttctccctcccctgggcttttgaacattcttctccttctgaactggaaagactcccctgctgctctgcttctctactggggaagaggctctttcccatgttctttgtctcagctaaaatgtgtccattgcctttccatctcaggtcccctataggttttcttcatagagattatgatcatttagaattatcttaattaggtgctttgacttttccctctcttttaaaattcttgttttgtctatctcttgaacagtagcgtaaggactggggcagtctgtgatgtgtctctataacctgatactgtgcctagcacagagtaagtacccaggatgaattcagagaggccaagtggcttgctctcagtcctaccaccagtctctgtttactgtgcactacagtttgtttgtttctccctgtctgtactatacttttcctaaaaaacggtacaatgagaccccaaggcttacagaagaaataatataaagaatattgctacaacatggatggtggtactaagagagagtctaaaatattgtctccaaaatgcatgtgtcatatttgtctttccttttgaaaacctagctgaatgatcaagtttaggtctgaagcaactgacttttatgaatgccacctccatctaagcagcagttactgattttgaaggaagaacagggacatttgggggatgaaccacatttctgcagtgctccttttctgtgcatgttgctaaatgcaatatgttggggaaaagattgattgcttaaggcatattgtttatactgtattacttgggtctgatggaaaagttcctaacagtggttttcttgctaaagatatggtttatggggaagtgtggaatgtgattttttggtgggacatcatcatgatttaggtgaactccagagaaatttgatactgggagaggccaggaaaaacatgcaggtccatgaagcttctttagcattagccctcagttcttcatcagattgtaaatgctctctgcttttaattaccatccttattcaggccaagctaattgctctgggccagactggaaaggaaaattcccagaaagcctgatatcttgatagaatggtagtgagtttcctgaagaagacgctaagaaatccttaatgaattagcatttcaacttttgtaacagtatactaaaggagtgggggggttggaatcatagatttttgacagctgtttgccatcatagcacttgacaatctgcttcttatttggctttctggtatgtaaaagcatgaaattctcaagaagtattgatcactgtatgacaatacgtatgtaacaaaactgtattgaaaaaactttcttttaaaaatgatattcctatttggttactaaaatgtgtgggtctttttatttagaaaatgttgtggttttgttaaacataagttatttaagggttaaaataatcttaattttaactattaatgttactgagaacagattttcaaccaagtacaactgagtgcaaacaggaacaaacttggaaaagaagattagtggttgggaatgcagagacacagcaagggctgggccttggccacagtacatacattcacagaggccctttgctatattagcagagccagacatttttgtaaggtctggtgatttccccagacttcatggaatctagattaagtttgccaatttcccatttctctggagatgataatccaacatagggctgaattaggaacactcagaatgtgtgggcttgatggttctcttattaagctggattgcccttctctgtctgtagctggtcagtaaacaggagagtctactctttggccatcagtgttctagggacacttgcagaaccagatgtaaagttacctagttcattgacaaaagacatctactgagctaaagattagtccctatgctggccaatgggataagtgttcatttttaggaaatacagcctaagtccttgcagtgaacaatccaagccaattcggtaatttgtacatgttaaaatatttttagtagttattggcatcctccaacatttagcagtgaggctgtaacaagtctcaggccaattctgccatctatgcagatatttattagcaagtatgcacaaaagccaactgttttaaagctcaaggaggttccagctctttatccttcaggtgttctgatggccccttgcatcagagcaaatgcattatttgcaagagtcagctaacgttctatttggagtcaggtaactgagaggcctgagtcagcagctgaaggcaagactgtttaaaaatctggccagggggcactatttctaaagatagagctcccaaagtacttatttgggtgtttgcagagaaaggcaaggctcctgcagcatattgaaccaatccacagagtggatatgtccagttttaccagtaagagttcacttctaatatccattgtggtaattgagaaaatttttggtgttggtcagagataaatacccatagcacatgcaaccatttgtttaaatactagctggaaggtatattcctaatgaggtcaattgaccatttttgatatatagactaaaattagcattcacatttgtatcaaaacatctactctgaagtattctacagtaaattccatagcatataacaatgctgtattatatactgttaaggtttcttttgtgaaatggaaagaatagtggtggtgatctcatagaattgtgaagatttaaaaacataatattgtttagcactatgccacgcctatatcaagtgctcaataagtgctaatcattattatgtagaaattcaggataacattattacttattgttccatatagagtttttgtggagtgaattcttccttcgttttattttggacttgccaagttctgacactctccaaaagaaaagggaaaagactgggccatgcatgtgtttcccttcccagcagaagagcattcagagtcatcttcactctttgcggtcaaggcccctgctgtaggtcgtgtgtccagcttgtcctgcctaaaagcatcatgccatgcttgagaaaaagaaaaaaaaaagtctactgaagccatcacctctccttgtctcaaaagactttatgactacatcatttagaaacgactagagtaagaaccaagaagcttgagaggaaaggctgagctgtgcaaattgatgatgcacttctgaagcatccttcctaacggtggagtagggcaggtgtcatctgagtagcacagcaagaataactggggtactaagagctgccattatggggcaggtaaaacgcacaccagaccctgtgttacgagcttttgcatgtgtcagataggccctattatctccatttacttgatgaggaagctgaggtttagagagattgaggattttgcctaaggaaatgggataattcatggaacaaatggaattcaaccttgggtcttctgcccaggtgtgagactgtgacctcagattccatgttacatgcaagaaggtctcctgcatacgtgtgtgtcctctgaggccgcttttaaggaactgccaaagtctttagaatgcctaatgggagattagaaatgttgttcctgttcccacaagtttgagttatatcacctctactgaattaaaaaaaacccatggtacccactttgagatatgaaaacactggagccagccgggcacggtggctcacacctgtaatcccagcactttgggaggccaaggcaggcagatcacttgaggtcaggagttcaaaaccagcctggccaacatggcgaaaccccatctctactaaaaatacaaaaattagccgggcatggtgccgtgtgcctgtaatcccagctactcgggagactgaggcaggagaatcacttgaacccgggaggtggaggttgcagtgagccgagatcgtgccactgcactccagcctgggtgaccgagtaagactccatctcaaataaataaataaataaataaaaataaaaataaaaataaataatgaaaactctggaacctaacttgtcctgaattatgtttcccatagccttggcaacccaaggtaggaaactttaaattttgcaacatgtatctcttacatggagagttctctgtgctatattaaatgacagaaggaaaactcagctcatcacacttgtaaaagaaaccacagcattcctaggtttaaatgttgagtcataacaattctatttgatgggcttttaaatatcttggaatttgcattttgaatgtgttaaacatcacaaaaggattttgatggtgttatcacagcaaatactgtaatcacatcctataatttatataaccccaactgctgtcagtatgtcaaaaatcatgaaatgttattcatgatacacacaacttctctactgaaggaaattgagggtcctgaatcaaattccttgagggcatttttaatgactttgtatggtaagtctgtccactgtgaagggtagtcaggcaagtcaagcagtgggttaataagtagatcaaagcttcaaatactcagttgaacaagccaaggtgtccggaaggcaggccagggcagagaggtagacctctgaacggaagcaagtttagcagcctgggaacacctgcattgcagagtgcagcagtgatctgcggctcgtgctggaggccttccaggaagcaggccaattaaccttggggctaagagttggtatcttttagaaaccttgcctctggtctgaacttttgtacccagactactctagatgggggccggaaggagaagccgtgacattgtcagactttttttttttaataaccgaactctgttttgctccccccaaatagtcactttgtcttattaaagaagagatgatcaaatgtaacctcatccctccatgcacaattatttgcaaatgttcacctccaaatcagtcttatattcaaacatagtaccaaacttctgcaggaaaggagttggggccatcaagatgtgaaaggtgtagggagtccagtgcagagttgcaatgaaagaggggaagaacagaaatgttccgtagaagaagatgggacaaatgaaaagagcaagtttgcctcctgagagaagagggagcagcagacttcgtgagcaggcaggggacctgaccccagatgggcaaagtgacaggatcttttcaagagcaaggatagctcctatttaatttcatgctatttgctctgctatagtgaaaacctctgcaccttcctgaaagtccaccacattttcacaaaggcctccaagagtggtttttggaggacatcatgggaagttttagttttgtacctctctacactcttgggaagggggccagagagtgtgcattaggatggtgaggtagtttacaaacagaacaaatctagcaggagctcagaaccagagtaactgcacagctgcaaacaccatccttccgcaggaccacagtagccaccagcagagccatggagcttcttcccacatgggattggttgggataagttactgctagtcccattgttagaatatcttgactgaaagatatgtttctgccaaatgttcaataggttataaaatgcagtgattttaaaaagggtcagaagatgtccattttgattttttttctcccctcctatgttatgtaacatctgctcctcagcttctccaattgaagaatgggaagattggccttcattaggagatctcaaaaatctgacatccagccatgtgtgaatttcaagcagtctgtgatccctcccatcaaaacttgtacatgtgcatgtcttattatttcattttatttattttttttggtagaggaggctgtcatcctccaaaatgttaagaactatgggaacagatctcttatgtttagtctagctatatgggcctctcttgttttcttttgttgtaaattgcttctctttgtctacctaaatgacaagcaaaatacatgaattattttctgtagggaaattgagaagccaacaagcctgaatgcaaatcctgcatgacatgtcttattgtacagaaatgtcagtgactaggagagagacaaatccactgaagacagccttggttggtaccaaaagatagtggcccagatccttgttatatcttgtccctggtaaatgaggcaaacaccatgtcactgggtttgagacacaagtcctattgattccactctcagtatacatctcatatattttcccttcttatcattagcaatgtgccatctaccctgtctcctgcctggaacatccctgcagacttctaagtgatcttttgggttcactcttaacacttccagccttctccctgccattattttagttcctgggaggtgagcacccagccaccctctgccatcatggtcctttcttgtttcctggctaacacttacctaatctttatgtttcaagttacaaatcccttccctaactcctcaaatagaaagggaccacctattactctctcatagaaccacttcttgttcttgttagcacttagcacagcttattattattacgtattgcttgggctatttttaaattatgcgtggtaactctagagtaacggtcactaaaataaagtctgggtcactaactgacatttttttgtttaccactctgttcccagtacctaacacagtaccatacaaatggtaatatggatgaatgaatggtaaaatagtgtccacttgggagaacctgattttactcttgttatagttgaatctatttacctaatgcttctgcagtcctttaagtctctttttaagtactgcctcttctggagtcccctccctgcactggctccatgggccagttattatacaatacagtatggttatctttatttactcctgtgtctcttcactttgtaagcatcccaggactgaatcatgcccaagtctctcatgtccacagtcttccttggcctaggctttatagatatttggtaggtaaataaatagcaaataactatattattagtcctgataagtttaaatcttaaaaaactgtgaatgtaatgcacttatcacttagctataacctagttgataaacagtatgtaatttcacacccatctgatttatccatggttaaaaaaacacacaactgattttacatatggaatgttgaaactgggagcacatacggtgacacctcagagagcctgcatcttacatatctttgcatgtggctcacatgcccaatactcctataaatgtttgttgtgtgagtgaatgagtccatgaatgtatgacttcaacttgctatcacttttggtattagattttcaaatttcccaacatggagatatggaagccattgttatttgaaataactctgtgtttgttactcattttagttagcaacaaaaagatgaaaacgatcaaattttaccattcccacatgtttcagagcttttcccttcttgtggttgtttcctgaacacacatatttgagggaatattcagtactcataacgcgtttaaagacaattgccttgagttttggagcaattgaattctgaaatagctcatttgtattagttataggtaagaagctatccagataacaatacagtctgattctgttggtgtaaaccaccttatcagttgaaattcattgcttcataaaatcatttaagccccctcatatattaatttagatcaccgttaggattttttaaaaaaatctaaatcatgatgtatcttttattttccttaagaatctggaccagaagcacaattgatttcttcacatgaaactggaaggtagctgttctaggggagaaaggaaacttttcatctaccctcttagattcagtgaccaaagctgattaattaaactgacaaaaacagattattaggagaaaggtttatttcatatgcacatggggggccacacaggaaagaagtgaaaactttaaaaattagttaggcctttgagtttatatactgttttaacaaagggtaataaattatggagaagtgacaagacaaaggaaaggaggtttaggcttctaggggtggcacattgtgggaaggtaaatagggaagacaaatggatgataaggattatttagtaaagtttgctatgcagacgaaagttagtgctgtttccagtgataagagttattgcctcttcctggtacaggagaggggaaggcaaaccttcacaacaggaaatttgtgtccaaattttaggcagaaaaggtaaaggacacataattcctcctgcatctgctctttctcagttgccttcagctgaaaataatctttatgacaaagtggcatattttggggtggcatattctgatccctgtcactgtttatagtcttccacttattagcaacttcctaatcattgctgttggcttctgatggccgccattttatactgctctgtccccaatactgttactgcatttatatacatttccttattaattagcatcctgctgtattctgtgacttcatattttcttttatcttttaactgagtaatctcatctgtcagtcatgatattactgtgggtcataagggtttgaaaaccttttaccttttttgtaccagtgttggacatggtaatcttaaggaaggctgttcctcaatatagcctgttgaggtgaacatgtttggctgattttcttaactggttttgtctaatattccttgcctgattgttcaagatgtctcaccaccagtccgtgactaagtgtgggggaagatctgtcagggcacccagacaccttagagccccaagtctctagatgtcttctttgtggtaattaccttcctcttagtatccattcaaggagccagtcggaggtgtccaaaaaatcacttttgaaactctccaaatgaggagtggaaagcctggggatactgaggaactgacctttgtccctttcaacttggtgctatcagtgaccacaccccagaatttctgaggctccttgacaactcaatggacattgacgaaagaagtttgaagactgaggctccagcctgtgctctgccatgtgcccttatataaatcacttcctttttctgggtccaagtttctctacttcattgggtcaggtgctataaaatttatattgtataacaaagttaaagtgctgatactgtgaatatttaaaatattcatgtgaagataatcattgcagtaatgactcagtgggttgaatttgcctactctaagtattcttaggtattcatttctaaaatatttctccagaaattcttagtacctggtatgtaggagacatttaataagttttgttgagtgaaaagaaaaccttacctttccctgggttcatgcattgttgattgagcggccaaaaataatgataaaaattacagctgcatttattgaatgctcacagttggccaggcacagttcaaagagattaacacataactatatgtcaagaatatttctaaataaatgtaacattaatattttatttaaatataagcatatcattaagtataaatatataacagtcttatgagataggtattattgttatccctattttcagatgataaaactgaggcattgaataattgaataactttcccaaatatctattccaagatatgtgttttaaaaaaactgtgtcctttctgagtagaatgcaaatgttcaaaaataaaactggtgagttattaaagcattaagacatttgccctttatctgaataatccctggcttgtcctttgctgaaactttgagcagcatgatgttggaattcctttatgataaccaagtggagattcctgacaccgtaaaggtatgatcatgtgcttggtgctgaataaagtttgtgagcacagccaaggcccaaatgcttctcagatctgtgtgcactaccatattcagtaagtaggctgggaaaatccatgaagctatttccaaaatcaaactgttttgccaagcttgctttctctcctcttaattgtgaacccagggttatttggacggaaagttgatctatgcctctgtttcatttactcattactcattaaactgctatttaattctaggtatatgagttgtcagagctttctctaaagctcctctaaaccaaaatttagattttggattgaggcagtgttcactgaggccagtttggctcacatctaaagtgagcccgagcttaaaatgagctggggcttgagggatctccaggtcaggccgagcaagttaaggtgacacaggctgtttcaggggtcagagcccattcctctgttttgagattcaccctctgtgttctcccaaagaattgcaatatggagctattcgagaaagagtcaaataaacatcttgtataatgaggaatgatttcactttccttcctacttaggtatttatgtcacttatggagtgattcctggattacactttcctggctggagtgtactagggtagttaggaacacaggccctggagccagaggacccggtttcaaatgcttgctttgccacttagcagctgtgccatctgagacagcttgcataacccttctgtgctttttatcacatataaaagggggataatgatagatactgcctggcttgcttgttgtcagggtaactggtgcggtgtcctctcctagggacctgccttctcccctctcatctgctggtgctgtggcagccaaagtagggttgcctgctgctattgcaaagcaacagtctaacacgtacatactgtttagcatccatgtgaaaaggaaaaggttcccatgagccaagctggtgaagtaagtgtgcagagaagactgagtataacacaatgggggtaagggtatatgtgacctatatgtagcatgcatgtgtcatctaaaggtatttgtttcacaaactttaaaaacagctagggccaaatgaaactctacaggtgcaccttctaggtgctcggaattcctgatgcctgattatgccattcacaccttttcctgtactccagaacttcaacagctagaatagcagcagaacacatctcaatctctctatacctagagcccaccttccaagttcattgtcactcgcacctctggagcctgatcatgcttgagcctgagcccctagtgactcactgagctggtgctgtcactgtgtgccctcctacagtccaccatccagaaggggcttttctttcttggccatgctcagggctgtcactattgctaggcagtgtcagtcaaggtgaaaaggattgtggagtttcaggttgagtttgccctgaaaagcaccatctccacagtcagaaattctcacttctgtggtgtctcctgctgtgcactattaaccagcccattggcctatcggtacttcatttccctgtctgattttggcaccttctttgtatttttttttttaactttctgttatgggtagtctatggatgttcctccaagaagagtttctttctctgagctctgctcactcagcagaatgcctccacatgacagatgcctgggaaacatgtcctaatcaattgattccatcttaggtccatcaccaggaatttgctaacatccgtgtgcatatgacattatatgaggactgatacagatgtgggttacacccatttattattatttctcaatgttcagtaggaatataaagggttcccagagggtgtaagaaccaccttagaccctgagaaacaagggcagatgtattcagagcagatgcaaagacagaaatatggagggaaaataacaaggaagagaaatgcaagctaagttcatatgtgattagacattttccatttttagcctcatggcttacatttgcataattcttttaaaaagaaaaattaattatttatgactctagcttttaaccaaaccgtgcatttaaagtaatcactctgggtaatttaaataaaatcttttctgtaaatagtttatgctcattagaatgagaaaactgttggtttattcaattaaaaggacattattgccagtttggattctctctctttttttccacttcaaaacagagggcagtcacattgagacagatgggacttaattaagttgtctcaaaagtaaccagattttgctttaaaaaaaaatttaaagaggacagattccagaagacttttcaaaaaccagatcaccattttagagttctgaagtttttaccctttactctgatggatagtcagtacaaacataagtttgtttcctggcaagcatgtaggacttttcacatgagcccagcagcaatcagagaagatggttctaaacaaagctctgccctactgtgatctgtaaagaatgcaaaaacaatgaacctgcttggtgcttctgaatgtaggtaacaccattcactatggtaaagaggcttttccaaagaagccatctgtattttcaggatattattatcttttgtttactggttagttccctgaatatccatggttcgtgacagctcctggagagtgtgacacctgagtgttttcccagaacatggcaggtgtgtagctctgcactgaagggtgagcaggcaactgatgcctgaggtctatgtttggccctcctttgctgtaacatgaacagtgttacagtaattctgattgaattgggatcagggagccctctcactcagtccctttggttcacctgtggcatgcagaattttgggactccatagagcagagttcatgaaccactggaatagataacttataatatgttgacatagtgaatcaggcttctttggctgtgacagaattccaggttggccagacttgtgtgattaaggaaaatcaattgaatcataaaactgaaatgtcaaagtatagcactaccttcaggtgtggctagctctaggtggccaaatgctgtcaggaatctgcctcttgccatctcttggctctgttttcctctgtgtggttttattttcagatgaggctttttcccctgtgtgcagtcaagatcgtcatcagcagctccagatttttatcctaccagtatagccctctgccctcagaagaaagaaatccgtttcctcatggttccagctaaagccctggtgcccacactcagggattttaccacctgcttatctctaactgaaccagtcatgtggtcagcaagatggagagttctgattggccaggcaggagtcgcgtgtctacccttggatttaagggaaggtggagtcagctccttccaactgcaaaatctgagagtaggggctgggttttacctcaaaggcaaatcaaaatgctgttgccaaaaggagggacagattcagtgcaggcaaaaaactgctgttttctacagactccttttagatagaacagcctatgagcctaagcaaaacctgttacttttcttctacatccatggagattttgtttatgtccagtgatgggagacttatacctctgaagaaaagaaactgatgtttgtataaagaggaaaaggactggggagtgagggagagtagaggagatgacagaaaatagaaaatgccaacccatctcaaccatccaaagttcagtcatctttctaggaaggaagtgaataaattatattttttcctgtcgtcgtaaatacttgttggtttaccacccgatatctcctgtgagaagtgaagtgagagccaagactgtaacaggttttatccctttacttcctgtgctctgtgcaactgtttggcaagggttttttaagctcttgtttcaaccaacttctgtctaaatgcccagaattcgtggctgtttgagctacttaagcttttcaaatgtaggcaatggggatatatctgtgcgagaggtttaataatgagatggtttggcctgtgtggcctcagcataccaaatcttcatctcaaatgtctttcagagagagacagagtaacggggtcaggttagagcagcaaccactcttggtgatgatggggcaaaagcctcttacagccctcgcctagaactctaatggatgaggccatcccccacgtaactccctttgtctaggtcagtgtagtgcagtggctttgtagagaaagctgggttgtatttgtttgtcgggttttaataatgctgatgtaataaaatgagttgggatgtatttccttctttattttctaaaacatgtttttgttagattgctgtatttcttcttgaatgtttgttagaattcattaatgaaactatttgagcctggagctttctttgtggggaagttcctcattccaaattcattttcttttgtagatatagggctatttagattttttatttcttaatatcaatttttctcatttgtgttacaaggagtttgttcatttcatctaagttattgatttattggcataaagatgttcataatattctcttagatttcttttaatgtcttcaagatctatggtgataactcctctttccttgatatataagagcaaattttatatataatgatcacacatatatacatgcatgtatctatatattatgtttttattctttttctacatcattttgaattgaatgttttaacttccattttatctccacttctgacccaataatagctacacctcttagttgtttcttttgagtgattgttaattatttgtgcctttaacttctcacagtctaccttacttatagtggaagaaacttacaacagtatacctgcaatgcccccctttcacactatacgctattattaagatactttttacttccacatatgttataaacctcacaatacattgtttttattttgcttcaaatagttaataaagtgaggaagaaatcttatagttacccacatgtttttcatttctggtgctatttattcttttggatatactcaagcttccaattggaataatttttcttcagtctgaagaatttcctttaatttttcctatagttcacctctgctggcagtgagttctctcagatatattttttttttttttggtatgaaagcatttctactttgccttcttttagagtgttattttcactagatacagaattctagtttacagttgttttcttataatacttgaaagtggctgctctagggtcatttggcttgtattctttttgacgggaagtcactgataattcttactcgtcatcccctaaacctatgtgcctttattttattagctgcttaagattttgttgttatgatatgttttcagcagtattacacagtgccttggtattgttttctttttgtttatttttcttgaggttcattaaccttcttggattggtgggtttataatttttatcaaactaaagatatttagtcattatttcttcagatattttatttgttctgcactgctccaaaaccatcctggacttttaactgcacatttattcatctacttgatattatcctactggttactgaagttatttttcaacttttttttctctgtgtgcttcatttcttattgtttctattgctgtgtcttcaggccgattacttcttctgccatgtctcatcctttgttagacccatacagtcacttttaaaaaattttaagtattgtatttttaaactttaggagttccatttggttttggtttttattggtttttgatttggcttttaatttttatttatccctttattgtgttcatgttttcttttaagtcttttattaaattttagcagctaatttaaagtctgtgtttgtgaattttatcatttctgtgtatatgttacctattgattgttttaccacttatgagtcacattttcccatttatatagtaatttttgaacagataatgagcataatgacattgtgatggtgggcattatgtttctgagtgtctggattttgtctattttaaaggaatgttgagttttgttctggcagtcagttaacttacctatatatcaccttggcccttaaaaagcttgtttctaagtcttgattaggtgggtatggcatatctttcactctaaggcaaccattttgttgctcaattattgagaatccaattggcatttggatttctctagtttttaaatgtgaacttcagaagcaaatctgcctctttgaggtttgggcccaagagccactgataagacctgactttctatactaagagaaaaaactcccattgaattgtaaacaccagtaggaaataccgatatttgttaagagttactctatttcatgatttaattgtaaattaatcaacggcaggaaaaattccactgaaaatacacatagatttcaaaatcataggaacatgtgtttggcaaagtgtgcttgaagattgccaaaccccagacttgggggctggggaacaaaatgtagtttgagagaatcagcaatcccagcatattaacagacctccctttcacataggaccaaaataagcctgaagtggtatggtagtcagtgtgtcagcaggcttgagtggagaacaaagctctttgctagtctacaaggagaccacttcatttttatttttaccttgtattcccttcattatccattaacagagtactttaagtttttagggaaagagcagccagactatttgacttgattatactatcagatcaaaaaacaggctttggagtcagtctcagtgtcctcatttgcagagtgaagatgattgtacttgaaccctagagttctcagggggctttctgtgagcatgcatagatcccttagcacctggcctgccttggagtaagcactcagcttgtgtgagttctcattgttagccactggatccagtcttgactttgagaagtgcttatgtgcacaaagagaactaatatcaggcaacacatggctttggtagttctttctctggcccagtgaacataatatatatttaccaatgggccaaggtaaaaacaatatgtaagagaatgaaatgttcataaattttcccaagaaaagaacttcacttagactagaatcacagcattcttcacagactaaaattatagagctgaaagttccctgaaggattctctaatcaggagcatctcacagaggactgtctgtctcccacagctcacacctctactctggactggccatttactgtgttcacttccgtgagacacagacttcatggataaaagagctacatagtcacttacttttatttaatagcttattacgtttttcataggagtaaggaaatggaaggacaaaattgaacctttcagtttacatagagatagggctgccacagagctccgtgtgaaggcatcatttcatcagctgtatcagctgttttcaagagcaacagggaacccattcttctggagatgcttctccagagctgtcttctgaattatacccctaagccacttagttagagcagacagctttttaacatgggattctttaagatcatctttcaagtgaccctagaagatggactgttgtcatcagaccacttgtgatttgctaaatgatgctctctgtcttgaaggcagccattggtaaatttacactggaacaagctaaagtgacattgtgtcttttgtttctagggtaagttctagatcaacaagagacacagggttgtctttcttcccctggctgatgatatactgagacagtgtttcccaggaatgtatctctctttgttcaggaatgttctaacagtaaccatgcagccaaggagacagaagaacacaatgatgaacctggcatttgcccttgctgtggccacctcctattgtacaatttcagtaggtggtagaagcccgtgtcactgtgattaactatctttagggaggcctctctacacaaagccactattttgagaggcttacgattcagccataaaaatctgaggacagcatttaaagttgtggaagatacgacagtatcatatggtatcatacggtttttttggtctccccaccacccccatttttgagccatttcacttttgcaagttctttttgaacttttttaacttgagacatagcaaagcacaaaacatgataaaaatatttaaagcaccttactgattgtgtgacttcttgagtttgtaatgtcctctaaagatgagttccagagcttttgcacacctttttgtcattctctcagtgactcccttaagaaaaaagacttttataaaccttatgatagctatgtgatgttcaccttagagctcttacatctaaaaacctgtttgcaaactaaaccattgctatgcaaatgtaaagctccattattgttaagtaaaaataagtaagccaaataaggaagcaaatatagactccagggagttgcttgagaaatctggaagatctgctttgtaatattatatttcatcctagaaggtcccacacctttgataggtgcccctctccaactttgaaaatcccgtgaaaagtgtgacacttaaaatattactcacttcagctactgtattataaagttatcaaatattatctgtcttagaaaattcatagctttgctgctttttgatcattaaacttctcaaactttgtaattcttcattatggctaccaagaatgttaaagctattttaccccaatgtctttacatagtgtcattttctatgaaaagaatggaccaggctgggcatggtggcccacacctgtaatcccagcactttgggaggctgaggcaggtggatcgcgaggttgggagattgagaccaccctggccaacatggtgaaaccccatctgtactaaaaataccaaaaaaaatagccaggcgcgttggcatgtacctgtagtcccagctactcaggaggctgaggcaggagaattgcttgaacccgagaggcagaggttacagtgagccaagatcatgccactgcactccagcctgggtgacagagcgagactccatctcaaaaaaaagaatggaccagagtttagtaagaagaatgtcacctcttccactacagcatgtgtttctataatgtgaattagctcccacgtaattggtaaatagagaatgatgttactataagacagaatctcactgcgtcatagggcatttttcctggactgctagagttttgcaccactgaggaagcaacaggtgatagcagagtataccaacccactagcgagcagcagcctgcagaggggcacatttcagcacacaagagtttttcacttaaatcttttactctgggctccagctggtcacatgttctgtcttgggacatgttccctgtttgtttcaccccagacctgagccttttgcccttgctccattactcagctgcctgaactcttccttaaacttcctgccttcaagttattgactccttctttaaaaaatgatagagtaatttatttttttaatcaaaacatgtcattttaattgtgctaatagtttatgaaagtggtgattgtttttgtttggtgttctggttaccaagtttctaagagtttgagctgtctgttctaatcctatttttcccatacattctgttatttttagtgtgcaattttacagaaggtgaggtttctcactgatatatatcataacatagcagaaatgcctggagttgtacttatttcaggctaatagttgtttttatattatagaccaggtctgtggctaaaaaatatggcaccagcatagtgcctcttgctttctgaatgtgtagattgcatatttatttgattctgccacctctgatattttttgctatgacaaaaactgtttatatactcttcccactgcagacatggaggatgactgaagattttgttcactttccaatgaacaaagtgtatgtgttgggggaagttctttctgtttgtcattcttgggggcccggtatttctagttaagttactatacagatttctttgtggttcagcagtttgtcagctctctgcaggttctctcttgaagacatctgttgagtgcagtaatggcttcattgcagactcttgagttttcactaattttcttctgaaggattttaatgctgccttttgtagggaatatgaagaccctttcatctttttggagagtttcaagttctttggctcccatctcccctggtgaggttttccttggaggaccattctggccattattgactctctgggttctccatgtctataacctgccaaacaggctgtctgcctcacacagcaagtcccatgtctgtcccaggtggctgcagagccaggttgacaggaggctgaaaggaagtatcagtaccttcctctactgtgtccccattggtacttctcttcctctgtccctttcctcccctaactttctcggcatagtgtttccttatatagacctacattggctccaagctcacaatctcagaggaattacatgacatgcataaattatgaaacatttttttgcaaattaagttttaattaaaaccagcagcttagagcatccaactggaagcagtcacaatgttgaaaagtgacactggtagggtgggagttcaggagaaggtctgagtggctttgcatcctgtttggatatttccaaaatgaatgctgcagaaaagagcttccttccatatcagaccctccttaatctacactgccgccttcgatgaatccctttatgtcgttagaccctggactgccatggggaccaatataattttcaagcaggaaatacaaatgcatccttattgtagttttatctggactttgccaaatttccatctggttctaccagtctgcattctcacagagaactggcagaacctccagctcccccacattaccaaaactccaattcagatcacttttcagccggatgatcacccacaataaggctgaagaatggcaattttaattggaaccttatttttcagatacaatgcagagtgaaagcttgatgagaaatgacttctaattgtgagaattttcaggacattataatgagcaaaatgtggggggccttccctccactgatactccttagctatatgtaatatgagacttgttctggtctgcccattaataatgcacatttttcagcatctcaaagaatgtctgccatcaaatgagtaatttatgcaggcttgcctttcatctaggcagggctgtactactagaacaaaaactccagatcttttcattcaaaattaagtttgaaaatatgaccttcagtgaccagtccacattgctgctaactaatctggtgtggtggacggtgtggtgctctttgtagacctgtagcagagctagccacttggccattcaggaattttgaagtttaatattctctatgcctttaactcattcagaccctgggaaaggcttatccagataatctgtattttaaaattactggaatatcttttttttttttttttcttagacagagtcttactctgtcacccaggctggagtgcagtggtatgatctcagctcactgtaacctctgcttcccaggctcaacagattctaacgcctcagcctcctgagtagctgggactataggcacccagcaccacgcctggctaatttttgtattttttattagagatggggtttcaccatgttggccaggctggtgtcaaactcctgacctcaagtgatctgcccattttggcctcccaaagtgctgggattacaggggtgagccatcatgcccggcctggaatatctttaaaaatgaaggtgttggcttggcgggggtggtacaatgaacatcagaaagagagaaccttgctcagagtgtaacttgggacaacttttcttgagagtatttggactgaaatgtgcaataccctttaaccagtaattcaccttcttgaaaagttgagagggtgcctaacaatttgactacaaggatgtccattaccgtgtcattcatgttagtgacagcctagatctctaataataagaaatttaataagtaacttattacatattcaaataatttaaatatcataaagtgatttaacatgaagttaattgagatcagcggtggatattagcatcatagggagctttaaatgtctttttttggcctatcttttatatctaattttctacaaaaaaccggcattacttgtgtgatttttaaaaagaaacacttaggaaagtatatgtgttgccaagaagggtctttctgttcatcttttccttgcttttaaacataccattggaagaaaaaaaaaattgaagtcccatccataccccaaactagagattgagaaatcactattaaattatgtatgtcctggtaagataatacccaatttcataaaagcaagaaaatttggaatacatagataccattttacccataagtctttccaacaaaattggaaggacttactgatatgcagcaaaaattagaatgaggacatgactagttttaaagtagtaaagtcagctatgtttgtttgcttttattgaccctgtttttatcttatcttaccccctgcagggttatctctctacctgtgttcctactctttcctcctcctcctctttcaacatcaccataatagcaaggggttagctgaagccatgcaactgggagaggtcactcaattagggattatggagtgagcaacagggtgcccacatttaaagagctagagaaggaaggtggagtgaaggaagtagcagactggcactcatgggaaagctggggtagggaggggagaagattccaaggagaaggatattcagagagataccttttgtgtccctgacctatccaatattattataaaaaccagaatagcttccagactttggagaaatatgatgtcccatgtgtttgtaaggaaatttcatgcatagcattggaaatcttttgaggaaattactcctgagtatttttgaagctgagcaaagagttacagaaatattttgttgaatccctttatttgtacaaataaaatctagttgtgatctgccatggtgtgtacctaagagatacccagctgcaagtttctatgaaaatagtagtcctctgggggcagggcacagacaaacaaaaagacagcagtaacctctgcagacttaaatgtccctgtctgacagctttgaagagagcaatggttctcccagcatgcagctggagatgtgagaatgggcagactgcctcctcaagtgggtccctgacccctgacccccaagcagcctaactgggaggcacccccccagtaggggcagactgacatctcacacggccgggtactcctctgagacaaaacttccagaggaacgatcagacagcagcattcgcgattcacgaaagtccgctgttctgcagccaccactgctgttacccagtcaaacagggtctgaagtggacctctagcaaacttcaacagacatgcagctgagggtcctgtctggtagaaggaaaactaacaaacagaaaggacatccacaccaaaaacccatctgtacgtcaccatcatcaaagaccaaaagtagataaaaccacaaagatggggaaaaaacagagcagaaaaaaaggaaactctaaaaagcagagcgcctctcctcctccaaaagaacgcagttcctcaccagcaacggaacaaagctggacggagaatgactttgacgagttgagggaagaaggcttcagacgatcaaactactccgagctacaggaggaaattcaaaccaaaggcaaagaagttgaaaactttgaaaaaaatttagacgaatgtataagtagaataaccaatacagagaagtgcttaaaggagctgatggagctgaaagccaaggctcaagaactacgtgaagaatgcagaagcctcaggagccgatgtgatcaactggaagaaagggtatcagtgatggaagatgaaatgaatgaagcgagaagggaagtttagagaaaaaagaataaaaagaaacgaacaaagcctccaagaaatatgggactatgtgaaaaaaacaaatctacatctgattggtgtacctgaaagtgatgtggagaatggaaccaagttggaaaacactctgcaggatatgatccagtagaacttccccaatctagcaaggcagaccaacattcagattcaggaaatacagagaacgccacaaagatactccttgagaagagcaactccaagacacataattgtcagattcaccaaagtggaaatgaaggaaaaaatgttaagggcagccagagagaaaggtcggattacccacaaagggaagcccatcagactaacagcggatctctcggcagaaactccacaagccagaagagagtgggggccaatattcaacattcttaaagaaaagaattttcaacccagaatttcatatccagtcaaactaagcttcagaagtgaaggagaaataaaatcctttacagacaagcaaatgctgagagattttgtcaccaccaggcctgccctaaaagagctcctgaaggaagcactaaacatggaaaggaacaactggtaccagccactgcaaaatcatgccaaaatgtaaagaccatcgagactaggaagaaactgcatcaactaatgagcaaaataaccagctaacatcaaaatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaagtcaggggttgcaatcctagtctctgacaaaacagactttaaaccaacaaagatcaaaagagacaaggccatacataatggtaaagggatcaattcaacaagaagagctaactatcctaaatatatatgcacccaatacaggagcacccagtttcataaagcaagtcttgagtgacctacaaagagacttagactcccacacaataataatgggagactttaacaccccactgttaatattagacagatcaacgagacagaaagttaacaaggaaactcaggaattgaactcagctctgcaccaagcggacctaatagatatctacagaactctccaccccaaatccacagaacatacattttttgcagcaccacaccacacctattccagaattgaccacatagttggaagtaaagctctcctcagcaaatgtaaaagaacagaaattataacaaactgtctctcagaccacagtgcaatcaaactagaactcaggattaagaaactcactcaaaatggctcaactacatggaaactgaacaacctgctcctgaatgactactgggtacagaacgaaatgaaggcagaaataaagatgttctttgaaaccaatgagaacaaagacacaacataccagaatctgtgggacacattcaaagcagtgtatagagggaaatttatagcactaaatgcccacaagagaaagcaggaaagatccaaaattgacaccctaacatcacaattaaaagaactggaaaagcaagagcaaacacattcaaaagctagcagaaggcaagaaataactaagatcagagcagaactgaaggaaatagagacacaaaaaacccttcaaaaaattaatgaatccaggagctggttttttgaaaggatcaacaatattgatagaccactagcaagactaataaagaagaaaagagagaagaatcaaatagacgcaataaaaaatgataaaggggatatcactaccgatcccacagaaatacaaactaccatcagagaatactacaaacacctctatgcaaataaactagaaaatctagaagaaatggataaattcctcaacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaagaggaattggtaccattccttctgaaactattccagtcaatagaaaaagagtgaatcctccctaactcattttatgaggccagcatcatcctgacaccaaagccgggcagagacacaaccaaaaaagagaattttagaccaatatccttgatgaacattgatgcaaatatcctcaatcaaatactggcaaactgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgagacatatctcaaaataataagacctatctatgacaaacccacagccaatatcatactgaatgggcaaaaactggaagcgttccctttgaaaactgacacaagacagagatgccctctctcaccactcctattcaacatagtgttggaagttctggccagggcaatcaggcgggagaaggaaataaagagtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaatagcggacaaacagagaaccaaatcatgagtgaactctcattcacaattgcttcaaagagaataaaatacctaggaatccaacttacaagggatgtgaaggacctcttcaaggagaactacaaaccactgctcaatgaaataaaagaggatacaaacaaatggaagaaaattccatgctcatgggtaggaagaatcaatatcgtgagaatggccatgctgcccaaggtaatttatagattcaatgccatccccatcaagctaccaatgcctttattcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactgataccaaaacagagatatagatcaatggaacagaacagagccctcagaaataatgctgcatatctacaactgtctgatctttgacaaacctgagaaaaataagcaatggggaaaggaatccctacttaataaatggtgctgggaaaactggctagccatgtggagaaagctgaaactggatcccttccttacatcttatacaaaaattaattcaagatagattaaagacttaaacattagacctaaaaccataaaaaccctagaagaaaacctgggcattaccattcaggacataggcatgggcaaggacttcatgtctaagacaccaaaagcaatggcaacaaaagacaaaattgacaaatgggatctaactaaactgaagagcttctgcacagcgaaagaaactaccatcagagtgaacaggcgacctacaaaatgggagaaaattttcgcaaccttctcatctaacaaagggctaatatccagaatctacaatgaactcaaacaaatttacaagaaaaaaacaaacaaccccatcaaaaagtgggcgaaggacatgagcagacacttctcaaaagaaggcatttatgcagccaaaaaacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactggttatatacccaaaggactataaatcatgctgctataaagacacatgcacacatatgtttattgtggcactattcccaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggcctgttgtggggtggggggaggggggagggatagcattaggagatatacctaatgctaaatgatgagttaatgggtgcagcacatcagcatggcacatgtatacatatgtaactaacctgcacattgtgcacatgtaccctacaatttaaagtataataataatttttaaaaaataaaaaatagtaagaaaaattcagttcactccagatgccccaatagcttatactgagctgaaagccattagaagctaggtctcatggatgtggggtcagaagacaccatgggtgctgagctctgccatgtcactgccatgccctccctgctgttgacttcactcttaggcctatttgatgatctttccccagtagtttagttctaggtctttcctcacagattgtagtcaagaggaaagctagcaggggaaaagtgggagaggggtgtaaatgaaaagtctcgattagactagattaggtcacacgtctaccctgagccagttgctgtggccgagggaaagcgatgagttgagttgatggcttgggtctgggtaatgtccagatcatggggcttggcctcttacctagggcaagggacactgaaggaaaggggttagataatgaacataaagagataagtgttctggatttctcacctgtaaaattgtagtaataacactattagtagagataggagtcacactctgcctaatgtaccttgctcagaccctatcatttcttcactaacccactgtgatgcagcagtggctcagtgagaggggttctgataccaggtctgtagggtcacctgtggaccatgaggttggtgattactgtaacctctcatacgctatcggattggagccagccctaagtactctggaggttacgaaatcaaaggatgaaaacagcaaactgttatgggccagttgttttcgtaaagactcaatatgcattagctcgtttaatcctcacattaatctcatgaaataatgttattactactgttttacggatgagacctctagagttcagagacgctatattgttgtccaggttcttatggctactaagtggtagaggtagtatttgaaaggtggtctaccaagctccaaggccctccttctttcattgcttcttcctttcttccttctttcttctccttcctttccttctgctctcatttctctctttctctccctctctcttcctttcttccttccttcctttatctctttcttctctctttctttccttccttccttctttcttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccttccttctttctttctttctttctttcattctttcttcccctccctcccttcctttgttcctctcttcctcccttccttccctttcctccttcctctctccccccttccttttttctttttctctccctccctccctgatctttttttctttctttcccatttccctctttccctccttccttcttttcaacaaatatacactgaattcttaccaagggccaggcataggtatagtccctaggaatacaacagtgaataagatagatacagtccctcggtagatcttatatggaggtcatcaaaaaacctaaacaagtaaagaggaagattacacagtgcaacaaatgctaagacaggaataaacaagatgatattatagaaagacacttggggtagagataataacacctgccagaagaggtgccatcagagctgagatctgacgcatgggtagggaatcagtgaggcagggaagtggggtagtcagagaattgacgtgaagttgtcggggcagagcattaaccaaccagaggaaagagccccacaaaggctttaaggcaagtgaaatttgaagcacaggctgccaagtaccaggcttatactttcagatcattctgggtgccatgtaaaggaaggattggattggagggctggagtgaacctggagagaccagatgagcagcagtggtggcatggtgtggggtggcagaagtggaaggatgtgagacaacctgcactgccaaatcttagctcatcagagaccccttggcataggttttagagtttgagccatttaacagaactttctttgctctatagtagagtgcggatctttatccacattgcttaatgaagaagaatggaagattatacatgcaagcatccacagggaaaaaaatgaacacacagaacctcagcagcaagcagggattgatcattcattcatgaggcccgaggcaaagggccagttttacaaatggaataaagatatgtaggccaggctttttttgttttacacagttggcaggaaaatactttgtttcttatttggtctttacatatttcacagtgaaatgtgttgttttgatcaatagatctttaattggagttttatgtttgaaaaagggtccactcaagtttggaacttcgttgagctagagcactagatgtcccttcaatcacccccatgggtctgtgtgaaactctgaggtagaaatgaagtgaattaggagaattaaaacaaaaacatgtccctctgctcggtgggtatttttctttttgaaatacctttatcagggcctcagatctcttcctcacatctcctttgtgcctcacctattgttcctcacaggttgcctgcgctggtcccatctcatcacatgggctctccctggtgggatgtccccgattgagtcctgggctctcgctgtcctctgcctacactcaccccttcggtaacctcatctacgtgcagacagtaaccaagctcaggcctcctcccgggacatgagcttcatatttccagctgcctaccctacacctctgcctgcaatcctaagagacatcttgaacttttcttaattttggacaaaactgagctcttagtgtttttcctcaactgtgcttctcccatactcatcttctcagtatgcctctcccatagtcatcttctcagtaaatggcagctctgtttttgcatttatcaaggaccaaccttggccgcatcttttatgtctcttctatcatgatccaggctatcatctcgattctcaactctacctggggtcagactattgcctgctgcctccacaccaccagtgtgctgatcctgttctccctcagttcttttttttttttttttttttttttttttttttttttttttttttttttttgagacagcatctcactctgtcacccaggctggagtgcagtggtgtgatgttagctcactgcaacctccgcctcccaggtacaagcgattctcctgcttcagcctcccaagtagctgggattacaggcacactccaccatgcccagctaattttttttgtatttttagtagagacagggtttcgccatgttggccatgctggtctcgaactcctgacctcgggtgatctgctcacctcggcctcccaaagtgctgggagcacaggcatgagccaccatgcccggcctctgtcagttcttatctagaccattcaatagtctggtcaccggccttccttctcaaattctgtctttattgctctctggctttgtgaccttgtagtttcaacatctgcagaattagagtaataatagagcttacctaataagattactgtgagttttcagtaagttaatataggtaaagcacttcaaatggtggatagcatgtcacagctgtcataatcacctgtcattactgctgtcttcaatatcctagtgcatggctgttagccttaagataacctcataggccagaatgactgctagagctctagtcatcacattcaccttcctggcagtaggatggagggagtccttttaaagacactatctggaaaagccacatttatgcatacctcattggccacgactgaagccatttaactgcttatatctttaatagagtcatttagctaagcttggctaaaattagggtttctggtactgaaaaagaaaagcagcatggcaataactttgctaccaattgcaggtatgtggtactaggaaggcctgcgaaaagagcatatgacaagagagggtaaacaagtcttctttgagacacagacaactgaccagagaaataggtgtttgccaggcaagtggagaggggtcttaggaagagctccaggatgagaggacagaacaaatgtctgtgaccagagagagcacggacagtcttcatgttgcaccatccacctgatacaccacatattgaaaaccatggtggctgggttctctgtcctccatccagactcttccataaggagtcgtgccaggatttctcatccctgctttctcttctgggtgatgcccagatggaatggcccatgaggtccccaagtcctttgggggtgtaggtttgtgctgctattgtgtggtcgtgtgagaagtagcactggttggagcagacgtgggtccacacagagccttgtccttgactttcaacaggaacatttcctgactggggtgaccttggtgagatacttaaccattctaaatattgtctgtttcctcacctgtaaactgagaagatactaatatctaatccagagattcactacaaaaagcaaaagagctaaaactgatcaagcatttagccaggtccctggtttaaggaaaaagtccaatcaacagtgactatttctgttattgctgtcacctttatcttcatcatttcctctccttcatccccttctgaatacacattctccatgtttgaatgtgaagtgtcacctgaaatgtatcctgcacccagctttttctcaggagtgtgtaaacccacagcacaccacaacttttttctttaaccttcttttggaaaaatgacttgaggatgtattcagttatacagagaatcctacagtctgcggtgtgggccaggaaggaacccaatgctgcctgtccagacccctcatggagtaaatgaggaaatagacccagcaaggcagagcctggttggcaatgcctgacaaggtggctttgaagaagaaaacatctccccggtgtgttgaggaagagatgtgacctcatctggagcctcatgatgatgagaagtgcccaggctggttttatgcatatccaggggtcactgagacatcactcatagacagacatctataccaggcatgtgggaatgtgagtttcaaatctattcctctagcagatatatttttctcttgaaggccatcagcttgggtgattaacatggtggtggggggtgttgattcaaggattcaaggcagttaccccgattatctttccctggcatcaactctgggcatatcctagtaataaggtagcttatttaacaagggaagtaccagtcacaggttagaggacttcacacgtacatatggggaagatgtcttctctgccctcatggagtttgtgacctagcaggatagaaaggcattacttgaaaaaattacatagtcactagagttgtgctcagaactatagaaaaaaagcgcagggaaatgttttgccatttcttatttataacaaattctgctatttggttataatattctttttttttttttttttttgagacaggatctcactctgtcgcccaggctggagtgcagtggcattatcagggctcacagcagcctcaacctcctgggctcaggtgattctccccacctcagcctcccgagtagctgggactacagccatgtgccaccattcccagctaattttttttgtattttttgtagagatggagtttcactatgttgcccaggctggtctcaaactcctggactcaagcaatctgcccaacttgacttcccaaagttctgggatcacaggtgtgagccactgcacctggctggtcataaaattctttccagtgaaactcaggcatgacttcagaatccttctcaacatagcccttcatccagccgttgctaattagttagagctgggtctcaaggtaaaacctagcggccatccaagacctggcctttccccagccctctctctatcattccactttacaggcaagcacactggccagaggctggaaggcatatgcctcaagacttgagtcaaaggccaaagcagagcaggtatctggctggtctggcccctagggcagggccctgcacgcaagtcatgaatgctgggtgacaatgtgttggggagccagctcccagcagcagcatctgtggccacagaggatctgatctaaatatgtgctattctaccctgagactccttcagagaggtccagcctggtgagggcatcacaagctgtaatttacattatttaaaagctccagtaggaaagttgctctttgttctcgtaagttatttcttgaggaaaatatatgttttgtggggaggatgagggcagtcttaaactgaggacatcaccacaaaggcctggtctgtcattttccttcccaggatttcttcccatatgcttaaatggatgagtcaaaaagaggtgtttcctgctcaacaaagataaaatagagagagagagaaaggacagctctcctgtcagagaggcctgcaaagtccagcagtttgtgcagggcttcactttggtatttattttgcagtccatcaaacatttgtcatactcatggccccttgctttcacaggacatagctgcgattcgacacaaacactttcctaagaaaatatacatttttcattccacaatgttcatgtatccaaggtttgtttcctgttgtgtgaaaagatgtttaatatttgagaagcttttttaaaagtgattcctcattttaaactcagtttctcatctcgtggtctatttttttctgaactcttgaaaagcactggaggagcttatgagcttcctttctgaatagttccagccataagtaggaggaacaaatcaggaaaacatcctcatatttccgtcttcttaaattgggagacccgtataagataaaagtgttggaaattgagtgttggagaagttggagtctgcttttcatagacattctcaataccattttggagacatctctgagatccaaaacatcttgtttgttcggttctactctttgtgggctccatccacaggggcaggggtttagggcaagtttaagagagccctggtcttcttttatcagaagagaaagcattcttcccagagtaaaaagaatgggaaagtctgatgattcaagtggagaccttaagatgtctcatttagttgctttgcattttctagcacttctgatgtcataagctctagagagacagagagaaagtctactgtcacaattcccaagtgtttggggtctttatttatgtgtgaattgagttgaattagtatgttctaaagtcaggcagcacagtcctatgattgtttatctatgggacgttgtataattacttaacctttaagttccattttagtttttctctgtaaaacagggatacctagcattgggttgttgtgatttaatgggataatgcaaagacgtaatacagtgcctggtgacaagttcacactcgataaatgttagtccctatgttgagaagtaaatcttcgtaatgatgtaattcttagattgggtatttaatacatggatcatgttaattccattccagattagaaagatgctttcaaaaacactgcatgctataatggcagtcataatactgtggaattaaaccgtagcctaatactctcaacacagaaatatagacaaatatgtctcgtaaatgttgatctttttccacatacctattaatttcagttcctcgcctgtgccattgggaaagctgttatgtcttattttatggattgactgactgccttttccttgttcttagaacatcagctttactttaaatgcacaaatcctggtgcatacttccttaaccatcaataaagggaacagttaatgtgctacaaagcaagaaaaattgactttaaaaacaagcatttttctaacagtcttacctttatatacagcagggtttctcaactttggcactatggatatatgggctgggcagtttgtttttgtgggggactgtcctgtgcattgtaagatgtaccacagtgtcccttggcctctaccctctagaggccaacagctctcgctcccttccctttcaccccctagttttgacaaccccaaatgtctccagatggccctcatccagttgaaaactgctggtcaaaggaagaaggaactgggtcatggaattgtgcccttcggatcactgggcagaagagcctcggttccagctttataggagtttaccaactgctttggatgtggtgattcccaaaacacatgctggaaagctcgtagattatctgttgataccacaaattcagaaagcaggtcaaataatcagcactgtagcttcattttgaaaaataacttgctttacctctttttcacttgtctccccattttggtttctccatttgcaaatggcaagaaaatgaagctttaccattaattacttatataatgatcaacttttttcttttttgttttgttttgttttcccccttcagctccctcaggcacaaaaggtaaattctcttctgtcacattccagtcacccccagaactcacgagtcatgcatgcctccatggtgttgtacatttgacactgttcatgaccagtgaaatggtttttttccacagcttcagaaacctgaagttgggcaggaacagagaggccagcagactcagttgtccactgctcctttgctgagttagtccctccaaaggaccctatagtggccagtgattgggaggtgaatctgtgcccaactgtttctctaagaattatcaaataataggtcaagaataagtttgacacattccttccaatgtagcattccaggccttctctgaggtaatttttagggagacaaataatgtgaataattagtaaggcgtggtaaccaagtttaaatttggggctcctaagccaaatcgctgaaaacttattggattttattaattgtaaaaatcagcagctcctttgctagcttcatcatcccagagaccattagagcagatttcttgccaatggccagaccctttcactggtcctcattgtctgagatgatctagttccaccatctagaatgttctgtgtccagaaagactccatgtggttgcagtgatggctttgctgtgtcaccctcatagcatgtcgttgtatcctaaggacatttatggcagaaaatatgtcactcagtgcctgctgcattgttcttgtgtgtttcacaaattctggaagacacagcaatttctgggggccagatgttgtgtttcaagagtcaaggtagggcacccccctgaaatttaaacagcatctcctaagctctccagtttagagcagaggtgatttggttccttctcattgagagagagcacaactgctctactaaagacagtctgttcagaccatatggacaaccagaggcctagaaatcattacacaattactcagatatatttgaggtatttaaacaaggcaaggcatgctagtgtgtgacttggcttgtggtaatgtttgattacacttcaatgccatcacaaaaggacggaatacttcattaaaagttaaagtattcaaggctcacaacagcttccagggtaaataaatggtcagaattccagattgtttggaaggctcaatgtctttgataggacatgctttcttaattacctacatttgaatttttttgatagagagacttcacaaattctctgcctaaaaatggaccagcttccacttattgacatttattcatcaaatttccactgatccatatacaaagtattcctgttacagaaaataattcatgaattggaggtgccatcagccgtagaaatttgttttattttattttttgagacagagtctcactatgtcacccaggctggagtgcaacaatctcggctcacgcaatctccacctcccgggttcaatcgattctcctgcctcagcctcctgaatagctgggacagacatgcgccaccgcacctggcttatttttgtatttttagtagagacagggttttgccatgttggccaggctgatcttgaattcctgaccttaggtgatctgcctgcctcggcctcaaaatgctgggatacagtgagccactgcgcccagccagccatagaattgtaaaacaaagttcaaaacaaagcaacacagaatacagaagaacaaatgttgctgggctatataatacttcagtagcacttacttcattgcattcacttcttctgtcatcatatattgactcacatcacatgccctgcaaagtggagcatattattgtggtcatataaaagtcaaggaaggtacctcagctggcttcctaatttttttccctgtctccgaatgatgtcagacatcccaagggacttgttctatagccctatgtgaaaaggaatagctttgccttctgttcctatcatggctagaaattgtcttttttctgttaaaatagagaaaggcacttaccttacaaaatattaagagatctatgcgacatggtttcagaacactttgggggtagtttgcgggaaattcagctctttgaagaaggagtttgaacgtaaacctcaggtatctaggctggagggtaagaggagttgagggagaggtgcaccatagattgaaggcatcctcccaaaggctgcaagtctccacctggtaatgtattagcatccctgcccccaactccccttcccatcccttccccagtattacctcagtgacacttgcaagaggcctttgccagaagaatgaggttcttgcaagtgtcagctttccttagatttactgtcttgctgcttgaccagcaaaggaatgtggtggttccattttggccttcatccatttgttaccatgggtaagttacttaacctctctaagcctacatgtttttatttacttaaggagaatgataaactaactttccacttttgttttgaaagttacttctcttacctgttcctcgcacagagcctggcatatggtagaccctcaaaatatagagttcttattacgacttggcttgacttgacccctggtgcttcatagcacatcaagagagcagtcatatctgaggggtggtctgggacctctgcccaatgttttgtgattctgactcaagcctaatgaataactgggagagggcaaaagagcccagcaggtatgggtgctccccccatttcattagaaactctgttgttgggccaggcatggtggctcacgcctgtaatcctagtgctttgggaggccgaggcaggtggattacgaggtcaggagatcgagaccatcctggccaacatggtgaaaccacgtctcttctaaaaatacaaaaattagccgggcgtggtggcgcacacctatagtcccagctaatccagaggctggggcaggagaattgcttgaacctgggaggtggaggttgcagtgagccgagatcacactactgcactccagcctggtgacagggtgagactccacctcaaaaaacacacacacacacacaaaacctgtgtgcttaaactgactgcaccttcttcatgtagtcagaaagaaatggagattggtcttgaaaccccaacaaagcaaaaatttgtcgggagaattgttttgagaggtttcttcctaatgcctttgacattacccatagatttcactcatctgtggccatgattctaatgagctctttccaaacccctgagtttgttgttccaggggtgaaagagaggcacccccagccactacagctttggcctacttttcacatgaggtcatgagcgcatacgttgtaccatatggtgtctgcatttgcgctgtgtttttgttggactctgcctttgtatcatctgcaactattttctctataaatattttaaatagttacgtctctgtaaacatacttatttaaatctcttggctgatctgcaactaaaaatgtcccatttgggtgtccctcttatgtgtagcagccattaatgactgttgtctgtaagttatggttttcatgattctaatattttgagggtcttccaaaacttctagtcctttatgacaatgttttagaacaacagtttgaaaaaaaatattattttttctgtggttcttaagcatctctaagataattcctagactctataaatttcaagccttgatataaaattggagtggcactaactggtgatgaacctgataaatattaaatattcttagcaaatatggaggtagtgtcctgaggttttggctaaaaaatatgtagcaatacagatgcagcactttcaaggcgtcacaaattcattcttctgggtggaaattggaccagtttcttgggtggattgattgtccctgaattcaacaatgaagagaggtctatgtgtaagaaaggtctgctttttaaaaattcttctttacttctacagaagtgtccgagagatctgattttatgataataacatagcagaattacccaaagccatttacaaatatatgttcaatagtaatactattgaacaaaatagtccctttttctagctgcatttttcttcacgtagattctgtctataggagctaaacatcagttattcactgcaggattaatttaatcaatgtaggtttaatcaacgtagagtgggcccgaatgtttaaagtcaaaaatactcttcagggagttccaaacgtggctatttatgtggatgaacgtgtccagactctggtaccctttcccttcattttctgctgcatccacacaactttggaatttgcaaaagaacatttcttaaaggtttcctaggtgctctatgtctttcctgacaccgtattagttaatatcaacctgagaattctgagtaggcataagcatttttcacaaaaccatagttaaagcaaaccacatctctaatcctgtttggaacagcaattgatgcattcagggctgcgcagtatggcaaaatgatccctgtttaatagcccgactgcgtgttttgtttcctgttaggaacagcttaacttgcctccttgaacaaacacagcagggttcaagatctgttgttctatgcctgctgtgattttctgtgctgcttaacttgtatgaggactcaggagtgcataaattagcttcttaaatggaggtcgatttttggtctctttttcagaatggaactgttttattaatttctccccctgagtgcaaacggcatcctgaatctatttgcattttctttgtttccttgtttatattatattttggaggaataaatggaagccttcgtttttctagagtctttcgttctttctttctttctttctttctttctttctttctttctttctttctttctttctttccttccttccttctttcctctctctctctctctctctttctctctctctctttctcattccttaggtacaaatttgtacaagtagaatttggcctagctcttatctcagggtaatcagatttcagcaattgcgaggcatcatttatcattctttgcctcatttaacttctatacttcgaacagttgaattaactgtcaatgaaaattgaaaattgaaagtttgcaaagctgctgtttttgtagaactgcaggtctagtgatttcagtgtttcattacagttatataaccatctaaactgatgcaaatgaagtgcaaaactgagaactgataactatttacatttggttctggtttatgactcatttgcttttacctgtactttgctttgcatgtaaactattacatcttgttttgaaaaccctatttttctccttatcatttactattttatagtaacatgtaaggtactttttatatgcattcccaagccgggggtgttaagattgatatactcacagtctgaaaaatgatagcagcacagtggactacagtttaaattattggatctattttatgaataaggctatggtgctagaaaccagagagcaagtctagtcacttcagcttttcctgtagccagcgtgagaggctctgtggaaatctgagtgatggcatattgcccaaccctaacaatggttatataactaagtattttgttctctgccatagttctgtatgagtgtgtctgtggcagcccagacaggctgctctgctgctgaggaaggaggtgaactttgcaagtgtacccatgtgagtcttggctgaccccttttccatggccctatccaactttgcacttgaggcctgaaataaatgaatgcaagaccctcagattcaaagtgcatggcttcctaatggcaggatagccagcaggacagcatataggcactccagccgaagctacgtgtgggttcctgggggtcatggagctctgtttggaagcaagatgctatttgcatttcttttttattttctttctttctttctttctttctttctttctttctttctttctttctttctttctttcctttctttctttctttctttctttctttctttctttctttcttttctttctttctttctttctttctttctttttaaatttgagacagagattagctcatgttgcctgtgctggagtgcaattgcgcgatctcggctcactgcaacctctgcctcctgggttcaagcgattctcttgcctcagcctcccgagtagctgggattacaggcacctgccaccacacccagctaatttttgtatttttagtagagacagagtttcaccatgttggccaggctggtcttgaactcctaacctcaggtgatccacctgccccagcctcccaaagtgctgggattccaggtatgagccaccatgcccagcctgctatttgcatttcttattgaaaggaaataatctcttcatatcaaacaacctcatagtgtgtgtctacttgtgtgtaaggggaaaaatcagggtttactccattttcagatttatttgaacatttgacgtgttcatgtactatttttatgctttatatactatttttcctgattattcaggaaaaaaacaaagtaaaaacaatattacattttattattaacttttttaaaagtttttttttagcttttacacttttatgcatgaaaattgataaaagccttcaataaaacataccactacataccagtaactttcacactttcagcctttgactcaacaaccctcttttgcagaatctagcctaaattggtcagtgacttgcaattttatttataatgaggaaaagaagagccaaaatacctgaaatgagaaagtggttgaaaaagtcactgaacttccaaaaaacagaatattaagaagccataaacaaaaccatagttcaaaaggatatttaataatgtaagaaaatacatcattttaaaattagagtgtaacattttatgtacattatgctcctgttgtgtgtgtgtgcgtgtgtgtacaaacagatgtacaaaactgtattggaaagaaatgcatagacatatttaatagtggctatttcctagtggtaggagaacaaatatgtattttgttttcttaatacatttttgcatatttcaaattctgtattatgagcgtacattatttttataagtaaatgattatatttgtagtaatgaactaattgttttactcataaatacactaaatgaaatagactaccaagagttaacctaacaatagtctgctaagcccaactctcccaagaaataaacaaatgaaaaagtgggaaacccaaactctgttgtaaaaatacacatgcataacatgcattgattcttggtacagacagctataatcagaaggacaaaggtttataaacagtgggttgtcttacgtgggacaagtctgaaagtaccttagcttatcagtaatccttattttctaccaaaggcgatctaccaatctttaatcaaagactcagtccatgtcagatgcttagagcgacattgatctgagcatgggaaatccacaaaaaatggtaggtgtgtggttacaccgtggaggtcacccacccaacatgagcctcagtcagtaggtgttccctgtcctcctcacacctctggttgggggaaggactaccttggcttaaaaatggaaaaaatgaagtggggtgagaatgacatctgcccaacttgctatttggagagtgttgtaccaagttgtgtaacctctggtattgcattcatcattgcagaagggacgcattccactcctacaggtgaggcaaaggagcccatcgctcttaagactaacttgagtcagctggatatggagtggaggccccacctgccagttctcactggtaaccttggacccaggatatggacccaggatacatcgtcctgagcctcggtttttcttgttttaatggggtacagacacgtcccttatgggattttcctgagagtacaggagcagcacctgctcagggcccatccacgccacatgctcaatgaggggtagtgttggccatggcagggacagtaatattattaataatgctagcagcattataccttgtttaatacagacacatttaataaagttaaagcagaaatggtttcttttaaaaataggcaaaaagaacttggtgtttattaagttgaaaaccaaaaattgattttacagttccttacatctcagtgctttctagtttcagacttaattcttagtgtcttagaaatccagtgtcttctttcaaaaattctcatttatttaaatatgtgactgttttctatttatttaaatcaagcacagttataaaatatgactcttttaaggtgctaaaacaatacaaactgtactcacaacattgctgcaatgaaactgccttttcttttgaatgttaaggaaacatctgagtaaaaacaatgaaatttttaaagttgttttcatctcagttgttcttacatcctcgaagatataaaaacacccttcttccttctacacagaagggaaggtagaggatcgaggaaagttatttcacaaagccctctgaattgggataccatgatattaatgtcagtatcaccagtatttagcctgggtggtcttgaaggggacatcacaggacactcaatgttctgtttccttgcttatagatacaattctgtaggtcatttttattgacacaaagttgatcttgaactcaatgagttgggttttcattttggggtctcttccgtatttcttggtagatttagaacacctgtatccatcacttgacacactggatgtttcctgaaatcaacaatgtatgaatctacactttatggccaaggccttggaagaggccagctaaagaacaagttaaaggacaactgccagtatcttaaagagataaagaattaagcaacccaggaaataaacatattttattttctaattgcattagagaaagatgacacaagaacaccattttaacactgaggtaaatcagattcaatacaatttagttactaatttgaaaaccaaatctatgtaaaatataataaatgaagtctatatcaaatcaatgtgaaatcatcatcagtgattttaatctgactttattagttctcataggaagggatttcctgtgtggaagatatactagattaatatgatgagttactcaagagaaaacacacataccatatgtgcatatgcatagcttttctttactttttggcaaaatttttttgatacaatacaaatcgaattttctgacaaaatttgtctacctgtattgtttgtgcacattaaaactaaaaaattaattattttaaagaagcaactgccttttggtttttcttagtaaattgagccacatatttaatggtctggtcatgttcagctgcctgatgctttttccagtcatgttactcactggtcacatccccaattaatggatatatatccattacaaacccaaatgtagcccacttccatgagaactgaaggaatggctctggatgcgctgccagacatctcatgccaaaggattcaactgaaatgaccctctggggtaaactggagcagttgtgcaatcctgtacatcagtgctaccaagaagttcaaaaacaaaatgttagatgtttatcccttcaaattaactagaaggattttggaaaacccaaccaagtttcatgaagtagaaaatgtcaagcaaagactaatgtcgtggtatggattttctttttccagaaatgactcacgaaattgaaccacttgctgaatcatgagccctgtgtgcttggatgggacccatccatatttgcccaggcctggaacacattagatgatttacaggctgggtacttctgaagcatctgtcccttcttcccagactcccttcctctataacaacttccttcccagtgtgcatccttcctaatctcctttaatatttatgatcataattaattataattaaccactccccacccccaccaactgctttcatattatttaactgttaagaccaagatatttgatcatgggataaaggaaacatgtcttcctattttatttatgcaattcaggagatagatgaagttcaaatctttggatttcaaagaagcataagaatttctctggcctagtctggaatggtctttatgagattaattgcacttgtcagatgtcccaggcactgtgctaggcactttatgtctataattcatttaatgcctccaagaactctaaggacttttcctatttgaaggatgatttgcttgattgcaacctcctttgctacacttcaaactcctgagggccaaacatggcatttgtctttgcaccccaaaacaagagtctgagggtggagtggttactacacaggctctggcatcaggtagaccaagactcagatctctactctgctgttttctgtacctgaagcaaggcactttgcctttttaactccttcacttgtgaaatgtgcgtaggcacttgcaacgtctttgtcagggttcaatttaaggctacgtagatgcaaaacattcacagcaacgtttggtagcaagtacaaatgatatttggcaatggatatggaaaggtaggcgtgtggatggatagacagaaggaaggatggaaagatagatcaataaaaatgactcagcaagtttgagtaaccttctccagcatgttaatgcaggtctgtttgcttccgtttgcttgttactttttgtcttctccgtgctgctaagcacattgcagtgttcaactaagctgtgttttttttaagtccttttcttttatcactgtgacatcagctggacgttgtgcaccagcttctcagcacttccttacagtctcagtccaaccacattgatacaggcaaaatacacaaagatattcagtgaaggagccgtgagcaaggagagactgtataatgtgaaagagggagcactagccccagagtcttgcctgaattctggtactaattttctctgccttctttactccctgggcctcatttgtgaaataaattaaacgatagtgttggaataaattcatttaaggaccatttgctgggcatgtcttgtgtaccaggctctgtgctaaatgccgtggatgaaaagaggaatctttcccagcttctgcccttggagttcacaggctttacacaattcccagcatttcttccagccacagtgttcagtgactttgcttcattaacagtttgcacaaattttggtcctagatggtatctttggttgtagaataaagatgattatctttgtagtgaagtttgagaacatctggttctcatttccacttagttagggaaggttttatggaggaagcagcatttcagggggtctttaaacaaggagaaggttttgtcccagggccccaaagctctgacagttgcctgtgttttcagggcatctacttggaggtgtctaaaccacgtttgtgaaaatatgaacatttggccaccatggggggtcaattatgtgtcatggctcatcataaatattgaccaaaatccaatgcctcatgataattttcattgtcattagtcctgggcattcttgaaataagcaggttatacccaaataaaccaacaaagcggtttccaagacagctttcagatatgttaatcagtgatattctcatgaccatggctttatttatatatgttcatggtcaaaggcagtatcctccctctatctagaagtttactcataaaacatattcctttcttaatgacatatcctagaatcactggaacaaaaggacagaatatcaaaatgttcccgaataataacaattttattagaagaggactgtttttagattctcatatagatgttccaagattgtccagcattatattcacaaagttgtcttcagtttgttaagaagagaaagagaacaaacaaattcaacaatttagctcatacaagatgcagttaaagttcaaagagggaaatctgtttacttttgtatttaaacaagttaaaatgcagtgaaatctcatggaagaatatggaatctccagatctcaaatgcaagtaataatgattcagtaagaagagggaaaatgttttggctaaaagcaaaatatcttttttgtagcattctcaagatttagtgattacactttaccaagacaatcaagtgaaaagcaagaggacatgttacttgaaaggtttacttatttcttattcttgtttcttattctaattgtaaagtctctcaattaaaactgctcacaatcagcaaaccttaagattatcactaaaagtagtggaaatctaaagaatataagagcagagcaaaatccacagccagagtcagatgatgttaacattagccaagtaggcagaatcaatactgtggtccctttccaggcatgagatgcaataggatctccctgccccacgtttcagtggattttcacctgtgttcttcctccaaaaggtgtctgtatctctactgggggtgtgtctccagagaaaacatcctcctgaacatgcctagcacagtcttactagattctttccctgacatgtctgcccagtgttgaggataagagatgttgtgatgatggaagtgggtgggagatttgggggtggtgcaagtagttggccattgaaaggttaggtacagaggacttttttggctggtggaggagggaagggtgcagagactttgtttggggaaggtatctaaattgccacatagtctgcttacatccccttttccagatgtacgtctccctgctgttctccctggtgccctcacaaactaattgtacagagagctgttctgatggctttctgttgtcttcctctctccttgccatggagtgtgcaaactgcaggacatgggtgacatttcttcccagcctcaccccattaaccctattatgtgctacccagagaatggcccttaagaattcccaagtcattgataaacttaagctcatggggagaggtgaaagtgccaaggagttggtgtcccttttgttcaagctgcatttgagaaagtgggtgtgaaagaacctctcctttgctaagctcccctgtcacattctcagattctgcatatcttttcttcttcttcttcatctttttttttttttttttttttttttttgagatggagttttgctctgtcacccaggctggagtgcagtggcaagatctcaggtcactgcaacctctgcctcccaggttcaagcaattctctgcctcccgggttcaagcaattctctgcctcctgggttcaagcaattctctgcctcagcctcctgagtagctgggattacaggcacccatcaccacgcctggctaattttttgtatttttagtagagacgggatttcaccatcttggccaggctgatcttgaactcctgacctcatgatccacctgccttggcctcccaaagtgctgggattacaggcgtgagccaccacgcccagcccagattctggttatcttaaagaatcaatggttctcttttcataatgtctcgtctgatttatagatgtgcacagctgtgtttttccacctcttagtactactccttttctgtcaaggcaaatgttattatcagacctaattgttgataaccgccggtctttgcttcagttgggtaggtaactaaacgacatcagctggcatttaaatacttttttttttttttttgagatggagtcttactctgcagtccaggctgttgcacaatggcacgatatcggtttgctgcaaccgtcacctcctgggctcaagcaattctcctgcctcagcctcccaagtagagtagctgggattacaggagtgcccccaccacgcccagctaatttttgtatttttagtgcagacgggttttcgccacgttggccaagctggtctcaaactcccaacctcaggtgatccgccctcccaaagtgctgggatttggccacttggcctcccaaagtgctgggattacaggcgtgagtcaccgcacctggcccctaaatatatttttgtttgtaaggcccatactctggaaatggctttttgtcgtccaggacctcgtgcctgcaatttaccctaatggccactagatggtggcagtgtcttttcatagagtgcaggttgaagttcctcgcaggtgttgaaaggaagctagcagaaacaccgctgcgtattcacaagttatacacacacatataaaatatttatgtattatagtattatacatttatattatttactaacatagtcaatatgttgatcaatgttaataataaagcaacacaaatgtaagaggagcaaaatatagaagaaatatgatatttgatgagagttagtggattagcttttgttcttgacttggagccagtcctgtatctgagctgagtccaccatttgtgcacaaccttccctttaagcccaagcctctagggctgagcagatctggcaggcggctccgctgaaaaccacctggcagtcctcaaatgggctgccaagagtgctgtccttggcttgctcagatgccttccaggtccagcttgcctcctttctctgcagcttggcattcacccccaggggcttccagctgcaggagaaacagaggcttctgccaccagtcctggcaagcttcctctgaatagagttatgaagaaggcaacccaaacagatgtccttcaaaggtggaggctgcccagacagcaagcacatagccacagctgctccccaccatgggcaaccactggggaagcagccaaacttctactcattgtgaaggcttgacataaaattctagtgacaatagtcttttataccatcataaagagtagtcattaccatcagtatttgggtactttgcaggtacctaaatttcttctcttgtgggaaagatatgcaaccatccatcttgggaatgttggtacccttttgcctttggcctttttggcctcagaaatttctcctttgtgtggattgtacatggcacttgggaccacctcagtgggtatctagagctgcctaggtcatttatggcccagattggtatgtctaagagttacaaatccatttcatgctcattgaagctaaaagagaaaacttattggctcaggcaaccccataatggaaaaggggcattggtggaattgatcttgggaatgaaggcattcagggacaggtaccctcccgccctttccctcttttttttcctccctccctctttatctctctcttctctgtcacacacacacacacacacacacacacacacacacacacacacacgtctctcctcctctctgttgagtttattttattcagtctcatcgcctctctgtggcaaggggacacggctgtcaagctgacattcttatagccattcacaaaggagaataggtagtctttcccatttgctcctggttagaaaaagaaaaacatctcaggtagcctagcctgaactacatgcctagttaataaacttaccagtgcagctcgcgcagagtgtgtgtgtgcacacttctgtgtgtgaagtgctctggttaacacagcctgggttggctgtccatccccacactcaggatgggagagcttgactgctaagaaaccttgtggttggacggggtgaagaggactttcctaaaggaagtgggtgatacctgcagaagaaggaaaagaaaggggccaggcagtttacaagatgtctacccctgcattgttccatttaccaatatccttaagtataaagcaatggaatgaaatcactctgcggcagactactttctcctgcgtttgttagactggctttcaggaagcattctgaatctgtcatataaaccctgacagatattgataaacaccaggcattttcactttagttcatgctggacttggaaaagagagcctctctgctcaccgaatgagagccagcatgccattcccagctagttcttcctctgccatgttagcttttctttctcccttagcagacttgaggctccttggggataagacccatgccttattcctagttgtcttcccagcacatggcatggaacctggaacatagctgatgctcgaggagtgtttattaaggaaatcaatgagtaggtgactaggccagcagcaaaatggatgggtcacaagtcctgtgttgttatactctctggggtcatgccctaggtctagccatgttgccaactggtgccatcagtgggaaactaatcaagtattaaggagtaggcctggcatggccacgtggaccttgcacatgagttcaaatgcatattcatatgagcctacatgcatgattaacttgggaagctgacaggaagcagtcaatctgttgagcaagtttgtgttttataaaccagatgttcagtattattattcatcatttcctttgatacccaaatggtccccattatgtagcatgggaaatgaaggatatggaataatatatacttagtatacaacagagcaccacaaccacaggtttcagaggcctgcttaaagcctgggcaagtgtaattgcatagcagttcattttaagattcccacttggacttaagttaatgggattttgcccagatggaccatggtgacccccacctcctgctcctaccccttggaaaatgaatgttgactctacgtctgcatttttcttggaagccacatgtatgaatcataagcagcacccttgcctcagtagcagctacaggttggggggccacagaaaagcagggacccccctagcaacgtgttgggggacagagggtttctggccatagttggctgcataacttctgcttggtggtctgggaaaaaaaaaacaaaacttgccattgactgctatttcctatggcaagagtatagaatgcctttcaatcataaagtgcttacagtgcaaatgaacttgcaaattgatgtgtttctccatgaaacgtttaagattcacagagtccagacctgtggggactgggaatgatggagctggtgggtgcagaagagagtcttaattttctgcaaatggtatttctgtgttcctgccagtctttgttgccataatgatgaactggtatacataggaaagcctacgggttagggttctggccaagccagttcaaattggggccagaactgcccctaggagaggtccatgagatcattggcccacatgtgaactgttgccagactgaactgaatgcatttcctttgtttacctggggctggttacaaatgaatggtttcagtacaaatgcaatattatgggtttcttttttaaagtaatgatgcagtaattacatttggaattagctcctgagtgaagttgatactatattctggcttaatattttgaagttagtttctcataatcttgtctttgtgccaggacaattactagtaatttataactgatttttactggttgcaggaaaaaggcttcatttctcattattgtcaatggtatgtttttatttcatccatgttacatgttggcactgcttgaaatttgatttgagttgcaaagtggaagttgtgcggagttatggatcagctcaaatcagttttctttatagcattaacgattaatcaaggagtcagaatatgggaagacttctaattctaagagaactatttaccatgggctggttctgcctttgaaaatggccttgcaggtttccagtggtggccacagtatgctttgagtattttaagcaagatgttagaaccatgtttccaaaaactattacagactgtatatactggttgacttggttcatggcaacactaactgtcagcatcatctcatagttaatattttttgtttattatattgatgaattaaagttgtttacatattctttcacccaaattagggtgcccaaaataatcacttatatgattaccatgtatattattagtcatggttctctagagatagcctatagagctagagataggctatacagatagggtggggaggaatttagtttaaggaattgggttacacaattgtggggctggcaagtctgaaatctgcaaggcaggcagtctgacatgctggaaattgcagcaagagttgatgttgcagtcttgagtttgaagacagtctacaggcagaattccttcttttgaggggggccttgtcttttctcttaaggccttcaatggattggatgagacccacccacattatggagaataatctgctttactactgattaaaatgttagtcacatctaaaaaacaccttcccagcaacatctagactggcagttgctcaaacaactgagcatgatggcctagccaagttgacacataaaattaaccatgtcaccatgagttcccagtcctagacagaccaggagattcttgcttcattttacttgtcacggagggatataggactatcttgatatccatgtaaaacttataaaagcatggccccctccacccctgttgggagtttttttccaacacctgccagcttctctttagctgtcatgattattggtggaaatgaaatggaaaggattgccctatacgaatgcttcttgcattttaatatacatacgaatcattaaaataattattcacattcagagtgtttggaatggggcctgagactaacaagcacttaggtgctacaggtgctgctgttctgggtactacattgtaagtagtgacaccccacagctctaataatctattagaagaacaaggcaaaagaaagactaagtttaatgacctttactcaagagaccagccagtcaatgggggcttcaaacgcttagattttaggatcttctctttataatgcctctttccaagtagattgagggagcaatgcctgattattctgtggaactaaagctatggaagagaagtgtccaaatatcagaaaacacgctaggttgaagatagtggattctagttcacggattgcttcacttggggcttgaacaggctacgaagccagaaggacttgcctggtcaattttggtgcctgtcagcagtgcctccagccttaatctcattttggactctgctacttactagctgtgtgacctcgaaggcagagaaaagaagctggcatcctttgagcacttccatatgccaggtaccatgctgggcagttttctgttttgtcttcatggcaacagtgctggggaatagtgggcattatttcatatgagcatgtggagacttcactagtgcagttaggaaagattcagagctgagatttagaaccagatttgtcttgggccaaagcctaccatgttccaagactctgtttccctatttgtttgggacagagtaggggttcctgcctgtctcccaacactgtgtaaaaagcaggtgcaatggtgtgtctccatgtgtctgtaacccaattgagaggtttacagacgtgaatcacatgctgtatttcaagggccattctttttttttttctttttttttttttttgtttttgttttgggagagagtctcgctctgtcacccagcctggagtgcagtggcactatctcggcccactgcaagctccgtttcccgggttcacaccattctcctgcctcagcctcccgagtagctgggactacaggcacctgccaccacacctggctaattttttgtatttttagtagagacggggtttcaccatgttagccaggatggtctcagtctcctgacctcatgatctgcctgccttggcctcccaaagtgctgggattacagatgtgagccaccacgcctgtcctcaagggccattcttataagagaaatgattaccttcttcatcatgattttagaagtcagataataaagttattatttaattttgtttttgttttatttgttttccatctgggactggcattcagagacccagagaggtaaaacagccttgactggctaccttggggaaaataagtgcatccagattctgttgtttttagcaggggcaactcaccagaccctttatgtgcatgctttctgatcctcaatatttagattacggagaagcactcttaagaaacataagtgtctgggaggcaaaatagtaaaataaacctgtgctaataaaataaaatgaatcaggaagatccaaacaaggttctctttgaaccaaagtggctgaaagcagagaacagatctgctagagtgactaatgacaaatgatttgtttccccagctgggggctgggactgtcctctgcaaatccaggacacacattgtgctccgcgctccactaaaggcttgagtgggcactgttccatctcaacagcccctggtttggaaaggacatgattgtcaagggggtggcctccagaactgtggtttccagaccgttccccggtaactggcttttctcttccatccagctgactgatgatcagggccccgtcctgatgaccactgtagccatgcctgtgtttagtaagcagaacgaaaccgtgagtacagtcgctgagcttcctgcttgatgctaggagggtggttttctcagaccccctctgactccagctctggtgacttttgatttttaagcataggatgtatgtcatttttccttattgtttgatcttgctgttagaatcaccaaatcaaaaacagatgagaggaacccaggctggcatcattttagagttggcaacacctttccaaagtttaagtattagaggaccagaggaggaaaagccccagagaccatccatgattatggtgcactgaccactctcatttatagttaccagccttttattagtttcctagggctgttaggaatgaagtgccacaaactgtgtggcttaaaaaaatagaaatttcttctctcacagttctagagcctggaagtctgaaatcaagatgtcagcagggccatgctccctctgaaggttctagggaagaatttctccttgcctctttcagcttctcggggcccccagcattccttggcttgtggcagtgtcactccaatctctgcctctgtttccatgtgacctgttcctcttatatgtctctctgtgtccttccctgttgtaaggaaatcagtcatgggatttagagcccacgctaaatccacgatgatttcatctcaagatccttaacaattacgtatgcaaagatgctatttccaaatagcattatattctgaggttctgggtggacatgaacttggggggacactgttcaactcaccataaagccttaaaaaaatggcctttctgacactgaaaagttttagcaaatcacaatggctacatgccttggaaaatggggctccagaggcctattccttcaccttggtcctcagttggtaaaagtgttagggttattatatatttctcttgctatttagactctctctcctgggcaccagatggcagtgtaaattgagaaagcagttaacatgctgtctttcctgtaaaaagctttcataagagaaactggtgaacgtttagagcccttagctgctgaaactcttgtgtttcttcaaatcagtgtttaattttcaagagaggagagggaagctattgtagtatcttggtaggattatgcgttggggactgtagtagttaatggttggcctgagaagctctcattttacccagtaacattttgggtggagggtgggggatagaagagaccattcttggagatatgggttaatcctcaatctgtatcagtttggggaaggcaccaggcagacggtatgtgacttctcgtgagattctatttcttttgccaagttaacttactgttattataattcaatgtttattttcgacagagatcgaagggcattcttctgggagtggttggcacagatgtcccagtgaaagaacttctgaagaccatccccaaatacaaggtaatgaatgacctaatccctgaaatcaaagcaacagagatgcccagagccttgttttcacaaagttcaggcttcaaactctactttggagcgatgtttttgctcaccactattacagcctgttagcttgtctttataccatctgcacagttatttaaaaggttttttttttattatttacaatgacttgctgtttttcttatttacctcctctaacctcagtttaaagaatcaatgttatatcttaagttttgacatgatcattgaatttttctgatacacacaggatatcaacatgactggtttgccttttaaaaagatagtccaggccgggcgtggagactcacgcctgtaatcccagcactttgggaggccgatgcgggtggatcacgaggtcaggagatggagaccatcctggctaacacggtgaaaccccgtctctactaaaaatacaaaacaattagccggtcgtgatggcaggcgcctgtagtcccagctgctcgggaggctgaggcaggagaatggcgtgaacctaggaggcggagcttgcagtgagctgaaatcgcaccactgcactgcagcctgggcgacagagcgagactccatatcaaaaaataaaaaaaaaatagtccggagagttcttagaccccatccagaaaactctcctatttcctggtggggactctttggaaaaacaaatcaaaaagtgggagggggatgcccttgaggcacaacccaggcacacagcactgcccaagagtgctctaaatgtaggcatgagcatgtgcatgccagaggcatcagagagcagcccccaccagatctggttgattcactggacgaagggctccactggctgcacaggggcgaacaccacatccacccccttctcccccagcaccaagctgactggctagctggtctccatttctggcccactcagattaacgagggttctctttgtctccatctaaagggagcccaggaatcagggattattggctgccaggggcttctttcttggcaccaccctccctgatgtgctggggcctgattcaccacagctgtgagggggacctgggctttcctgggcctcaggtggaggcaggcagtggttagagcttgactctgcaggttcctggctccatcgttgatgaggtgggtgtggacaagtccctccaatccctcgttccccagcttcatccaccagggcttttataattggagttaagttcccagaggcatgaaaggacatttcattgatccaaacccacataataaatattggaaactgtagttcctgagaaactaaaagtcaaagatggagatgagggaagactttgaggcccctaaagatagtggacttgacttttgatgaaattgccagacctaggtgtccagaactgctggctcagtttcagaaaaggcatcccacctgtagagaacttttccaaacaattcttgagcctcttatttcacatgaggagatttagaaacctaagcaccgagccactacttgatacgtgtccaataaatcaagaaagaaggaacatgacaaggaaccagtaacaattatcctttgtgtccatttctccaagcttcctctaccaggcaatgtgcagagctctttatggcattatctcgcttactaagtaaacattacggtcacccccattttatagttaaagaaactgaggcatggaaagcttaaatatcttgccaaatctcacatcttgcaagcaggagaaccatgtctttttttttttttttttttttttttgagatggactctcactctgtggcccaggctggagtgcagtggcaccgtctcagctcactgcaacctccacctcctgggttcaagcggttctcctgcctcagcttcctaagtagctgggattacaggtgcacgccaccatgcctggctaatttttgtccttttagtagagatggggtttcaccatgttggtcaggctggtcttgaactcctgacttggtgatccacccgcctcagcctcccaaagtgctgggattacaggcgtgagccactgcaccctgccaagagccatgattttttttttttttttttttgagacggagtctcgctctgtcacccagggctggagtgcagtggcatgatctcagctcaccgcaagctccacctcctgggttcacgccattctcctgcctcagccccccgagtagctgggactacaggtgcccgccaccacacctggctgattttttatatttttagtagagatggggtttcaccatgttagccaggatggtctcgacctcctgacctcatgatccacccgcctcagcctcccaaagtgctgggattacaggcatgagccaccgtgccgggccccaagagccatgattttaacctctgtaaccacaatgctaccaagaacaataagagcaatgacaatcataatagtaatagttaaaatgataataataactaaaatacactaaaacatttattgaacttcttactatgtggttggtgtcatccaaagtactttacatgcattattcctgttgaattcttattacattcccatgaagtggggacccttcggcctcatttttacttaaggatgcttgaaataactttctcaacatcattctgctagtaacagatgaaggaaacgaagcataacaagggaatagaggaagaagatcaactatagaaaattaaccagcagtgcttgaaatgcaggcatgtgtgttttgtgcttttccaagggtcaagctgggaaccattgacgtagatatggcataagttaacctaaggcatccttccctctggttcccatacagagctttgtgaaaggggtacgtgtcagccagggacagccatggccaaatgggcccctctcatccaggagaggagagctccagggaacagagttcaggtcacaccttgccctcctgattaacaccttgtaaagatgagtcagctcttggctcttggggttttcccagaagatagaattctttctttctcccttagcttcatagattttcccacaagcaatcagacttcctgtaatttttattaagaattccagacaccccagcaataatttccagacaccacgacctctgttaacataacgagccattttataattgggttcacttcattagcccagactctccagttggaagggaagtgcctcctttccccaggctgttggaccacgtggcttctggcctccaggagaatatgcctctggtccagggcccctttggcaagcccaagtgctggaaggccttgtgtccgatctgttctccattactccatggcactgtacattagaatggacaggaagactggttctattttggataaaaccaaaattagcgatttcatcagtgtattgatttgtggccaaaaactaatgttggacttcgtcatataagcttttaattatttgagagactcatccacagaatgtgttgtattttgagatgtggtcagagctgcccttcctttgtctacattaggatgtagctatatgccatcaaccaacacacaaaacattctgatgttattttctcagaatgctttcctggggaggattttaaccagtttctgaatatcaggaagactttctcaggtacaggcttaagaaggactggctgtgcatctcctggagcaaattggcttctccttttcagcttgtttttaatatttactttagttggaattttcaagatgagctaggtaacatttgagttaagtggcaaatgtctaaaatacacaaactgtaactgaatgcctgccacatgcctgaccttgtcctagggactgtagaagtcaaaggtaagtgaggtggcccctttcccacaaagagctcattctgatggaggaagtactgcctccagttatttcttttttcttctcttttcttttcttttctctttttcttttttttcttttctttttttttttgagacagggtctggctctgtcacccaggctggagtaccgtggcacgatcttggctcactgcaacctctgccttccaggttcaagcaattctcctgcctcagcctccagagtatctgggattacaggcacccaccatcgtgcctggctggtttttgtatttttagtagagatggggtttcaccatgttcaccaggctggtcttgaactcctaacctgaagtgatctgcctgcctcagcctcccaaagtgctgagattacaggcctgagccactgcgcccgaccacctccagttctttctaggacaaatcagaggaaggaaagagaactacctagggttgagaggcggaaaagtgagtgtagcttttttttttttttttttctttgagccttactctgttgcccaggctagagtgcagtggtgcaacttccacctcccgggttcaagcgattctcctgcctcagcctcccgagtagctgggattacaggtgcccgccaccatgcctggctaatttttgtatttttagtagagacagggtttcaccatgttggtcaggctggtctcgaactcctgacctcaggtgatccacctgcctagcctctcaaactgttaggattacaggcatgagctactgtgcccagccaagtatagcatttttagatgctagagtaaacatagtgatgatggtatggaaaggacaaagcaaagtgcaggtcaggagagcctttttacaagagatgagctgaggctgagcttatagcatgggtgaggattagccacagggagagagaaggaggggtgccttgggtagcaggcactgtgacaataaaggtctggctgggagagaaaattgcagggggattgttactgccgtgtgccttgagtggcagtgagtggagggaggcagggttgggtactcaggcaggggccagaccccagggagacctgatgaacaggcctatggctctgtcttacatatgaaaggggttgttagtggctgtcacaaaggaaagcaacgtggtcagaattatctttgacttggatcaacctggaggatggttttgttggggtcaatctctgaggcaggaagagcagtgaggaccattgtggaaatctattgaattaatatagtagtggtacagttgggtagcaggatggaattggagcaaacctggagaaaaacattagtaggatttcatactactgatgctgcagtttctaactggggagtctgtgtggttggtggtgccgcctactgagagaggaggaagaagaacagctttagaagaactccactgtgactgggtgagtctgaggtgccagagcaatggccaagaagagatgaccactaccctgttggatacttggtttgccactgaagggggagactgaggccagcacatggatctggggagcagcagcacagaggtggtcactgcagcttattgagggagaggagagctaaggcagacagtaggtactggggacagaatcttagggaaaatgagtacttgaggaatgggcaaaggacaaagatcctgtgaaaaggagaaagcccaggagtatgggacctggaaactgagggaatagtgtcgaggaagaggaagcaatgggctaagaaaagtaggaagatttgagggagaaaatcctgtaaggtttggcaatgaagaggcccctggcaaccgtagagaaagggatttccatggcatatttggtggtggagggagggcaaaggcagaatgcagtgggttgaggcataaaggggcaataaggaaacagagatggcacttggttaatgaatacaggacattgggatgggaagatgagctcagcgtctgcattctgggggaggaagcagagagtttagctaagctgtgtagaatctgcactaaatgcagtttcttctattgtttccctacttccacctttttctctttcttctttcccttctcatctctctattccaaccaccccgccatatattgttaaccgcacgataggacctttgccctcatgaaacttacattctggtaggggaggcaggcatgaaataatcaaaagtcctgattacttatactcaaccccacagataattgattattataattttgataagtactataagagtacaggcattaagaggagtcctgccttcttttgaggattgcttctcacaagcaaaagaagaagaaccaaagtaatgtacattagaaggtgctgaatacatgagctgactataaaatattatttgttttgtttaattttgagtttgaattcccaaatacaatttttgcctttaatggaaaaagccaaactctcaagatttttttttgacccctccagtccatctgaaactaaaacataataatggtaattaatgcagcgttgactgtgtctgacatttttccaagagacaagatgaaagagacgatatacatctcaaaggataggaaatctctggtttatctttcacagcataatgaaatatacttttatcattagagtcaagtagaatcttattaagacttgctgtgcaaggtaactccagggaagacgtctgttgcccttgactaccatgtgcatatttgctttatgtagtgcaacggaaacttttaattgccagtgttaaattctctgaagttaatttcacatcaccttgacgttaagctaacaggcagacagggtcattcctggtttgtaaactctgttgtctggatcatttaatagtatcatattcaagaatgtgagtggcagagaatttaaagaaaattaacagtggggctcagaactgtgaaaaaactcctcaggaaaaaaaaatagaggatttcttttttcttctcccctttcactgctctggcaaaactgggttacattttctttcttcagagagacagatcagtatgggttttatgccagaggccgttttaatacatgaatgatttgtaggtaaatttattgtagccaatgggtgcagtcaactgtgtaatagaaatattgtcaaaaagccgggattattatttaaataagtgcagtgttaaatttgattacatactttttaaagctaataaaacatttcattgctcacaaactatttcccatagtcccatttagtcagaaaacataaatcaagtgaggctccgcatagaaaattacccaggctttgtgttgatggaagcatgcatggaaaagctaggcagccacacaatttgaagacgaaaggatatgaaaagggttgccaggctcctgtgtaggctgggacagggggacactttatatttgaagaattatggaaaatgacggcctaggggagcgccaatttgagatggcccctgtgggcgtggaattatacgaagtctagaagtgaggcagcgtggggacccctctttccttattacaggcagagagaaggcacctccattgataaagttctgtgcacttggacatagggtctttacagaaacattagccactttcttgttaaaaaaaaaaggtaattgttttgttttaaataaatcaaaataaagcccttggatgccaatgtggggatgtgacattttaaattgtgctatttgttgagcttatcctctgacaggtcttcatttccaccaaatgtcaaggatcagtgccttgcattcattttaatgaaatattgtgctgataagggttatgaatgacaagttaaagctgtaaattactaaatgccgggctgctttatgctttgtgaattcaccagggagcaagctaatgaaggtttctttcttgcttcctcttacagttagggattcacggttatgcctttgcaatcacaaataatggatatatcctgacgcatccggaactcaggctgctggtaagagaaattatgtacttctgcatttctgcttttatgattttaaaagatttccttcaattcaacagtgatgacactttgctgcagttttcacttttaaaaaactattgaattcatagcattgtaaagattgttatagagtttataaactggtatttggacacataatacataaataatgttggataaatatatttaccattatgattttgtatataaagccatatatgtgtatatgcatttatttatttatctcacatctgccaacatatggaaaatttttttaactctagacagcatgaaacctatcataacgggtcccttgatgtaatacatggacactcatactccagctctagacccacttactgcaagtctaatttgacacgataaattagacccaagatccctggaaatttattacaatgggatttgcccccaaattacattacttaagcccagtgtcttgtggatagaagctattcaacagcttttttgttaaatcagggcagctgagatttttctctgtttcctgcctatgtcatatccagtagcattgcttggtgaactgatatgtaaaccactttctttctctcagtatcatttttactgtctctgaagtgagtagggttaggccaaatccaaaacagcccatggtagcatcaacccacatccctgggcaaggctgcccttggggcattggccacaagtgtgccacatgtttgccacccctgaactagttgcagtgtgttgaaaaaaggacatccctttgggtttgtgtgtacttagctaatttttaaagaagatatagaattataaagagtaatgcagtgaacactgttttttaaagttaagaaagtgtagatcgttttctttagcaatcaacaaacacacacgtacctatatgcacatacacaaatgcatacatacccatccaccccacccatcttttcccattcatcagaatgagaaagtagcggcagtgcctgctattcaaatgtttgttggcaaagcattgtggggaccagttcacttctcacttgcatcattgtttagaaacagttcatgtgagagctccatcatcatgcaactttgctctaatcgccctggtattaatggagtcatgaccacatcatgtggatgccatatgcatgctttaagatgggccttatggtaatattcaatttcaacaatctttttatcagaaaaggactgaattaactagttggctaattccaaatgtaactcagaattattgaaaagtctgattgaaaaagcggctgtctttttaaagacatttaagtccaaagacatattgaagtttaaaactcttagcacattacccatctccaggttgcccagttggcatcatttgttggaagtaagagaagttacaagtttgcgtgacagagtttggactcctagtgtgtatttattccaaattggaaaggaacagagtccatgaaacaatcaaacccaaatcttctaccagtaaatggattaatttcctatttatcattgcctgtcatttaaaggaaaaatgaaatggaatcagatgtcagaagtcaccaaggtagcatctttctctctgtggcaatggaaatgattagctgcccgccacacagtcgactcacaatgtgaactggtccccacagtgctttgccaacaaacatttgcctagcagtcttttatgtcttctggccctgcagcaaatggtgtgtttgtaaatagtccatctgatgcactctccagagctgtggcccctgagagggcagctgaaaggctcttggaaaagcagaccaactccatcaatgctgttcatctcctaagagtacagatacttgtaaacacatgccattgctgttcttctgttgacacaccaaaagtggtagtggttgctagggtcaaaagtggtggtggttgctaggattttggccatgccatacatggggtggcccaaacaaatgccccatattctgtttgtgagaacccaaaccatatgaaccatgttgcagctgatccatgacaagaacataaggaatgatcagacctgttggtcatctgtcccattcatctgtctctcaccctgaggccatcagatacttagaagaagtttagggtgataccaaccgttaagcattacatgaattaacccatctgaatgtggtcaataagtgtatgttgactctgacttgagttctgcattttccttctgagcaaaagacgcagcatagtgggagggactcaattccagcatcacactgtgaagctcaactcctagtcccactacatccacactatgtgactttgggcaatcacacaggctccctgagctgcacttttctcttgcaatcctgccataaccatagtgcatagatcgtagcttgttgtcacagtaaatgagataatgcaagcaaaggacctggtgcagaaaagcaggccccagaatatctcagaggcagtagtggttatttggacatcttgtttgtgtttattttctattgttctgtcctcagcttccgtaaaggttggaagaacatggtggtaatggatgcttaaagaggcaacctaaagagcactttttgattattcaggtgattcaggtttttgtgatagacattgggaagggatcgtgtacatacaccatcagttttctttttggttctacggcaagcttggccaactgtggtctagaagacaagtagacaacttgtactagaggttctatgtgagtcctaccatgtgaagaaaccaaggttgtttgtttgttttaaaggtagcaataagaataatactagcagccacagtagctaaagaatgatagctaagagtcagccggcatgaatacccgtggctctggcgtgcacaagttgtttgttcatctctgttttgttcacttatccctgctttccccctcctccttccttaaccaccagtcccctcagcacagagcagggactcagtagatgaataagtgaagggatcctctaaaaccagtttcatttttacttactttaggttcttctggaggttgtaaatgacttgtgaacttaccttggaaatccagtgtcttcatggaccataaatccatcctggccagagctctcaggcatggctaggaacagccagctgctagcagcttctctggctagctcaggcagggaaccctcattcaaactccatttgtctcctcgcaagcccagccatataatcgaatccttattacaaatggacgatccccttagttctggccaaggctgccagattagcacggtgagtgtgagtgtggggttgtggccagcatggggaggacacagcaagctgacttaaaataactcctattccctctccatctgccatggactttgtttcggcccctacagccagaggaaagaggtgggtttctctgaagcacaataccaatatttttctaatttgtcctataaaatctttcccctgaacttaatgtttggcttgattttatccagtattttctttaatcttgtgtgatttggttgtgaatcacaaagtgtctccaagaacagctcagacataggggccttaatcagcggactcactttggtttaactggcaaagctgctgaagcaatgcttctctgtgatctctgggctctccttagtcctcctctaagggcttctcaacctttctgtcctcgccaccagcttgtgacttcctgatagattaactgatgttggttcagcaagcattgcccttgtgcctggtgtggctcagtcctgtgttagactgaagactgatgaagtaatcttcaaaggggccggggggctgcagcacaagtggggacagacacctgttctcaaggtggggaatggaacaacagcacgtagcaagagtgattaaatgctcttgatcttgagaaatgctttttgagttgttatgatgcccctggaatgtttgtttgtttgatcgttaccacttgttaaacattgaagtatagctacagactagattttgttttcttgctttttataattcctttgtatttgagagctttaggaatttttcttagaatgtggagccctgaatagatctccttttcttttgcccaacagcggattggtcatccatctgtccctaccttttagaataaagggacagctaaattgatttccttcccccaaggaggaggtctggaatgtggacctggtcaaaccgacaggagaacacaaaggaggttccctttcagcagctgcagcaatggcagggttccacagaggagcctcaggcaggcaaaatttaggactcatttccatgaagcctgcattgaaattggccagaagctgtttgctctgtgtctgcaaacccaggagatgaggaaggatgctgtagggttttcattctggatgaaaatctgccagtcacatgggtcacatatgtgggagtggatgagatgggaggtaaaaatgatggagagaaattcacattcattccttcaacatacactgaatgttcactatgttgtaggcttgagcaagctgctcagagaggtcacagagatgtgccctacctccaataactcaaactctaataggatggatacgatacgtgtatcagtaactgtggacagtagagaagatgcgctttttatttgtttgttgttgttggtattagtatatttttctaacattcactgattcctttttatgggacaggaactattctaagtgtttcacatgtgttaatgcttttaatcactgactaattgaatagcaagcctaggatattatgtgccttggaaaggcctagaggcttaaggaaaggatgaaggggaggggaggtccaggtggaagatacatctagcagcagcctggagttgaagtgaggacaactgtgagtactgggctgagcagctgggcttctctaagatgaaggtaaatatcctcatgttacagatgggaagctgaggcactgagtcctaaggtgacgtctcccagatcacataactggaaagtgccagaactaggacccttaaccccagtcagtttaggtgtactaagttcactctgctgcgtgggttcttcaggaaatgggaggcagagtggttggagggtgggagtgactgggatacctggtctttgcagccatttggaccagtaccgaggtaatcatgtcagaatctgtctagacttaacactgtccagtaggaatataatgtgagccacaaacaggagctgcctatgtaatttcaaattttctaggagccacatctaaaagaatacaaaagaaacaagtgaaattaaatttaagaatatattttattatcccagcatatccaaaatatcagtgtttcaatatataatcaatgcagacattattaatgtgatattttacattcttttcatgctaatctttgaaatatgatgtgtatcctacatggcacatctcaattcaggcaagccacattgcaggtgctcaagacccaccagtggctgtggcccccataagggacagcacaggtctagagtgtgaccagacattttggacccttctagataaaatggattataggacctcctctttccttaaagtgggttagagcaggctctatttccaccaccacccgtcattgtgccatcctggaagtctgggccaacagttagtggccagttagcctcctctgccgtggccaccacccctccctccctcccaggctgtagcctctccagtgtccaggagtggaagtgggaggttgcccagaattcaaggggccttgacttgattgccagggcagatgagctccatagtttggcctggaaactctgcctattctagccatgtaggttcacccctacgccatctagacttccgcagacaaactgtcatggaggccagtgggtggaaagcagtagccacactaggtgaacctgagcacttaggtcatctaaatcagaatgttttgatgccaaagccatttctgttgttctggaaaactcagatgaactcttgaacgagtttaagttttcctaacccaagagtcctcgcacctccgctggaatttaatattgctgtttccaccaccagctctccacagcctgggttccaggatggcactcgcctttccctgtgtcactctggactgtccttgccccattccaaacatggattctgcttctttgttcttgtggattcctgggcagtgcacgtttgttagtggttatagatgggtcctcatgaaaggttattaaatccatggattgatacatggacatgctaatcagtgtaaatgttctcacactttagtcctcttgtatggaactaagtggacatcccccatggacacatgtgaatatgtgttaaatgctaactagacagtgcacatcaaacatcagtttaaataagggtttaaaaaggtaggagcacttctagaatccagctgacttagttcaagcaataggccataggaagagattctgtataattccaaagaatttagatgtgaaagtcaaatggaatttttcttaactatgcaattccgcaactgaggaaatagcaggtcctttcgtccgttcctcagaaaccgcaagctccttcctgctccaaattctcatgctcaactcttctttacctgaaatcttgtcccaggtacaccttttactggcattttctcatcctccacttcttagctcagatgtcacctcagagaagcatcgctgcgcccacccagagaagccatactcctccatcactctccatcacatcccctgctttagttttcttgaatcaccactcttggaaaacgtctattgtttaacttctcccctgtggtcctttgtgaatagctgggagtttgctactacacagagcgggtagtcagtaaatatttggtgaatgatctgcaggatgtttgagtgatgctgatggttggatatctgagtaccagtttcttacaataaatgagaagagcaggtgacacacgttcattcaccaaacatttgttgagtccttgctacgtcgggtgcagaaacagaaatgtggttggttaagctcccttttcttttcatccctccctatcccctcctgcttgcctgcaagcattcatcagatgtccttaagtccagcactatgctatttaatggagacatagaagcaggtagaaggaggtctctgcccacaagaagctcatcacacaaagcaagggttccctggtggtaagagggaccaagaagaactatgggctcacagacaaagtctctgcttttccttagaggaagggtgccctgagatgcagaagggcttcccagaggaggtgggggaggactgcactcagcagatactctacagtctccccaggatcactgacctcaggcctgacttctctgtctcatctcaggaccatgcattctgccggccacagcctatgggggtggggggatggggagttgggcctagcattgttcacggaactttcggtggtccccaaatgcagggatctgttgccagcctcctggacccccgctctcaggctgctgctgaactgaaagagactgtccagtaggtggcgcgcgggcaccgccgagtacccggtccccatgcagagccagcccctgccagtgcacattctcagaacagagcccgggcgactgcaacctaggcctggtctgagtccatttcgtttagtttcaaagaaagaattaacagaggcttagtaagtgtatctgctcagaggagagcgttctctgagaaaaaataaacaagactgtgtgaccccacgtagcgagcctgttcttttggaaatacatcatttggtttgaaaaaaagaaagaaaaagaaaacagagccttgtgtgctttcttcctgacggaattggtgagggcaccgtcctcactgcctggtctgggcacgagtggacagattgcagcgttgaggggagggcttacaactcaagtcagtgggtgcctgggtttctgttgggtgggagctacgccctttctgcaaaccttgagaacccacagctcctgtgactgggtgtgtgcttggacactcaagggattgatggggtctggaatcaatcccacaggtattttttttattatggacagtgtgcttatgaatcccctttgggtgccaggcgccgcagcacccaggctaccaggaatcacaacactgccctcaccacgggtctcgggccaggccttgtgctgagagccctgggtgccttgcctgggtcagttctcattgcctcgtgcgtggagtgctcaccacagaggggttgactgtgtgtgaagattctctatatataatgatttaaaaaattaaattaataaataactacatatttgaagggcaaaaaagatattccctgatgcttaggccaaggaatgtgtcaagcaaaaagtaaattcgggtcagtcttcagaagaaaaaccaagaagacagctatagataattacccacctctgtgagcccatagttcttctgggtccctcttgccagcaaggaacccctgctttgtaggacagtgtattttcttcataaaattaagcttattcaactgaaagaatgttctttaatcctgaagctgtgtcctcaggttatttgacaaaatgccaggttgggctgcagagcctctgtcagcctctccagacagcatccccctggccctaggatgcccacctgtatggaacacagcagtgacccctctgatctgggctgcgactctgggtctgctgagtgggggacactcacaggaaatggagagaggggaggggagtcaggctgtgtgttcacccgtgtcctctgggactggctgcaccccctctaaagcttcataagcctactagtctccgggctccggcacctgcttctccctctgacccttcatgcagatgggtgggtgcgccccactgtttctaacttcagggtgctgcaccatttcctgtcatttcctacaccctgcccaggcctttccaagagcctctttactaaatcctccttaatttgccagctcatgtataccacgtgcttcctgctgtggccctgagtgatacgaaggtgagaatacatggaaggtttgtcttttatagtcattactctgccaggaaagaaagagagaaagaagaaaggaaatatggaagaatgcaaagaaaagtgaaggagggagagaggaaggaagaaagagatggagggaaggaaaaagaaaaaggaagaatgagagaccctctgtcctttattgattgattcattcattatttatctatctcccattgtagtgggagtggagaatttccatattcccttccaataagctcccccttctgctcaagtgattaagaattgttatctgttgctggcaaccagagcagcctgactgatccaaccatgaatcccaaagtctgggaaccactgctgggtgtggctctgacccctgctctcaaggagctcacagtctgacaccacctcctgctgccctgtcacccctcctttgtaaaactttagtcctctcagcctccccttcccccacagaggggtctgtccccattcctcaagtcttcttgcatggacctttgagtctgggctccccacgacattgtagaaatatcatgacacatctgctcctctgtgctgcaagtagcatgaagacactgatgagactgtgttttgttcagctttgtatatccagggcctggtgaggtacttggcaaaggaggtggaatgacaaataaatgacgagagaaaacccatgtgtaggaaatcgagcacacaatgaaacaatatgttatcaagcaccacggttgagagtactgacaagaaggagaatttatgaaagtacctggtgtctcgctgtgcactgggtagctagggaaggctgcagggagctggtttgcagcctataactttgaggccacagtccagcatgcttgggagcagcagaaggcctttcagataacatggatgagttacttgctcatttgtgtgtgactggaacccttcctcccttcctttttcctcccatctttccctcccccacctgctcctgtccttccctcacttggcatttgtctgttgaacacctgtcatgtggcagacaccctattagatgccaaagatctagtgataaagcagatagaattgtccctttatttggtgttttcattctcatagagaagatgtgggtttttaaagttctaaaacaaactgataaataaaaatactacacaatttggataagctcgccaaaagaaacaaaaatctgagaaaacaaaaagtcgggagaggtacctgccttagttagatggtcagggagaccctttcttaaggatgatggttttttcgtttgtttgttttttgtttttgagacagaatttcactttgttgcccaggctggagtgcagtggcacaatctcggctcactgcattctccacctcccaggttcaagcagttctcctgcctcagcctcctgagtagctggcattacaggcacctgccactatgctctgatgactttttgtgttttagtagaaacagggtttcatcatgttgtccaggctggtctcaaactcctgagctcaggcaagccacctgtcttggcctcccaaagtgctaggattacaggcgtgagccaccatgcctggccaggatgatgtattaagctgagtcctggaggatgagaaaaactgtggagactggtccaggctgaagaaacagtgtgtacaaaaactctgaggcatggggatggtgaatatgctgggttctggaatctgttcatagatttaggccagattttcaaagaagggtaggtgacccaggttttgttgacaaattcctatttgaggctgcatgtcgtgaagtcgttgctggtactgccccgtttcctccactctgctctgaccattcctgtatgtgtagcatggctcatacctgacagcagctaggtgaaggctttctctggcttctgtagtcatctcttctcaggcatgcagcagacaagatgtgacgagaaattagcatccctcagccaaagactgcccttctcaggtggggtgtctctgagggttgtgttttacactggctcccagagttccctgatgggattatgccacagttgcccgtagtggtaacatgcctgcaccctgttggctgccctcccatctctgaatcactttgccatgtccctgcgggtatttcctgggaatccctgtcaaataaaaactttgcacttgaatcctgttctcagggacttctgagagaattcaagccaagacaccagcaggctgatgtgtctctgcaaaaattgatttgctgtagactagagcttcaaatgcagttttgagtgctctcacataggcttttacattaacaccatggcgttgagcatgcttcccattccatttcaggcccctgagcatgtattcctaacacaccagcctgcttggagaatccacatttgcttgtagaagtaccaaggagccttggctttatgctattaataactgagagtaggcactttaaggaaatttgatttagaagataggattctcggctgctttattatttgaagaaaggatttgatgaggaaaaggcttttcttttcactggacacactctgacctttgttctactagattaatttcatatctagaatgccccatcttggatgatgaattagcaataaaaacctcatcaaaatgtaattacaggcaaagtgttgaataatgatctcttaaaaattcctgtagatttgtctgcacctccttccccttgtgggggaaatgagcctcagctgccagctactagcctcagctcaggaatgcagaccctagccctattgcaaggctgggatgtgagtgctggcttctaacttgcccagtgtcatctaattgatcaattgcttttctccatgtgattgatgcacatctttatgtaatttaaaggaccatctcaccgggggtaggaatacacaggaagtaggagctcaaggcagaatgaaacactctcctcttccatctgtgacagcctgctggggggagagagttattaattaaaatgttaactgcccagacaatagcaggcagaacagcttggagaaagcctgagaagcaggcattgcattagaactttcataactgcaaattccaggaaagtttgttcctccttaaaataggaaacagagccatctgcctctaagaggagactcgactgggctgcttaagtgatgttagactttcccaaagagcacatcttgtttgtctccggggagatggacttgaccgagagataacctagccttaccctcactctgttgtgggccctgtaaaaccctacagctggatctgacagcagaatatccaaatggtcccaactgggtagatgcccacattcatttgaataactgaagaattcaatcatttgaatgccaatgattattcctctgggagtttacattttagaaagaccttccatctgaatccccatgagagcattaaattgctatctaattagcagtcccaaattatatatatttaaaagataattagaggtttgaaggctgttggaataactggttatacatttaaatgaatcactagaaatttgttggtaatgtgtggagttttcttttatttcttgctcccctctttgaagttcagtagacccaacctcgcggggttaaatctggtagcagtaagatgaaggcagacttctttaattactgcagctcaaacctccaaataattataagcagctgtcatttttacataatcctaaatgataagacccaaagaatgcaaataaaaatgttgagaccatgggctctttggcacaataatttaatccgtatcacaccactgcactgagcattgtacttcattgaggaatgtgctccaaccgtgacacacttaggtgaactttcatcatcatgtgataggcacatctatttccaaacacatctcccaggtgccatttttacattctctgtggaggttgctaggcaaagggaaacactaatacatttggaattttgaggcaaagaaggagcttggctaagccaggcaaggtttttgctgaaacttcttctcagcctcacttgtccctctctcctagagatggagtctaccccgtgcctgccccagtggccccctccctccattatgtagcatgataggattgtccctgggagcatttgtttggcctgttgctggggtttttattggcttggccacttctgtgtgccagctaaccaaggacagaaatcccaaatgacaaacggacctaccagctccaacctggtagcctctgggttcaggtcttaaattccatgcttttgatgcctgtctcttcctggaagggcaagggcctcttgaggagcaagtcaaggggacatttactgcagccatgacagtttctttcctttgaatccaatgactataataccaaagtccataagatcaaggtaggcaattcaccccaggcagagctgaagccccactctgcaagagacaaatttagaacatcatctggaaagtagatgcacacacacacacacacacacacacacacacacacacacacaaacacacatattccaaattagatcggcagcccaaggatccctctgctaaggaatgctcaagctggatttaaattgggactgagacctggcttggcagaaatgtggccaagcagaaaggttggcccagtgagctaagctggattccttgggaatgggaaatagaaacagatgaaagaggagagaagtcagaccaagggtttatctggaatatttagaagctgacagacatcacagagtatttttacctctccacagtgaagaggtgtagagattttagaaatgtatcctgaatattagaaccagttaaaatattctgattcttccaaatgcctgcttctcccaaagggcctctcctggagtttctaagtctctagctgcaccccaggaagaggatctagtagtaactgggaggggctgggacttttatctgactcccaggattgctgcaggtttttcatgaatatggggttggactcccaagttaatgaagcccatgtttatccaggctgaaatacaaatataaatgttatgttcgtatatatttaaagggaagattcatttgagcgttaatgatttgaaactcagctctgctcagtatggaattctagggacctggttaatggtgactgtaggtcaccttgctgtcatccccttcctgcgtcctcaggatacatctcaagtaggcactgggcagtgatttcagctccagactgggaggctcactagtgcctgtttctctatggagcagagcagtctctgaggtcagattctggggctgaaattcatccaagctacttaaccttcctgacctcagtttcctccgctgaaaaatgagaacaaaaaaatagtgcctactacatgagactgtgatgagggttaaatgagttaatgttcctaaaacatctagaaaaggccaaaaacataggtcattgttatgcatgtgtttattaaatgactacatagactaatttgttcattccctcggtccactcattcgtcacatattcatgggaacctgttctttgccaggcactgtcctaggcatgtggtccggtggtgaacctgaaatagtctttttaccaaagatgcttaggacctagtaggggaaacaggcaagtaagctaataatttgcagtacaatgtgatggctggggagatagggccatgggaggctgaggagagtatgggaaggacttgacctgacctagcctggccaggtcaggacagacctccaagaggagttgaaatcctgaggggttagcagaaattgaccacgaccctaagttggagtaaagagaattcagagcacatggggtggcatgtgcagaggcctgaaggcaagaacgatgatgacattttcagcagccagctcagtctagctggggagtacagtgagaggcagggagtggcgagaaagaggccagaacagcaagcagaggccaagtcacagggacttgtggaattctggactgttgggtgccatcacctaggacatgaggagctatgaggattccagcctaagcagtgatatgatctgatttgggttgtgaaagaatctctctggctggaccctggagaatggattggaagggttagagtacaggcagggagaccgcttaggggatgcctgcttgttatcaagggcagagctatcacagtggctgacactaagctgacggcaagattgatatgatccaattccaagaggcatttagaagatagaagcaatggacatggtaggttgatgggtgctgcttgctttgcctggctcacgccactttctctgattatactcacccattccagctcctgcctgtgtttccatggtcacaggcaaatataagacccagagaactcagtcttacaagggacatttggctttcctctgagttatgaatcacatcagagctctcttgggtttattcagaccagcatgcatccagaaacatttttaaaaagacatatcactgtaattgagaatcacacacacacaaaatcaaaactgagtattttgctggatcacctatccggtcgagaagacggaccaatgatggacaagaaccagctcagtttggtagtcggaacatggctggggcttagagcatatgtgtacaaagtggtcacatacatatttatactgtaaagcacagtatcctcagagggttgcagaagaagggccaccccatttgagaaaggagagagactcagctggaaggatctgggaaatttctttcatggaaaaggtggccacaaagatggagcccttcatgtcttttcttccttcataagtatcttcaacaatttttagcaggaaaagcaaaacaaaataaagctattaaaccaagcatctccctaaataaaattacacacacacacacacacacacacacgcacacacacgcacacgtgatgaaggctcagcattctgacgttggttgttggttgatgctattacaggcataaatcaggtaatggcagttggcttggaagaaagaatttctttccctcttgcctgcatccctttattaacttcacttgcaaattcattgccagcttcctgccctgcttgtcgtttagcataaaaacctgaagttgaaggctctctctgttcctcagccatctcagagatggtgagactagagtccactgcccagggactaagttaaggagaggcattggaaatggggtgacaggatatgagtcaatgggcccgaactacttaccacaggaggaaaaccaacaagagagaactccctcttccgtggtggttagccgtggcatctttcgaaagttaacattttgtagtgttgatggatactactttgagattttacttgagtgaataaaggaagtcaatgtttttgcagtttcaaaactagaatcaattagttgtccctaattgtacctcatattcaaaacggtctgacggctccacatacccaaaagtcttttgatatggtcaactgctcaaaggaataatgtcaaagaaagttctgtaaattttttaaaaagttacctgccaaatgtcacagacatactttcaaattatagaggtcctcttttttaccctggatgttctaatgacacagcagtttctgaaaacttttatgaacttggctttggagaaggcatatatccacgttcgagaactcagtgcagccctgtctgaaatttatttcgaggctgtcttgcatctaacttttgtcgaggagactttagagacggttttgtttgcctctaagtgctccaactcatcagagcagatgcccctgggtgcccacatggatctttattttgcatgcccatctgtgtgtgttccttcctctttgccgaggagcattcttttctcagcgttactcctttgcctacagcagaggtatggagttgccactctccctccctgctttcagagtgtcctgttctctgtcccattgccggcacgaaaggttcctcccagctcaactactcagcactattttgatttttatgtctagcttgctgttacaagaccaactggctttttgagaatgggagcttaaatccagcctcggtgtggtaagcgtgtttgacctacaaaaacggtggtgggctaagccgcctcctccccacacacagtgctgtgtgtgactcatggctacccagaggacactgattaagataaaggtcattcaggttttcaaagcagcctgttaattgttgtttttttttaaaaaaaaaataccaaagctgttttagttttacagcgatcaaaaggattttgtaatcatactaagagagcacatacaacttttcatctttgagatgcttaaaaacattaattaataagagcacagtaccttttagaaaaaggaaagggcttgttgtcttgacatgccccgttgcctccttcccaccttcctgctggtttttgacacaccctcatgaccctttttctctgcagtatatctgggcttctcatctttccgtgacatgtaagattacatctccgaatagaggctcattggcatttttctcttggcataatgtctatgtcgtcccattgggcatcttgtctagagaaatctgggctgtcagggagtcacacatccaaggagacagcaccatttcagtggaaatccaagctgaaatgatatcctcccataccacaagggttccctgaggccctgagatggatattggtgaaattgagtaagatattgtaagttgggcatcagcatattgctgcttaactcactgcagccactcagtttattgtaggtgttcttttttttttttttccaagacagtctctctctgtcgcccaggctggagtgcggtggcacaatctcagcccactgcaacctccgcctcccagtttcaagcaatttttgtgcctcaacctccagagtagctaggactacggcacacaccactgcgctcagctaatttttgtgttttttggtagagatgggtttttgccatgttggccaggctggtctcaaactccagacctgcctcagcctccgaaagtgctgggattacaggcgcgagccactgtgcctggctttggcctaggtgttcttaatctgacactgcttctcctctccctggccaccaagctcagtttcagggcaggccaaatgagtcagctggtaacagagacaagaccggctagtgggatttgactgccaatgtgattctgtgactgttaatgggtcttctgggtccagtcccatcagcagttgccacctgaaccaaggacctgcattagccaggagaagagcacctcaggtgaggcagtgccgagggccggtgaccaccagaccacaggctcagaaacgaggttgggctggctgcaccacgatgctgctgcctgtcagccatgtcaccacgtgacctgcctttcctgggtgctgcgttttcccatctctgaagcagttatccctcacctggagttgtgaaaatgaaacgagacacgtaccgctgttagcacaaagcctggcaccagaaacattcaccttcatgacgaatgatgggaagtgcagggggaaactgcccagtgggggaataatcgcttttttattcttttctaaaggcactcacttggaaagcagaacaagattagttactacattttataaattcctttttaggaaaacaatgaaccttgaaaagtgaaaacagtaactgattcaaagtacttttaccctttgggaaagagagcagaatggcaggtgccgacgccggtgtggtgttagtaagggcaatatacttttcactttgtatacttttcattattttccaaattttcaacaatgagccgttattacatggataagagggggaaagtaaggaaacaccaaatgcccaaagtacttagattgtgactctctcaaagtacttagattgtgacttcatgccccccaccttcccgctactgatccccaagggagtaggggctgacagaggccactggggctgcctttccccggggccacctcctctgagtctgttgcaaccagaggccttgatgtgcagctggcaacatggaatcaaaggggaggaggccctcactctgccacaggcccctctggccttcgccttgaccttgagacaaatgagcaccaagtcaggtcgaacaatctccttaaaggaatagggctatttataaacaagatactgttatgaactccctttgcctgtgaaggaacttcctccctaggggtgagctgcatgggggcaggggctgctgcatctcatcaatcagtatcagccattggtactggccaaatgggcgtgttttcaggccatatttattaagacacaggatgtgctgggctccttgctaaaccatgtttatacccatttgcttcttagtgcagcactgtaagctgagtgcccgtacctccatcttacggataaggaaaatgaggaaaatgaggcacagagacgtgcacacctagccccagaccacacagcatgtagaactgattagaatcagagtctgactccaggaccctggctttaagcacccttctcaatgggttcccttgatgaagcctgattcactggtagtgaattgggatcaagaacatgagggtgggagctcattctccctgggtgcttttccatgccctccaaggcttgcccaggcctggcacagagcctgagaaatattaggtgtccaacagtattttggattgtgtaggtgaacaaatgagtgaatgagggaaagaatggatgagtgagtgaaggaatgaagtgccctgtggccattggtccttatctcttgcatatggaggagtaaggcgtacctacatcccttctcctgaaatggtcccttgagccttggggaggagagaagacacagggcttcagaggaagtggtaaaggtcttcaccagctgaggactgcggctgcctgggagagaaacatctgccccagataatcgctggctgtcagccctcggtcacaccccatgtccagatggcattagctttgggcaaagtttcttcctctcccaccccatccccttccttcctgttggcagcatggagtggcacatatagattatcaattattagcacacacaatatttgttccacagaggctgcatggatgtgtacagctgatttcctctggcctttcccagaacacagaaagagcaaagggtttttgttttatttaaatcaacatggtcatcatcttggcccagcccactgtgcttccaaagtcagtctctaggtaacgcaaaggggtgctggtatccagaccattaaatatggccaggaaggctctgtgctgcaggcaagtcctggttccagcttgctcctcggatgagtgccctctcgtcccatcctgctaggccaagggcttgtttgtgtgttccccacatctggcctttatttgaaactccacctcgaagtatttcatagcacagaatatctttccttattaaactctcccccacagatttttttcgtaaaacaggcaccaaaaactacaaacctacctgtggctctcaaagtatctgtttataaacctttggaaaccgtttgcaattagttaatcacattttcaaaggaagttacagattatagatacactaacaaatgccatacacgatgcttaggccccggtaaccaactcctcacgcagaagaagaagaagtggtggagccgagggacctgggatttgtccccttttaaaactgcatgggagaagggagattgggcatgggagttggacatatgagaatttagttctttttctgtcactcatgggggtgaggggcgagggggagtaggcaaggagaaatcaactgtgcccagacgcaatcgtgtatcttggaaaacagtgaggcattttataaatcacatgttcctcaataatcatggaagcaccagtgtttgtgaatacttcacataacatgtactttaaaagccattcatttgaaaagaaaaaaataaaggaactaaatatatacaagttggaattctgttgactactcaatgcttaagatctaagccagctttaaaaaaaaaaaaaaggcctttaaaagggaagggggataatatggagataaagtattgatacatgaaacatccaaggatttcaggtacagcctgatccaggtgcacacaccaccttttcaggactctcttcatatcttttctctgctttccctgcactggcttcatgcccaggaagactctctccaagtagtggcagagatggccatgagctattccaagctcccatcctggcaccttagcaactcctcttttcctggataaatccaggaatgcatcccaaattgaatctcttgaatctcatttgaatttgcgtgggttatgtacccacctctgaaccagtgacatcctggagcgatgtgggcctcccccactgatcaggccacatgaaggatggttgtaccttcactagaattatgcttaatgggagtggtgcccaaggagttccctacaggaaaaccgaggtgattaacctggaaaacatggggaatgggtggtggcaggccaaagcatgggaaccttcctaatggagtgccactctctggccttttaatgtagtttcttagtaggggaaaagaggtaggtggatttaggcttagtacattagagttgtctcatagctcttggcctgttatatctatgcaacagcccactgacttttccttttctcactcaaattaatcactctgctgcatgactgtttatattctaaaggagcttattctctaaaaaagacccaaatgaaaagtgtttcatacccattttacgtacctggctaagcagacattgtagaagggcattcttaaacagtgttccagaggaagtatccctacccccgatctgtatcttgccatgaaattagactatagagacttgctggaatatggtggctcatgggctagtatgatgggaaatcttttattccatcactctctaatcattccaagtatcttgaatacctttttggtgaaatatactgtatttattgagagattataaaaaacgaataaagacatttggggaggatcagaagtcaagaattctctgctgattccacctttgccaaataccatctaaaatgacttgggttctttagcgcaggtatgaattttcggccaggagagtcttcagttcaaacttgtaagctccacaccaagcagagacatatgaatgtgattgtctgacaccatcatagtcaacaaacagcttctgtctgcctatggtttgcagaatggtgaccagtaaaattattgaatggtcttcttcatttcaggaaaatgagatattagccaattttattcaatgagcctgtgtcattccacaaaatgcatgactctcaggaatcttgctagctgaatattaaaatattttactgtgcctgggaatgtgtttgccattttacatacaatatttcatttaatactctcaacctttctttgccatggaggtgctattgtttttacccattttgtaactgacgaaggaagcttggagtagctggatacctggctcaggatcacacacccaatgtgatgtgagtggtgtgacacggcagagccactgtgaccttctcctctgaaaaagacacgtggacactttttttgaggacgaaggaacatttgttgctctggagcttgtagtcttttttcaaagctctttaacagtggttgaaataacatgaggcttagacatgaaaatttgacagaggctggtgttgggtggggtgtcctctaccatacaagctatgcgatcttatttaacttgtgatttaatttatttaacttgtgagaacctgttttcccaaatgcattatgggcaataaattgaccttaaagaagcagaattaagaaggataaaccacaagtaagtccttgggaaagagtgaagcactgtttaattgactttgtatctttagtgccttgcacttagtagtaggtatacaataaatgtgcattgaataaatgaataaagaagcactttgaagtgaccaaagaaagaacttcctcaaaatagacagtttagatccagtatcaggctacccaagaaattacgaaagttctgcatgtgaagttcaggatctgggctgtgtgagtttctggggtacctaatagttctcagtaatggttcttaggtaacagaggtccagaacgactgtctgactctaagtcctcagggggacactactatccctgccccgcactcctccacactgaggggcaaggcaccgctgctgacaactccggttgacctcgttgctgttcttttctgttcagcccaagactgcatctcacaaggaccagggcttccatgcacacaggaactttccttaacaagatccaactgctaatctgctattgtttacagtggcttctgagggaaccactttccttccccttcatctggagtggatctgatgtcataaaactgaccgtgaatgtctgttaattgaaaacctaagagtagtggggtgggctcaccgttgatcagggtggtaagagcccactggccataggaggctaggcaccatcctaggtagtggtgaggagggggagtctccagagaggtcgcagagttcctgaaatgcagttgacaggtaagaaaagagtgcatgcgtggacacttggccctgtttggcaccacagtggtgcaagatcgaccccttctggccctcccctcatcccactgggggtcagtttacacttgtctggttcaacatatgggtggcagttttctccttcatgcccagtatggcctcagcacctgtctccatagtagctgatcagtgtcaaaaatggcaacctatggttttggggtcttaaaacacttagactgaccctgcatctcacttagaaccttccagttaaatcaaaagatgaccaagctggagagaaaagtgaaaaagaaagcagtatacatgcatatatatttttccaatgtgccattaaccgtaactgatgaacgtgtaaaggggttgctaatccttagcctgcagcagagggcagactttcctacattataaacaccccacaaccagcatgaaaggcctcaagacacaagaatgtccagacacaagaacgtccggtcgataaaatggtaggcttgcagggtgactaacaccagtgatttaggggagaaaactaaaaccacttccccagttattcatgcactcatcagcttttccggagaaatgccctaacagccattacatctggctatgattcccaataccctcatctactccaggtaaaggagccatgcttagttcagtactgctgtggccagtgtgacagcgaatagatggttctgtgtgtctgcaaaatgccaccagtatgctgagcccagccccagctctggagatcagtgcttttgcttcctagctaaggagtacgggtaggtttgagacaaaaggtagaggagagagaattataaagtatagggggatatgactagattctttggtaaatgtaagtaagaagccctttctcgtatcacggactgagttttagcagctttgggatacacacacacacacacacacacacacacacacacacacacacacacacaccattcaatgggaagacaaatccaactgctaactagtctgctatgatttacagaatttacattgtttacatgtataccatataggtggagacacacacacacacacacacacacacacacacacacacacaccccccattcaaggaggggacagattttcctttgcatctggtgttttggaaaccaagaagtctacaaggtaaattcatatcaagcaaagagttaacttttctactcccaacttggagccaatgtttagaggcatctgaccttggctttcctgtcattaaaagtccctaggactgtcaccctgctgggcttctcaccctcatcggtccactcccaagccctgtccatgaaacaggacttgggaaggtaaagattgccctggctgatgacttcacggacttttgtttttcttttctttttcttcttccccttgctagtacgaagaaggaaaaaagcgaaggaaacctaactatagtagcgttgacctctctgaggtggagtgggaagaccgagatgacgtggtaagtgatttgttttcaggcctcgtggagaaggacctgcattgtacccacttctgtacctgggggcgatcccaggagttggccaagaggcccactgaagggacacctggctaccagagggacgtggagacaaggggcctttgtaccatgtgtggagttttataactcttcagccggtcagtcggaccagttgcagacaggccagccaccccagctgcttgtgcagtctactaaaaccatccccctgcggacgctggtcccctctgcagctgatgactccagccttcttcccagtacagtggatggcccctgacatcttcagtggaacctggctgggcaacagcaggctctgcctggtgcaaagtcagggtgcctgcaggccaagcaggcaggttcctgggcagcaagaattcacctgtcaggacctcattggcacagcccttgttttcagagtacagcccagggctctgcaggctcacttttctcctgcttggtcggctgcccatttcctgtaccttcccagcctttcattctgctctggccttgctgcaattgcaccccatgctttttccccacgtagattcagcctatggtgctctatcaaaagctctccttatacccatgacttaaccctgtcaggtcttcttggtacttcctcaataaatcagatttcttagacacggctgcctttgtgtgaatccaggtggactctccttaattaaatcataacttcccaggtgtttccatctgggtccctactcttccctttttctaagagtgtgtctgtgctgaggccacgtttctctgccctaccctcccagattcgtctagggtcctttcttaagttccactgttgagttggcgttgtttccatctctcactgcatcctgctctccaaagggatgttgaggagaaccatttgaaagcccagcctgggttctcatgccttccagaacagggggccagcatcacagtgcttccgctgcagctttccttctttccacacgctctgcactttgtcaccagctcaactagcataaatctctcattttcatccttgctggtaaaatgtgagagccatacctgttttagaaacttagcctcttttcttcttcatctgctctaagtctacttaaacccaagtttagacaaaataactttgccatttgataaaagctccttcctcctccatacccttttccccgcaagccaatgagctgacatagtgtcagctcaatagcatggtcgagttttctatcttcttattccttaaacactgtcacaaggatccggtcagttcttaggactgtcctgcacctaatgtgcccaccctggcttagcgcaattgtgaggagtgccactcaggttttagactcctgccaggttcaaatcccgccttctctgcttgccggatgtttgtcttgggtgagtgattatgcctctctagacttcagttttattttgtgttctttgttttatttttccccaagaaaatgagtgtgatggcagttgtccccacctcatagagctgttctgaggattaaatggattaatagattgaaaaacagagaagtacttgcactgttctggggagtaagtaagcattctacaagtggtagccattgttagtattattctgacctcctcagtcctcaggggaccctgtcatgaatgaatgtcctgtggatttacagttgctaggaatctttggaggggactttccattgttgcccttcctcttccttcttcactttatctgttgatttattttttttgttgtttgcttgtttgtgacctcactgaatcgtctccctttttgcatgctacttgaagagatgtatgactcagctcactccagtcatcacctgtgccccagctaattttcagtgagcgaatgtctcctttagtaatcacagtttgggaacactttgtatctcctcatcctactttgctttctcgttggagctgcaggcattggattcgcagcctcacgtgtgtgttcttcacctccacatgacacccaggactgcgttctgtctgtccaacttcagagttggacatctcaagcaagtccagtgcttttgttctgcacaaattgttctctggttacgtctttggtttgagtctcttaacttgtcgccttggaatatggtgcatttggaatgtgaattccttctctatcaacatatttgacttgggaaaacccaaaccaccatttctctcctggggatttgcatgtcactaattggagaattctggaatctacagaaagcatcattgtgaagtctgcacaaaatcttacatatccatgtgctgggccttgggatttgcacctgagtagcagaggacagggtttaggttgaaatctaggaaagaacatgtaagcacagcccactgaggaagaagcagtagagtctgcccagatgcagagaatttcttggaaggtgagttctacttctctaggaagtaggctcctgaatttagtaaccacagttataacctgcatacttccaaaaatgaagtaagttcatatatactgttacaatgtatataaaatagactggctaaaattaaaagaaaaaaagacaacaatttaaaactatttatagcagtatgagcaggacttctgtcccactctgcaggatgagttaggcatcagggcaggaatacaataagtagggcagatctttggcggacccgtgtgccagcaggggattttgagacatgcatagcccagtctgaattgccagtgtagatcccctctgggaagggaaaattatcttaaaaatagcgtttatcctttggttataaattctcagagatggcacaaggaattgagggtgatttttttgttttgttcctattaacttccagtcattcccaagctttccacattgaatgtgattattaatagaaaaaaactcataaaaataataactgccatatattagctcttcctgtacaccagtaccattctaagttcatgagtgaacttatttatttatcacagtgaacctatgaaatgggtgttttatctccattgtacaggtgaggaaactgaggcagagaatggatgtaatggcctaaggacatagagtgtggattccaactcaggcagcctggcccacagagccgtggtcttgacacttggatattccatggagagagcccttaagtccttgagtccaggagtccttgaagactctatttcagtgacgcatagtatatgggttatcctcctcggggggtgcagaaaagatagggagtgccttgcacatagtagctgctaaacagatgtttgtctgcatggtattgttgtgagtactgccccatagatgctgctttgaatctaactacaatcccttctgttgtggtaaaagccttttttcccctactaccctctaggcaactacattgcttcatacccatgatgactctgatggaaaatttctccggagtcttttttgcccgaagccctataaggcaaaaaagcctttttcatgggacatatttctgagaccttagtccatttatttgattcttttttatacccttcccagagtgtctctccagctcatgcttgagctctggacacccaaactaagcacagcactcccccaccccctccaaacccaaactgacacataggggaggaggaagagagagagaatgttttgcaggttctccatgctcaagtctgttttcctacgctggttgaatgcttgcttgggaatgacagacctgtttatccactgtgtctcccttcctctttaaactgccagcttgtctgtggttgcatgtcattaggggcttagaaatgcaggctgcctgtgcaccagaaaaggtgaggctcacgttctaatgtggacaatgagccaccattaggagcacgagctatcattccataatcatacacacaacttaaggtggccagtgaatctctggggaaagcttccttaatgaactgtaacatggctggtcagagtagcagactaacaatgaaacaggaaacgtggcttccacctgtaacgaggttggcaggaaagtgggtgctttgagtggttatccaaggagcttctgcttcagcactgcagaagagagacacattcaccaggggctctggagaagcacatctgaactggacaatgcagggcccaggggaaagggtggttcccagagagcggagaggctgatcactgtcgccagatgagtattttcagcttgaggagattttaccttttattttattgagtacactgtggtacaagctgctttaatgtccattgcattaccacacttgcgaatgcttgatatctgatatggaaaaatcaaggtatgccactgatgttttaatttgcctttctctgactatgtgttaagttgaacagctgcacatgggttttttaatgactacataatatgctaacatatgggcacatcaaaacttgtttggaaattttcctccgccaggccatttgcatttttccagttgttcactgttgtaaatccaagcagtggcaagttcaaagcagtgaacatcttgccctccccgccttaggtggggactgattgcattgctcttccccatcactttggcctgtgcttaggactcctctgccgtcttacaacctaggggtgccactcactgtgattctgggcaagttgctcctcttctcaagccgcagcttcctaagataaaaaagtgacatttctagaatgttccagcctcacagtgctgtattctcacagggcagtctattaagtcatcaaactccctttcctcctctggcaaggaggacagaaagccaccttcctgtcaaccctagatcatagtacttagagctcgtagaagagtctgccaggaagttaggacctcagactatgacgtggtcaattgttaaaacattttatttgatttttaaaaactcagaaataatatatgatttttatattaatgctataaagtatttaatgttgtccaagtgctttctcttctgatttgggaagcagaggttaagagcatgggctcaagaggcagaggcctcgttaccctgggcaaacttcttatctgtgcctatttctccacctgtaaaatggagataataacagcacctcagaagataagtttgaggggtttaaaatctgtgcctgacacacagtaagagctcagtaagaactcagtaaacagtatctctcagtagtatccgaatttcataggaatctgatgacctccctttttatagcccctgacaggatccctgggatctgggagtcctcactcatgaacactttagacagaatgaatgaaacaggaagaaagtgagccacagagaggtcacgggacagctggcttgtgtcagtggcaaaacttgaacatcgatatcgtggtttacctctttacctggggctgtctccttttcggtctatgtaaacctacaggcagttaagagcagcagttttcaatgtggggagttggaggagaggtcacaaaatccatttagtggttcatgagcaacatagcaacgaaatctactaaaataggagatagagaggggctcatcagagtaagatgtatttcttacatggctcaaagtcaaaacagtttggaaaacattgagcttgggcatctgcctcaagcaaacgcaagtccgaatcctgatgctttaagctactgaaaggtgtctgacactaagtgaaaatgagcaagatggtaatgaggatgacgatgatacagatactgttgactgtggtgttgatgatgatggaggatagctagcatgtattgagtgcttgggaggcaccagacactcttctaaatattgactcgtcagtcttcactacaacttaatgggatgggtgctggcattagttccatttttcagaagaggaagctgagtcacagagatggtaagtgatcgagatacccaagatcataaagctctggctccagagtccattccttaactacagtgccatcctgcttcactagtaggttcaataagtataacctgtttttgttatgatttaagacaagggcaagactaaaggaggcatcagtgaccctggccttggacactcccagacccccatgttgattgttctgtgctactgggagttgggggtggggtggcatggagacacagcgaggcttacctaatctctagtttgcctggggaatgtgagaggagaaggtcccaaatggctttaggcaggcaccagaaagaggaaaaatgaaaaccatgttaaagataaatcgagccgttcttaaaagttagaaagtagacttaattaggaccagctctccctgtccaaaaccacaaaagttaaaatgggaaaatatttccagaaatgcctattatgtgttgttaaaaaaatatctagagtaaaatatatgttttattttatacatgcctccagctaaaaattatgcctttactcactcacacagaagatgagaatgcaaacccaaatctagacagcctcgaatcaaatttaggttgcttgctagtgttgcagttttctatcggccagatcttactcaagctcctcaaaggagaaaagaggggaaaagatgaaaaagacaagagaggggtggggagagagcctttcctgacaggctgtggcatgtcagcgtttgctcctattccattaactggccttctctgtcgtcttgccttggtgcccatgacggcacatctttcatcactgcgtctgctgtcctcctctgaactcatggaagggccacatgtaattagatgaggtcagctgggggtgggggaggagagccaggctcgctgctcctaaacaggacctccaaaaaatcagatacagggtcgctcctgttcactgcctcatcagcaaggtcattaattggcccagatttctcagagagcatttaaagatgattcatcttaggaaaggctaacccctgtcttccaaatgcttggcctttttttttttttttcttcttctttttaactactgtgtaggaaaacgtctttaacttgattacgttttgaaaagtgatttctccatgacaaatcagtaccctttttgaaaacgtaccttgtccccagagacgttcttgctcggcatttcagcgggtctccaggagttcacgctctgacccccgggattcatcagtatcgccaaggctcttttgttattgtcctgaagtttacacgagctccccaaattaaagatgaaggtcatttatttattgttgttagcctgtctcccattgtacatgagcagttgggtgttttattcttcagaagctctgttttcgaggtgtaagttcaatatggaggctccactgcacgctgaggatgcaagatgtccagattacatgataacccagggaagaactaacacacttttcttttatcattttagttgagaaatgctatggtgaatcgaaagacggggaagttttccatggaggtgaagaagacagtggacaaaggggtacatttttctcaaacatttttgctgcttaatttaaaacaaaccactgtgaaaaattagctttgaaagctatatctggaataaatatctttcgctgagatcatttttctcttgtctttacttatctcaaacaagattcatgtagtactgttaacctgatcatagtgtgtccatttatttttatttatttctgaagacgtcacttagcagactaaccatgttttcttttctctacgacttttttttttttttcaatctagaaacgggttttggtgatgacaaatgactactattatacagacatcaagggtactcctttcaggtagagctgaccataatacatggacattccatcagacccatcagttgtgtttgtacaaaacctgctgacactctcagagctcatcatctgaagataaccaaacaccctgccaaaaggctggaaagagtgaggaaggggcttttcccaggctgcttttgttttccagaagggggggagatggttcaggctcacctaggagaactcactcaatctgccatggctttgcatctcattgtcaagcaaatatgctttgggggttcccgctaagggtgaagacaagtgcagagggttaccagggtccttaactattgaacttgctgctttgtgagttccatttcaccttttatttccatgaccaaaaaaacaatccttcaaacctggaggtggcatatccattcctacatgttgtgcctctgtttccatttctctgaactgtccttgtgtgcttgtctacttttgaatcctgttgtttctctttgtaacagtcctgaaaaatggctttgcctcattggctgctttcagatgtgtatgtagcattctaaagtttcccactactattaacttagtgttgtaattcattttgtaaaaaattatttcagtaagcctgcttcatattcctgaactggcgtctcagagctaaggagagaaggagtttactgactgtagaataatctgaaaaataaattctagcattgttgtcctaaactgccaaggatcatgggtggattccatgtggaaccaggagcaaataaggaccacatgagctgctaagtgggtttgccaaatagtctctctaacgtaagggactatgttttaaaaacatagtctcttgcttttgataaaaacggaatggatcttaaatcaagccagtgagtgtgaaaaacctattagactagggagaggattgggcaaagaagcctgcaacacagtaatgtggttacactcatgtagtagtggaagtttttgtttttgcccttgagcaggggtcaatttcccgagtcccaaagtctaggggctggagagacccatctctggctgaatgcaggacaagggtgtataaagagcagggctcatggtccttgggagggcatctgagagaagggcttgctggaagggcgagcagtttgccacaactctgaaaacacaaagagtagccaattgctgctggcatttctgatcagaagttactttgaagcagctgattgaacctaagaaaaaccaacaccagtgataatcagtggggttttgaaagtaaacagttggaaaaattgttgacagatcataaaatggaaatgtgaaaaatggaaaattaaaaaatgttagcccacaagtctattcgagtcgatgccagggatttcaagatttgctttgtctctctgcacagtttaggtgtggcgctttccagaggtcatgggaaatatttcttccgagggaatgtaaccatcgaagaaggtaagatactgcctggctcgtcttatcctttggtgtgggaggaaagctcgggagctagctactgagttagctgaagaacttgttcatctgtccgcacctgtgaccagtcccttggacattccactcaaacgaatgcctacttgataattcttaatacctttcttcttccctggtgtgcctagatttcagaatgacaggagttccgattcatggttgtgatttaatttacttatattctactttcatccacaaagctgttgactatgagtaactcacagtcaacagcattatggatgaaagcagagtatcagtaaataggaatcatccctcaagtatattcttctcatacataaaaatcagtacttgggagaaatacaaatttatgaaataactcatgcccaggggaaaccatgaaaacagagatatgagagccttagtctctcctacacagttgagccacgtatttcacttgtgtttcatggcagccctggcccaaagggaaatgtgaccatttaaatgatttacataggtcagagggagtaagtagcaccttgaagttcccagaccctcttatcttcataaagcacagaggcacagtaaactctcagtaaacaggagcagttgttatagctctttaaattttaaaattgctgtcacatgtgctatccttttcatctgccagctccctagtagttcagagaggttacctgtcccagcattaggagctcacaggggtggtggacattgtttctgaagggcaccactccctgagtggccttgagtgactcacttgcaggtcattaggttttgcatgtccacagaggaggagtgggcccagaacagtagtctttctggatgtctttagggaggacagccaggaatgggaaggtcaattataagcaaagttttaattggtcggaactgattacacatgtatgtggtgagtttccagaagctgggccatccatggcgccctcagatgatgccacagggcgtgaggaaggagatggatgttccctgagacgccaaacccctagatagcctctgatttactgccagtggtccctgcccgtgttgtttcagggatgttggtttgtgcttcccaagtgcttgtgagatcgtataggggcagaaaggagagtagagaggctcactgtgagctgggcacaacccagagtgtgcccaccaaagagctaaccatgtggtctctcttcccagagacatgccagagaacacaggcaactctgtgacttgagcaagacactctgcaggatgtgttttcaggatcatgttttcacttctagaattttctgcctctgtgggccatgttggctctgtggacatcactgcccatgaagccagaaaattcatgtctaagccatgtgaggtcacgctgaagaaacaactcatggtcagaacaataggagaggttattaagagatattaactgcctctcatgcgtctgctcccttggtcaatcctcaatacatgggcctgtccctcccttcctctctctctctctctcacacacacatacatacatacatgcatggagacacagatacacacagttgttttgcattgtcttttggattctttttcagtcactatcttcctgtatgttccacagctgtgaggctaagcagtcacagagaatttcagagctaactgtaaccactgtgcaaaaaattagctcaaatcctcagcaagggggagagtggctgcttatccacccaaatgaggtcatatcttcctctctctgttggtcctctgtaaataaaaagactgacaatcctgccagctttgctgagtaatagaacttaagaaagctgcttccccttgggccaaatagtagaggatcttgtcatctctctaggagccgtggtgtattattgttctcttctgttcttggagagggaaggagttccttggggttggcaaccatacttctataggatcttcaataaggaataactgcctacagaatgtgggaattttccacatgctttgccagtgccagagattacaaaggcggcaaataggtagcttttgctaaaaaatataaaaagtcattaccaagattgaaggtgtgggctataattctacctgctgaaattgtttctcttatgaatcttttaatctttttcaacactttgtatctttttgtgtgtgtgtgtgatggagtcttgctctgttgctgaggctggagtgcaatggtgtgatctcagctcactgcagcctccaccatctcctgggttcaggtgattctcctgcctcagcctcctgagtagctgggattacaggagcatgccaccacgcccagctaatttttgtatttttagtagagacagggtttcaccatgttggttagactggtctcgaactcctgacctcgttatctgccttcctcggcctccgaaagtgctggggttacaggtgtgagccaccgcgcctggccactttgtatcttttatatgtattgcacatgataattgttcaacaaattagagcttatgtcattattgtcaacagttccagtcatcagtggatatgatttttatcagaaggaccaatgtcagaggtgagagaattagaaagcaattaaatttccttggtgccctaggaacccagagaagaagcagtcaaaaagatcttcccgatagatctcatcttttctgagtgtcatttataggtcctgtgaaatagagccagagatgattttgtaaatgaggttgggaggatgggaactgcaactagaaaaagacttgacactctaaacccagttttctgggaaggtacagtcccttctcagggcctttgcacttgttattccttctgccatgagcacccttcctgccacctacatgactcttcctttcctcattcaggtcactttctcagtgaagcctttcctgacctccatagttacaatggaatctctctctctctctctctctctcctctctctcccttcaaccctccttatctcttggtcctccctgttcttgttccatgttctcttttcctttttagcccttgctaccatctgatattctctaaagttaaattttaatataatttactatctcttttctgccactagaaattaaatacaatgaaggcagtaattttcgttttgttttttcactgctatattctcagggcctagaatcatacctggcatatagcagatgctcagtaaaagtatggaagaaaggaaggaatgggaggagggcaaaaggaaggaaggaaagttgtttggttgggaagaaggaaaggaaaaaaagaagaaaggctgcacagatagatggattgtactagggactaatccctgtcccatttaactgttttctggcacttgtgagctatgcagtattacttgtatctcatggtagatataactcaaagagctgacatgacatccccaaggtcattcagcctgtaggtgttggagcgtgggtatgcccacttggatcatatgcaatgatgttcattctaatgtattctctactttctgtaaaatcaagcagaattgtgtgataggtctagtattttgctacttcttttatagatttgtgtttgagatggaaactggagtcctgagtgcagtaagatactatcagtcatttaagaaactaacttcccaaaacaggctataagcatcatgggagttcccgaggtcatcattcagaagtgtatgtctgctgataacccattaagatcaagccatgtgaaagtgcaatgaaacagttatccttgcagagttaggatggtctggaaccttctattaaaactcccagattccatgcaagccccagctcccctagtttccttcccaggcggatgaccgttttcacttaggatcctgtaacaactagcaatctttgctgctcaaaaacagttgagtattgacgacttcatattgttcaacctatgatttcaccctcacaaccacacatcaattagggactactattcctgcttttcacatgaagaaactgacgtttagagaagtaaaataacctgttgacatcacacaggaggtcagtggcctagcccggttcccaacttagactaaatggagcaccagagagagtgtttctaaagtcctgttaagcttctccctccggactcatttgtgtatcctctatcttcaaggggttaaggttttcctgggatgaacagccagggaaggtggcagtgctgggctgagtgaggtagagatggggagagagtcctgcctggaagggaactcgtttattttcctcagaaaataaacctgctgctccaaggcaggtcccttagggttgatgtctacccttaacccaccccgcagccctaccctagaatatttgaagcacacaggaggactgggggagtgatacttattcatgaaccccttctccttgacccccaggcctgcatgacttagaacatcccgatgtgtccttggcagatgaatggtaagaattaaaccatccctccttgaccatggcatccttcattgccctctttgattccacatggtttgtgctcccttgcccagttttcctgattccaaggcaaaggaagcagatgctgtaaatattgacatgctcttgttttgggccatgtcatgttcttaggtcctactgcaacactgacctacaccctgagcaccgccatctgtctcagttagaagcgattaagctctacctaaaaggcaaagaacctctgctccagtgtgagtatgctttcaaaagtgtgctgtgccttcaggggtgatggtggggaatgaactcaaaacattttttggcctcacttgttaagggaagctttgctttggcagagattatcagtcacatgaaatctaatcaaatatctgcttcctgtaggaacaggagaaagaatgtggattatggaaaattgtacagaatccccaatcctggtttagctgtttgcattgggctttgtccccttctgaaccatttagtcaagcaactgaataggatgaaaatgttacaactgggaagggactgtaaatatttgcatatctcccttattttgcaaatgagaaaccaaggctggaagtaggattgtgcctcattcaaggctatatctagatctcctggttctcccaagagtagggtcacgacggggacacgtagcctctcagtgtggtacatgctgagtgccctgcctaccaagcatccccttctaggggagttcagtgagtaggaaatctctcagctggtgcaaaagagggaagagcagtggcagccctggatgtccctcaaaagcaggaacagaccctatactctcacagtttgggcaggggagagccactaaaactgatcatgatatctgcccccacctctaacaagcatcatgtattcaatgacctgaaaagtgttttacatatctaatcctatgagaggtgtaaggagattatccagctactaaatgacatctccatagaatggatttactttttgggatatgccctggtggggaaaggatcagatggacatcctgtgagcccaatgtgtcattgtctttgactttttaaggacatatttaaaaaacaaaagtatagagacaatatgaataatacatttgtagtcaccatccagctttatgcagtcgtaatattttgccacacttactccaggtgctttttaaggaatgagacattatagataaagttgaagcccctgggtccctgctcagcctcgtttccctcccaaagagaatgaccttctgtatttgttcattattctcaataatttaatgctattcctacatatgtaggtatctataaacaatatgtagcattaattttattattttaaaatatatattaaactttatggtatattgtatgaattactatattataatacatacaatatgtgtataaagtatatatgtactacaacttgtgttttcacccattatatttttgaaatttgtgttgatcatttagctttaacgcatttatttgcattactatatagaattccactacataacttaatatattcattgtcttactgataagttatttctagctttcgcttttcagcaaagctcttttttttttttttgcccccagtcaaggtgaggactgtcctgtcccatgtgataattagttatcctcctctgcagagtgatttgaaaactctaggatgcctctcctagacttaccatgtcctctcattccttggcctcttccacagagctctaccaagagtccctttggatggcaacagacattctcctttaaaatgaaacaattcttggccgagcgtggtggctcatgcctgtaatcccagcactttgggaggctgattcaggcagatcatttgaggtcaggagtttgagactaacctggccaacatggtaaaaccccatctctactaaaaatacaaaaattagccaggtggtagtggcctgtgcctgtaatcccagctacttgggaggctgaggtaggagactggcttgagcctgagaggcagaggttgttgtgagctgagattgtactactgcactccagtctgggtgacagagtgagaccgtgtctcaaaaaaataaacaaataaataaaaataaataaaatgaaacaattcttaaaaagaaggaatcacaaaataagaatcccaggggttattaagttatggtatctctttcccatgtgacaacaggctgagaatttcagggtgctaaagaatttcagttttaggagaggacagagatggggatgatgacagccaagtgttcaaggagtactggcttctggtctccaaatctgggactcagcctgctggtccatggcaggaaccacgagatggggtgagaaagcaagaaactgaagtgtgagacacccaaggctctcagttgactaccttcttgcccaaatgctttggaggctcctgtgttgcaggcataccaggtgtcagaactgtttcatattttcaactagtgggaacttaactcataaagcaacatgccgcatgagaaagtagcctgcagatgctgcacaatgagcccatgagtgcctctcatgcccctcttccagccctgctgaagcatcctcttgtctgtccctcccaacaggtgataaagaattgatccaagaagtcctttttgacgcggtggtgagtgcccccattgaagcgtattggaccagcctggccctcaacaaatctgagtaagtggttgcacgtgtcctcgtttcatggccatttcctcaccaacactccgaaatatggttatggtttaaagaactaaactgttttaggaacctggtgttaaagttctttaattttcccccaagctccaaaccacaagagctagagcagattagcggctcgggcttggatggcaagctcctggctttgacatataatttgtttgagttttaacgttacatgaaatttggtacgctgaggtagggtgacacttccgagagagagggaggcggaagggaacttcgttgcctgcctcgccacagctctctctactttgcagtcttgggggagcttgggatctgggccaggttaggttgtgagtaggatggagaagtgagagctcagtttcatagggtgttagatataaccctgtggttttatttctgaagtggagggtggagggctgtggggaaggccgtggtagttgatatcaaagactaggatgagaactgctttagcagcttattattatttctttaccattattactttaagtagactattaaagattaaaaagaaaaggaagaaccattccttttcccttatattttcatgtgttacatgattcatttctctccacttttctgttcttccttagttcattccctcattgtatcttcccttctatcctgtttctctccatttttctattcaatagttcattccctcattgtatcttcccttccatcctgacattcattctgttctcattttcattcattcactcatcaagtcttgactgtgtgtctgttatgtgccagactctgagcgaggtgttggggaaatggagagaaaccacacagatagagcccttaacatcatggcacctgtggtatatagtgtgctgtattattaagaatcataactgctttgaaggaaaagtaaagacacataaagtgtaacagatctaaagtggaggaggaagatgggaactagttcaaggtttgggcagcattccaggaacagcatgtacaaaggccttgagatgagaaagcatttgacacattggaggaatttaaagaaggtggacacagctgacatatagaggatagcctggaagatgtcagaggatgaggctgcagaggggccgcatggctcaggaccttgggagtcaggttaaggattttggattttatactcagagcagtggaagatcactgaaggattttaagaaggggaagaaaatgatcagattttcattttacaaaaagatctctctattgctgtgtggagaacagagggtgatggggtaagaacaatagtaaaggttcgtacagttttcccagggattcatgacttggacccgggcagtgggcacagagagaagaggtccacttgtggcttgcttcagaggcaaggtctccaggacttgatgatgggtttgttgtggagggtagggaggttgagccatcaaggatcattcccaggtttatatcatgagctattgggcagacggtgctatttgctaacacgagagacactgggggaggatcaggtttagggctgggcatggccagtctctcttctagacatcgtgagctgaaaatgactgaaagtctcccaaatggagatgtcaggtaggctgtttagtatgcaaatctggagccccagagagactgccattttcattattaggggtgtctttgaactgcttgccttcatggcatggatcttatttcctgggaagctggcaacgaattgagcctttcctggggtttctttctctagtaaaccttgtagtgtttcttttcggctctcatgaaactcaaaatcttgagcaaaggttgctgattcattcctaacacatactaaagatttccaaaatggtaacttgctttgtagtccaccatctgtaactgattggacagcctggctttccaatttggtgtaggctacaagcagaaatgcattgttttggtttttattcagcccttaaatacttaaaggtagcatccaccattttgactttcatcaaagatcaagtaaccaaatgaccttactttgaagataacgtggagaatactttggatcaaattactagtagcatttaggacagagaaacaagctcaagaattggtgttctcttcatacatttattgtaggataaaattatgtgtttgtggaccaggcatggtggctcacacctgtaatcccagcactttgggaggccgaggtgggcagatcacaatggcaggagatcgagaccatcctggctaacacagtgaaacgctgtctctactaaaaatacaaaaaataagccaggcgtggtggtaggcgcctgtagtcccagctactcggggggctgaggcaggagaacggcatgaacccgggaggcggagcttgcagtgagccgagatagcgccattgcactccagcctgggtgacagagccagactccgtctcaaaaaaaaaaaaaaaaaaagaaaaagaaagaaaaaaaatattatgtgtttgtgaagaaaggccatttgctttttgcataggagaaatataccttgcaaatctcctaaagaacacgctcaagcatatagaatttgccttggaagttgaaacaaaatgatatttagtgaatttttacattagttttccttgccaaggccgttcttagagttcctatgtgtagcctcctacagagctattggaagaagccatttctttacacatctctttggggttggtggtgagaataaggcctgtggtctggtagaagtgataagctggggcccccacaactgtgtggatgtcaaaaccaattccaactacgtggaattccaggctgtgggatgctgcaaacttggttccatggctcagctgctttaatggcagattccacaaatgatctcaagaccaagaataaacttggtagctttaatgcaaaaagcgagtcctaagccctaactggctagtccttcccattcttagcctgatctctttgaacttgcacccagaaccttgaaataaagatgtgtgtatggttggaagtagatttttttcacatgctgcttttgttggcaggaagttcttcatttttcctgcaagtattactttgaaaacttttgtaagggatacaagttggcaatctgtgctcgtgtgtgtgtgtgtgtgtgtgtgtgtgtgtgtgtgtgtgtgtttctgtatcttcttttaaagtttaagtttcaaaactgctatttggtaaaaacattctgtgagtcttaaaatgcaatgtattatctgcttactgtctagaggcctccccctgacgtctgttgttctgtttcagaaattctgacaagggcgtggaggttgccttcctcggcactcgcacgggcctctccagaatcaacctgtttgtcggggctgagcagctcaccaatcagtaagtaggagggatcctctacaggggcccagggagcttctgaaatggaacattcaaagggaagcttatttcatttcttgattccactactggtagaaacataatttaggccaccccaggcctattgagatttttcctctctgttctaccatgcgggccccagcatgtgctttcacctgcctgttagcccttccaccaccctttgttcctcaggcttgttggcttctgtccactgtcctggagtcctctcccgccctgatgagtcatttcagaactctgggaggtggtgcggctgctgggggagccgccagagggaggaaacactcatctcgtaacaaatggcttcagggtgttcagctgttctgcagctatgctgaggaattcctgcctgtacaaaagtcactgttccaagtcctgtttgtttacattttactaataaacctctgcctctgtgcttagcctgaggggctgcagagctccacacccaggagtgggccctctggggatgctggggtttgacagtgtctccttggacttccaaagagacgtggatagatggtgggcagagagtttccaggtctagtacccagatgctaagcccctgcatcttcagagaaccacgggcccttaactcatcaaactggtgtttcaccagggctagtaggtagactgtgaagtcttttctgagtctgttaataagttttttctatttcttttctctgaagcaagagcgattgttaagacatggacaaatgggtcccaagattcagaaagttagagagtggtttgcaagtgtgtgtgtgtgagttcagaggttaccacagaacattatacccccaaccttcagggtacctggaggtgaataaccaagccacagagtagctgccaatttgagagggattggctcatcaggggtccaaggaggcggtgcttccttggagcttgacagtgctgtttgcctctgctaggtgaggccctgacacccaccatataaccttacaaaaccaagtctggtaaatgacagatcaatcaatgtttaggtattttaagagattggctttgaattctgttccaggactttgaccttcttgatactcacatttatcatctatgaagtttgattatagttgcaacttgatttttaacgacttttttaagcgtttttcccccagacaattgtttttccagagggcgagttcctgggaaggactagaggtgctgagatacacattgccttctcctgttaggatccagataggcaaggggagacaagggaattcattttctaatactcattgagaaagtctgctgctggcattgagactgaaacaagcaaagctgcaaaacagtaacaataaaacatgacaccttgctggtctgataactgtgttattgtgatggatttaaaagacaaaggaccacagtaaggatgctgggaggtgtacctggcttatctcacttgggtatcttcattctgtcctcctgaaaagtgagagcgatgatctcttttggttactgtgaagatcaaaaaaaattatggatgagctgggcacagtgactcatgcctgtaatcccagaactttgggaggccaaggcaggcagatcacttgaggtcaggagtttgagaccagcctggtcaacatggtgaaaccctgtctttactaaaaatacaaaaattagccgggcatggtggcacacacctgtaatcccagctactcaggaggctgaggtaggagaatcacttgaacccgggaggtgaaggctgtagtgagctgagattgtgtcactgcactccagcctgggcaacagagtgagactctgtctcaaaaaaactctttttttttttatggatggaaaatttctttgggaagctaaaaattcctacaactgtgtgttctattctttgtggcattacgtgacccacagagtgggtactcattgacaatttgaatggatgaaatctgtcttcaagaaactcctgtcattgcttcatatagaggcaccttgacatctattgtcttagggtcttacctgcctatcccctcccatcaaatggtatttgtcaagatccagctatttggatacactctctaagccaggcttagaaagtttttagcatttctgacttttggtttagtttttgcttttgactagggcatgaaaggcagagctttaagtattgggcagagaacttgataatataaagttgctaccctgcaattatctcatactatcatcagtctcctacactgagatttcatcccatacccccgccacctgcatttggaagtaggtcgattatactgaaacttggccgtcacccccaatagttataatacattctgtgccttcagtacgacttctcacatcacatgcatatagcatccagtgatgttagccttcacagcgtacagccttaagttaagaagatgaccactttacccctgccctttcaaccaccaagaacaaaagagctcttgggctttaagaatcccatatatttgttagagcctgttttcagtgtccataacactctttcacatatggtgttatgtaattctgatacaaccctggtaaagtgcagcgtttttattgttcccattttgtagatgagtaaatgggggtcggagactcaattactcactcagagtcacccagttcttcccagaatctagaccagcctgacacaccactgcaatagctcctagtatccaggaggagactttcaccttacccagaaggatctttcttcctgaagaacatttttgggattctgtaaaatcaggttgctccttcctgtttcctccagaattgctgcctagtagttggcagaggcctccagggtttcccggcaactcagtcctttcgcagtgacaccagggctaatggggatcaagtgctgcaggctcctgctggctgccctaggtgccagcactgtcccgggcagcagggcactggacacccagatgtgcagcattccagatctattgccagccacccccaaagcctgaatgtcactgccttaagtgaggaccacttcataccttctaaccaagccaccatctcatctaccatgactctggaaaaaggtcccctgtgggcatcattaacctgtgctgcatagacagggcacctcttagctgtaatgaccactgaacagacctgctgggagtgcgaacaccttctgctcagtcgtggctgcacctgtgacccagggtagagagtagcaatgcatcctgccatgggccaggcaacagaggctcctcctcacaccgtccaggtcaggtttatgaagaatttcatgtctagcgaaagaaatgaaaaggctaaaatttcagtattcctgaagcctgatgacttttagattaggaaacattaccactgaatacaagcagcacaaagaagagcttgtctaccaagatgagcctggaagtcctgatctccagcattctagatagcacaggggatctctgcactttctcagtcttgcacatgactccaaagttggccttagccttctgaatgagagaagagtgctttgtaaaaatttttcttttaaacacttttaatttctggagagtcattttgtcagtaagagtcaagatcaaatgcaagcagctatgctatgtcagaccgtttttgacctacaattacctagttctagtagcacaaaattttatagcagtattaacaaagtagagcacttatgaagacggccatagaaaggaatttaaacaaattgagaaattttatttttgaagatataggaaattgtgtttaatactggaagagctcttatctggatatgagattagatttttcttgtgatcattaagcatacaccaagcgcctgctgagagccaggccctggaaatattgggaggaggaaggtcccagaccttagaaaggagttaggacatgctagtacaagttacagggaggtagattccagagctatctaagaacctggagggtgtcctcgaagggcatgggcctcctctccaaaagtgggcactccatctttggtagaggtgaagggaaccctggttagacacaccctgcaactactgaatgctttcctgaactgggtgccaagttcaggaaaccaaccagttacaacttagcatgaaaatttctctccatggtccttgtgatccaactctctgctgcaaactgctgggttgaaagtggtgccatttctgcttcaactcatggccttttccctacctatatgttgtcccttgattggtctcccttccagaaaaatgtctgcagcagactgtggcctaaccaggcggtcatccccccaccgcctgagttgcaccgtatcagccaagatgaggcgcttcaggtgctggacagcacatgtgactctccagagggaatgtcaggtcaataatcatgcactgggacttgaatatgcttaaggctctgtgaagagtgcacaaatgtgaacaaatctcctgtcctcagagatcttgggaggtctggggaggggatatgatgattgtgcaggccaaaaaataaataaaaggctatatgaaagttaccaagattgtgggggcccagggtgtggcaaaagcttgcatgtgtttctgtggattcatggggtagatggtagatgaggcgcactttgaaaatgagtgtgattttgaaaggaagagatagaaagaagactgcacctagccttcccgatagacaagctctctgcgcagaaggcagggagtcagtggagggcggggatgcacacagggggcatgagcaggcctgtttgtccagcgaggaggcaggtgagggaagaaggtacaaagatctcagtgtgggctcacatttacttcctttgcacttcttctgagaagcgtgtttaccttctttacacttgctctaagaagaatgagatctacttaaggagttgattctcccaagggtatgagtatatgtgtgtgagtattaaagccagacaaagctttcttgtttagaggggacatccttgggttttctgataggatttctgtaggctttgtttgcttggcttcagactttaagacaattagttcactagatatacaaggaaaaatcattttacccactcagaatttgactcccagagctctgcaagatgtttttgagtaatctggggtgcacagtgttaagtgaggccccctctatactgagaaaggcaagttggggttctaaaagtgaacactggttttacctgatgaaggctgtcggggtgctccaggcccacctttactctgctgagtgatgcatgttcttctgattcttttccacttcaagggacttcctgaaagctggcgacaaggagaacatttttaacgcagaccatttccctctctggtaccgaagagccgctgagcagattccagggagcttcgtctactcgatcccattcagcactggtgggtgcccttgttggaggcgggctctgtctgtctggtccagtgggtctgggcattgtgtgcagggtgttggggagctgcctgaatgctgaaaggaaccaagttcaaccctcagagccagtgctgaatattgggtcagccctgaaccagtgaccagttccataagagtaatagcctcaaagaaaaggaaggtttttcctttaccaaattatgtaaatgtatttcaggaagcagggctgatgttttgcatcctatgggattttaatagaaacttgtcagtcagtttttttaaatgtagtcatggccccacttagagaaaattcaagcatcccttgccagaaccttcagtgagtcacatccctgcagaggtccactgttccccatttgaactgaattgatttaaactgatatgccggactaaggactgactttgtataaccatgtgctctcttgacaggagcctgcagttaccaatgacaggcatgtagccgattagtttttcagtcctaagagtttatgatatgatagtataaaaaattaaagtcacctgcctccaaaaagaactgaatgatgtcttatttccaccagttttggaagcaaaacatactggaaatgcttcagttttcctcgtattttttttttctcttgcctcatgcatctggtattttgggtgctcactctatactgcttattgcagaaacttgagagatgaaggaaacctagttctgtaaacttgggttgctctggaaagttcaatctgtagttatattttacatatatcagttcctttcatattaatcttctacaaatattcctaactcaatcctaagggaagttctccagggtttgtgcccaatccccctccctaaggcttggtgctttgtcatttccatgactgaaaatattttcagaaagggtgcttttgaaatttgtagaaagcaaagagtgctcttacaattggttgaatgggctcattaggaagacagtccctcatcaatggacatatttaaggagaggctgaatgttattgatgagattctttgctgcttgggatttcagactagattatctgttagattcttttcaggtctaaggttctttgggtctgtgctcctttgctgatagacctgtgtgtatgcctgcctgtagttgtgtgtgctttctcaaatgtaaatttccaggtgtccgaagctcgcttgcttgcttgcttgcttgctttcttccttccttcctttctttcttttttctttctttctttttctttttcttttttctttctttctttctttatctttcttttcttttcttttcttttcttttcttttcctctctctctctcttctccgccccaccccgtcttttttttttttgagacagagtcttgctccgtcacccaggttggagtgcagtggcatgatcttggctcattgcaacctctgccttctgggttcaagcgattctcctgcctcagcctcctcagtagctgggattacaggcacccgccaccatacccagctaatttttgtatttttagtagagttggggtttcaccatgttggccaggctggtctctaactgctgacctaaagtgatccaccctccttggcttcccaaagtgctgggaccatgcctggcctgaagctctttctttgtgcttgtctgcaccacactttgttgctgaaaatatcaagagacagtgaactttttcattctgctgcagacctatgaataataacattgtcttctgtcaagcaatctcttaagacttccttgtcacaatcctctaaagaaaaataatagaacttagcttgctgttcttctgattctggaatcatcgagttaactaaagctgttgttggattggtttttggtaactgggattttcaccaaactttcaatgtaatggtataatgaagtgagtttaccttgttcatgacaaagttacagatgacgtaacatcttaggacatttcataacccccttagagtccgggaaaatcttaaaaatcaccaactgcaagtctctgtggtggagctctctctgattttctctgctatgtgttgaatacctgtacaaactagaaaagaaactggtttttattgctgcttaaacttgggccaggagaaaatttctcattactttggtcctaagtgtattcatattcaggtttgacttttccctgcttctcaattcaattggatttcatccaactcactttcattgagcaccttttagcaggtgggcattggactaaattattaactccaggcattcagaatttgtgctcagtatcttttaattcgtggatattggaaccattgctggtaattgaaaatctcttaatactaatgccatattgttaccagaataataatagtttggagtgaagattatgctctagctctatccctgtttagaataattttgcccagaaaaactgggctcgaaattacaattttatagatcagtaaagatttaaccaatgaatcagagctaaagttgccaacttgtaaaataatttcaaagccctcatacagctcttcatggttatatttagacaggcagtgtaaatatgaccactgacacaagtaaacactgcaatttgaaaccacagattaccaaaaaatgtggtccctcgatggtggtcaatggtttcgatgtgaagaggctggatgttccccagtgcactggtggtcataactcaactcgccaattccttcagctgggaggactcgcagcactgcactcatggcctggcagcgtaggcagagcatccacacctcagaggactctggggcctgggaccaagccccagaacaatttgcagaattggtgactgtagaccgatatgattactctcttaacgtgtacactgtaattatcttcatttttgttgtggtgttttttcttttcacaggaccagtcaataaaagcaatgtggtgacagcaagtacatccatccagctcctggatgaacggaaatctcctgtggtggcaggtaaataattgattgaatccatgaagacaaagtaagcatggcgcccattcatccggccagtgggctacttctgtgaggcacgcttatcctccaaaaaggttttcaaaggagaaaacaattttaaattacttccttctcagcttggtgtcatctccttcaaaccaagactctgacagctggtggtggttgatgtgaaaacagaaaactttcccagcgtttctatccttaaactctgagccagtaagaaattgtcagtacttgccgaggagaatttcttgatggtaggtagcatgttcattcaaagtaaactccagatctccagcttctgtgtcattaggatgacagtgggcatacaaggaaattgcaggtttgttttaggcaaacacaaactgaaatgtgcccttctccagagagactgagattttcatccccctaatccccctggggaattagagttagctgtatctgcaggtgctgtgtttgggaccaggggaaagccaaaatattatatgactgagagtcttgaattgtcaaagaagtcccgtttctggctttttccatttctctcactttttaggagtgtcagcagctgtctgtggatggctaggggctttcattggtggcatttggcctaaagggctggcaactaccaaaaagccctctttgaagacagatgctgacataaaaacaaggcccgagggtgtgtctggcacatggtttattctgatcactttggagccattggttgatgggtgggtgatatgctccaagcaccatcctggtattggctgggtttactaaagagagcgatttttgttttccagcagtctccctcaataagttgtactttagggtgacttaacatccacttctgtgtcttcacacactgaatatttgtgggaaggagtataaatggagcagatggaggagacctgtttgaagtggttgttctttggcgaggaaatactgcttttttccccccactttatttcttacttggcctgtgtataattgtattagtagggttgaaagatctgggggtagttgccctggttattcctgagttactgggtgtgacaaggatgacagccttatgtatctgacctgtggctcatcttgaactaagcagacctattcttaatcagccaggagatatgggctctgaggattcacagttgctgtcttcaaattttgtcacttaatgtctcatgttccttgaggaaagtgggagacgggatcatttaactcaacaagatttacttatgcttaaaggaggtcaggcttgcttacctccaggctggtccagcgagctaattctgaaggcatgttgtctcccgggagctgaggccacatgcagcagctgtcagtgacatggtctggccagaatatctggttgtctgtttgaaatttctttttaaaaccctttctttgggtttctagtttagtcatcatgaaggatgagccctaaggtcactgtgcctgtcccagccacctctgtccaagtttacaaactatgctcacatgtttccaaatgccttacatttcataaatgcctgtttggctgagtataggtgaaacgtggtctgagcctgaacactgtgtatccagtctagagaagaacgtgcactttccaaatgctatgccagtctattgtcgagttgcatcgctggccatagaccacaggcaggtcacgagacacagtttggtccaccctgagtgggtggagaaggcaccctcctatttactgcttctctgtgtatgccaaatggcccccattttcagaagataattacagagcaaggccaagaagcaaggtcatttaaagaaccgtatttagtccttaccttttagaattggtgactgttaccctttttcaaactttggtagacgtaagataaaacagaattgcttggttttgatgttgaagactgctgtggatgcagccccacgaaggcagtgacctcaagaagacctctctgtctccaaaaatagagcggcctcttcagcaccccctccccaagttttcctgactctgactcaaccatcatatcactgtgtgattaggtttggtaactttcctctgtgtattttcctcaaattaagtagacactgtttaccactctaaaattaaaaaggccattttaattggggaagaagccttgttttggcagatgaagatgaatatgtgagcaggcttttctcccatcagtgtgccccaacagcagatgggagacagccgactggcaggaatgttaggtctcaatgaaatccttgtgttaaagtggaactcttctgaaagaagaggtgtacaactatgcaaataattatcaaggactccttggaaaggccagcttcgctcccaggcctgacctggtcatctcatgttcattggctatatatgtctggggtagaaagaggtttttttgtttcattttcttgttttttgttttattctcttctttctcttttgtgtgttttcttttttaaacaaaaacatttagatactcatctgtcaatgacacctttgaagaaaggccagtcagactgggcaagattccatttgtacgccagccttggtgcataaatgggccccatccatcttcccggcctatgacattgcttacagtccttctcttgagaagcctgccaactctccagctgccaccagtgtgctgcattttcttaattgctttcccactgcacaggaagaagtggtgggactctccctttggcctaccaagtctcatcctagccctggaaccttctgttgtgtcaggtccctcatccattgcattgttgtcactggaaatgcagatcttggactgtaaggtccacgcagtttgtcattcactctataacttgctaaatgtgtggtcttgggtctctaaagttctatctaaaataggcttgggattattacctcccttgccttcctgtgtgtcaattcagggataaaatgagaaaacaaacaagaaaattcttggataagagagaagaataaaaatgctagagtttagcataacccgtttttatctaaaagttggtggcatattcattcattcaataaataaatatttcctgagcctctgcttttgccaggcactctagctataaataaataataaccagtgtcttaatccattttgttttgttataacagaataccacagaatgagtaatttttttttatttaactttattttaagttcaggggtacacgtgcacgtttgttacataggtaaactgtgttatgggggcttgttgtacagattattttattgcacaggtattaagcctggtacccattagttatttttcctgatcctctccctcctcccaccctccaccctccattaggtcctagtgtgtgttgttcccctctctgtgtccatgtgttctcatcatttagctcccacgtataagtgagaacatgcggtatttggttttctgttcctgcattagtttgctaaggataatggcctgcaattccatctgtgttcctgcaaaggacctgatctcattctttttttatggctgcatagtattccatggtgtatatgtaccacattttctttatccagtctatcattgatgggcatttaggttgattccatgtctttgctattgtgaatagtgctgcagaaaacatacacttggatgtgtctttatgatagaatgatttatattccttcgggtatatacccagaaatgggattgctgagtaggatggtagttctgtttccagctctttaaggaatcgcaacactgttttctacaatggctgaactaatttacactcccaccaacagtgtataagcactcctttttctctccaacttcaccagcatctgttattttttgactttttaataatagccattctgactggtgtgagatgatatctcattgtggttttgatttgcatttatctaatgatcagtgatgttgagctttttttcatatgcttgtgagctgcatgtatgtcttcttctgagaagtgtctattcatgtcctttgcccactttttaatggggctatttgttttctcttgtaaatttgtttaagttccttatagatactggacattagacttttatcagatgcttagtttgcaaaaattttctcccacagaatgggtaatttatacagaaaataaatttatttcttacagttctgcaggctgcaaaccccaagatccaggtgcccacatctggcaagagccttcgtgctgtgtcatgttatgacagagggcagaaggtagaagggcaagagagcacacacaagagaagagaaagggcaaaacctattttgccttaacttacttattgttgacttgagttttataaattacgctgatcgtggtggtgattctttactttgttctccctggagagacctggcccactagtccagcagtcataggcaccgcatctaccatatcagggtagaaatgacctggtacaaagaaatacagggaggcagaattgaagcaagatggaaggtgtggccctgcaggagacttcttcccctcctcaaatcgtctgtctgacttccctgtttatcttctagaccctccctctgacaaatacaagatactcaatcccaatatttgttaacaatttcagacttctagagatgtgtaaaatattaaataatgaaatctgaattatgtgcacttgctttaaagtgtaccttttaacataccaaaatctaaaattgctcctaaaaatgtttcattttgatttcttagatagttttgaactctttaagggcaaagacccaattatctttttattcccagtgccaagtacaagggctaacatacggtccatatgggagcgatactggataaatacatgattcaaggaagacgggcttcattttcaccttctttatgtaggtacatatttattgaccagatagtggaaacatagtacttgactaaaactctaagacagataatcactcagtagctaaaactccagtccatactatagtaatatgatattgatcaatatgaatattttaaggaatagaaaattgttttgtgtcccatcccaaaagcaaccttgttggaccagtagttatctctgcatcagtagatgtcttttctgaggtccgggcatctaaggtgatgcttagaatagctaatctgatcacatcagcagataaaaaggagtatagacaccagagacattggtttcttatagaaactgctctttttaaacagctttattgaggtaggatttatatatctttttaaattataaaattcaatgaattttagtaagtttgggagttgatttgcaagaaacacagaacactttagatctgttactggagaaatttgaaaatgtgggttatgtggtctcatttgcataactcagggcagtgtaatgaaggggaagatcccatttaaccagctaattaggaaagggattgattaacatcagtgatcattaactgttgccaagtatgtggtatttaatctgaatgcagtatttactatgggcccttcattagagttaggtgaataatgctggcaaaatgttctaggcaaaaatttaacttgtgaacattcctttggtgggatctcacatatttggtatgtaggagttaactagtatgtcagaaagtgtgtatcaagtctgcctggataaacctctagtttttaaaatctgagcaaaggaactgttttattttggcaaaaatgaaaacttactgattaaaccagtagtttccaaccgggggtgattttgccaccaggggacatttggcaccatcaaaaaacatttctgattggcactactggttaggaggatgctactggcatctagtgggtagaggtcaggaatggtgctaaacatcttgcaaagcgcaggacagcctccacaacaaagaattatgtggttcacatgtcagtagtgctgagattgagaactgttgggttaaactgacaggtaaacttcaactcagtgctttcaaattcagtgtttttccttatagactaacaatcttgattcatttctttatttttaattaactcattcaataaatatatatattgcacctacagtgttcctagcgctggggatacagctgtgaacaagtaccccagaaggcactgtggagggtgtcaggcgattgtcaattgatgacaagggcactgttggcatcgatgtccagagactgagatgacagcttcccaatgaagaattgttccacacaaatgctgcagcaacctctgagaatgctgagcatggccaagttgctgccaatggagagcttccatttgtgtggcagatacacacaagtattgcaggaatgagagacaggaagggaaggaagggaagaagtgaaagggagggagggaggaagaaggaaggaaggaaggattgatttctagtagtggtaaatactctctagaaatggagtaggattaagagatgaaatgtggttggcagtggcaaaggggagaggaagtgcgcagccatgtgcacatgggtatgtggtggggcaatgcctttccaggttgggggtggtttgagaaggcctccctgatgaggtgacatgaatggaggtctgaatcatgagacgcagtctgcagtcatcatgcaaagatatacaggaagagtatatcccatatacaatgggaactaatgcctccagtaacctgcaatgagattcctcatccatgtgtccatattccacgtgggtgctgtgagacctgaatgagtctcttgggttttgggggtagttaccaggttctacaaccagagctgatgagtaggtgggtagctgacccagggaaagtgggcaacccaaggcaagtctttgctctgaatgtcaactatgagatgggactttttatatgtttgacatttttattaagctaacaaatgagtactatgcagggacagaagcaggtctaagccagtaggactgacaacagcaaactttatagaaatgggttagtgatgtagctataggtcacactttatttaaagtctacagcagagtttgagagtgagagctggacattagagcagctgctctgcataccacacagtagccagtgacaagggcatgttgaggattattgccccaggaataaaaatagcccagagttttgagaaactggatcctctgtgctcactctccaggacacttgctcccaagagttactgtccctttctaaactcctcaaaagccccaacgcgccctccactcaaaaatgagcagcagaattttggggtgacacatcctcttacctgcttgtgtgttctaaatcagcaagttaagccacttcttttagaggtcatggtgggatgtggacataaaagacagtgtgaactgagtatttatgagtgagcacaggccatccccttccccaggcctcacccctgtgccttccttttcacatgtgtaagaggaggttgtttggtgcagaggttggatctctaacagcctcatttttaaaaggtggacatttattttaccaccagagaaaagggaaggaattaaccaatactggaatatgtcttagacccagattcagtcttgcgtttgggggagtgtctgattcctgttgagagaaataagtttttatgtatataaagtttttggtaaatgcttacatctgggtgggtaataatcattagctgctaaattattattgtcgccctcttcattaagaattaccatatgttacgcccactgctgctcactagtcagtgctgtttcctgtattatgttattttttctgaaaacttgcatatcagaagattatattaataatatcttgatatgttttgtattaaaactttgaaactcacactttcacatacctgtgcctcagagctgaggttcgcaaactacagctctaggaaaccactcgtgtgctttctctatggatttgtctatttttggacattccagataaatggaatcatgtaatatgtgcccttttgtgacaagcttccttcatttaacataatgtttttatgatccatctacattgtagcctgtatcagtacttcatttttaaattgccatataatattcccttgtatggatagacaacatttagcacatccattcataagttgatggatgcttttttagctgttagtaatgttgatatgagcatccatgtacatgtttttgtgcagacctatgtttttatagtctcttgggtacatacctaaaagtagaattgttgggtcatatggtaactctgtttggtatttggaagaactgcaaaactgttttccaaagtggctgcaccattttacaacaccaccagcaacatatgaacattccaatttttctacatcctttctaatactgtctgtcttttttattttagccatcctagtgggtgtgaagtgatttctatttccctaatgacttagcatcttttcgtgtgcttacttgccatttgtatattttctttagagaaaggtctattcagatcctttgcccatatttaaattaaattaggttgtcttcatattgttgagctgtaagagttgttcatatattctggatataaataccttgtcaggccgggtgtggtggctcatgcctgtaatcccaatgctttgggaggctgagtcaggtagattgcttgaacctaggagttcaagaccagcctgggcaacatggtgaaacaccacctctacaaaaaaatacagaaattagctgggcaggctggcaggcacctgtagtcccagttattcaggaggctgaggtgggaggatagcttgagccaggaaggtcaaggctgcagtgagccgagatcatgccattgtgctccagcctgggtgacagagtgagaccctgtctcaaaacaaaagagaaaaagcaaaaaatcttgtgagctctccactgcctgtttttgtagaaaaagttgtattgaaatgcagccatgcccatattgtctgtgaataccttcttgctaaaatggcagagctgagtagatggaggggtagagaccatagaaactgcaaagccaaaaatatccactacctgctccttcacagaaaaagcttgccaaacccaacttcacatgaaaatatgtcacatattctatttaaaagaacaacgaaaaaggctgatttgttcactcacctatttaaacatgtttctataaaaatgaagtagatatttaaatcagaggttatgtaagtggatgccgaagacagagctttgtgtatcagaggttgtgcatcggtagtgcctaatgtttttgtctgtgtggttacacagaaattccaatcaaagatcctaagctttctaaaaatatatgttttcattgtaagtcaagacagtgatttagttaatcttcactctagcttataaatctctgaacagtgcaatcagcataatgcttggtagaacattgaaaatgccctcacatgctttggtggaaaacagtttatgggatttttttttttttccaacatggctcatgagagatttggggatttatttaaccgcctttatccaggcaaatctcctagtgaccttgttgggattttgatctcagttaagactagaatatatgtgactcatgctaagtaaagggcccacagaggatagatgagctgacatgaatttccctcccttgggaaaaaagggacgggcatgagcagaatctgcagcagaagagtccaagcttgtccaacctgcagcccatgggctgtgcagcttcaaatgcagctcaacacaaattcataaactttcttaaaacattatgagattttttttgtgatttttttttttttttttttttagctcatcagctatcattagtgttaatatattttgtgtgcaacacaggtggagaaccctggggccctgcaacatttacaagtcagggagatgagtgaatcagcaaatgagacctaggagggttggacagtgaggtcggctaagaaccaagtaaagggagacttcaaggagaaagtgatcagcgtggtgaagaagacaattcttcttcttccagtgtggcccacggaagccaaaagattggacatccctgcctaaaccctttgacttgactgaaagtccagtacatggactttcttgcctgaggaaaatgctttgatcagtgtctggtgggaaagggacagtgctgatcaaaggctttttattcccaatgtctcccaaagtttgcacttaccaagaactcctgggttctcttctgggtgagaagatgtgcaggatgttaggatcaatgcctgaatgtcatggtcacctcaaggccaaagtacacaattatacatgacacagctcaggcagatggtagtaggtaattgtctttcaaaataaaatttcagaatgaaaacatcgtgtatggtcatagtatatgctttaccattcttccaccaacttccagattttatgatatagtcaggtttttaagtcaaaagtattctgttacattattttatttgtgtgatgcattactcattcttttatgctatatgctcctctgccttgctgttttccattttctctggaacccactccacaatgaaatattcctcatgaaggtcaccagtaatttcagtaacttccattgttcttttgtcgtggcctattagcagtgcttcaccatgttgatcactttctccttgaagtttccctttacttggttcttagctgacctcactgtccaaccctcctaggtctcgtttgctgattcactcatctccctaactagtaaatgttggagggccccagggttctccacctgtgctcctatttactctcaaggctttgaacactgttcataaactggtgattcccaagccacacttctcttacttgaccttacttgcctattcagtgtctctactctttccccaataggcctgtcaaattcattagatgccaggctgaagtcctgattgcattcacaccctccccctccaccctttctccatagccttgataatttaaaatccaactcaataattctcattttctagttagtccaaaacctttggagtgattcatttatttttttaaacaaagcatgtcatcttggataatattgaatgtactcaaaagtagacagaaaaaaatacaatgaaattccacgtatcttgtgcccaatcccagtagccatcaacccttggccactgtgtccttcaatttgccaatccacaaccacccctcccatattattttaaatcaaatcttagtcattacatcgtttcattcataaatacgtcagcctacatctttaaaagataaggacttctttggattttaatatagcaatacaattacctaaaaataattcctaaatctattacctagtcagaatgtaaattctagttgtctcaaaagtgtcatttattttttacaatttgtttgaatcaggatcttcttcctcttcttctttttctcttcttcctcttcctccccttccccctccccgcttctcctcctccccctccttctttgtcgtcttttttttttttttttttttttaaagagatgggggtcacacgtttttccccagactggtcttgaactcctgggctcgagtgatcctcctgcctcagcctcatgagcagctggaactacaggcatgtacccctgtgcctggctttgaatcaggatctggaagtcattcttgactctttccttttcctcctacctacaaccaatctgcctataaatcctgttatttctttcagttatgtacagagtctgaccacttctcagcacttccactgttccctcagtgggccgctccactttcatctctgccctggattgtcatagaagcagcagcttctaccgcttcccctgtcttctcccaaccttcacctcttcattttattcttcatatgagccacagaaatcatgttaaagataagtaatatcatgtcactcttctatccaaaactctctattgacttcccactttactcagagctaaaagccaaaattctcacagaggtccaggtattagttatcttatgccaaagcttaatgccttaaagctacagacattgtagctacagacatttactattgtacagtacctgtgagtcaggactctgggtgcagcttagctgagtcctctggctcaggatcttccatgaggctgaaatgaaagtgttgttgagggttgcggactcatctgaaggctcaacagaggaaatgctttcaccgtcactcatgagatcattagcaggattcagttagctccttgtggtttgttggccagagacctctcttacctccttgccacataggcttctccgtagggtagctcatagtgagctagtttactttgaataggacaagcaagagagagtgagcaagatagaagctggagttttttgtaacttaatcttggaatggatatcttattacttttcccatattctgtttgtttgaagcgagtcactaggtccagcccacagtcaaggagagagcatgagttccaggaggcaagaatcattgagagttatcctaaaagcacctgccacaacctgtaagtcctacatgatttgacccctattaccctctaatctcagctccttctacttcccttttgcccactcaaccacagccacactacctccttgttcttcagtcacaccaaccttgctgctacctcagggcctttgcacctgccatgccttttccatgggacatttttcctccagataccttcaccactggttccatcatttccttcaggtctctcctcaaatattttctcagcagggaccttccttatcaccacatgtaaaataaaaactcttcctcttccatatccccagcgttctctcctcttcacatctgcttgttcaccacctgatatgatttgtatttctttatcttctccctctgctagatgttaagtttcatgggacagatattttatatttcttgttcactcctttagccttaatacttggaaaaggagaacatcctcctatatgccacattgtagacggtcttcatctttaatgaatgaagacagtggggtctcaatgggaggtattgtagaagttaaatgtcctcagataccctacatacaggacagcatgattcctctctgatttgtttttaaactcagggtctcagtggaaggcatatcagcataggatgggctgtacagactattgctctcgtccttgacaccccactcatctgtttcaaggtcacacctctgctctgttttgttttgtgttgtttttttgagataggatctcactcggtcactcagactggagtgcagtgactggaatgaatcactgcagccttgatctcctgaactcaagcaatcctccctcctcaggctcctgtgtagctgggatcataggcatgtgccaccacatctaattaatttttgcattttttgtagaaacgggattttaccatgttgccaaggctgcacttctgctttagatagtagatattcctcctggagacttagctatccttgagcagtattcctaatttccgtggccctcgtaactttctcctcttctgtgtattaatgagtatttcaatgggaaatacttattggctagcatcttaatctagactctaaatttcccatttttctcaaataatttcaagagagtatgactgagtttcttcccctctcatttggagactgccttttccagcccagtagagccatagattatgaaagggttcttatttccccattttgccttggctccttcagccggcctcctggttttagtagtaccagagctctggcagtgtcctactggttggtggttgggtttctttgccctgccatgctttaaggtaagtgttggcagtgccaggaaaggatcctaactctgacttcttcgaacctgtcaggtcctgaaaagtgcctgggtgttggccttgggaagagttgcatccagattcccactccaccatttactagtggtgtgacgttgagcaaatgacctaagctgtctgtgtcttcgtatgtaatgtggcagtacaatacccacgtgttttggttactatgaggcttagagaaaattaagtattatgcttggaaaatacatggcacgaaattgggtgctcagtaaatgctgataatggtgttgtaattgcccttatccaaatacttagtataataatgtcatagttttgatattgtgattcaccactaaatgaacaaagaatggtgaggatcgtgttgtgttatctatgctaaccccatctcctgcaactgcatttataagtctgcagttaattctgtgcatgacttgtgtaatgttgctttcctttccatgcttccatttcttctgtaaaataaggacatggaactatatcagagtaacaaataggtttaatctcttatgtcaactccagttgatcagtaatggatacctggaaaacagattaaaaaaaaaaattatgaggccttgtctgggctcagcagataactttgtcatgatctattagcaatgtctgcaatggatagaaaggctggtggcagctattctgaaattctccaggcctggactaaatgctctctaagacccttctcagatccccagtcctctgatttgttatcaaggtcgtcttgatgggcctttgtagctggctgacatcctatcctgtccacccaaatgaatattcagtgtgattggagtaaaacgtagatatgagtagtccagttaagaatctgaaagggattatatatcagtaaaaataaataaaaattaaaataaaaaagaatctgaaagggaagtggttgattaggcagctgcttctctgaatggggtaggggtttctttgagactgcattgcaatttgagtctaaaaaataaagcattttaatcaaaagagcaaaaggatggttccctaaagtcatgcatgcagatcatagcccagcaatgccatgtggagttggaatataattttgtgtgggtttctgtcaatagcatttagcaatggatacagggatgggttttcccaaactggaaacagtaatttcctgacctgcaatagaaagttataggtttctaacggttgttggataattatgtgaatgtgtgctacagatagattattttagaaattagtttaaccacttcctttgatatttaggatctaagataaaggtgtcttgtttcaggggtacttggttaactcaagcaaggagatttgatttgcacagaccttcaggaagaaatctgtgtgtgcatcactttttagtcttgccatttttataaggaaaaatgaaacccttagtaatccactggcattttataatcttaagcaaaagattcttcctgtggggtcagggatatttgccttatttgtaaaagcttttcagatataaagttgattctaggtcttccttctccaaaatctctatggcagagtacattcttcatgccccctttttttatgcctcactacagacagctacaatatctgtgaatttatgatccctggcaaggcaaaaatcacccgtctgtagccatactgttctactaaatatgacgaaagaactatatttttagttttctcagaaacaatcaacactaaacgtgatttttgtccacagtgtaccctcagcaaggcttctatgacagaaggacatttttataagggaatctatgaatatgacagcagcaataaacagctgaaaataatctatgaggcgtttgcaaattacccctcatgagctgtagtggttgtgaaagataatttgtggttctcacagaataccctgcaaattgggtctttcatctgcaatgttttttacagttaaaacatttcatttctcatattaacaaatgataactctgcatttgttaatgtaaacaatttgatttatatttttttctgtgctgagaagctgttgacatttcagggtaagtaattattttcattgccaactgctgtttgtggtgactgtaggcaaaagatagaaatctgaatataagtatgcatcattttaatcattttccttaaagactgcccataaagcaggaagtctgtttgcctgagttatcatctgtacttagaaatctaaaaggatataagtgttgacaagcaaggattctagtcacgttcagggttttctgtggtggatcagaaactccctcatgtaatctctgtgggtagggggactgggttgacctccactgtcaccaaacctctggcagggcccagtgcacttgctgactgaaatcactgcattaaaacgaagcatgcgttattgacctcagtagctctcagctaatgtaatatccgttcaagtggctcatggggtgggtgtcaggattacacaagaacgccttgcactgtgtctggtacacggtacacggtgtgagctctggaaacatttggtgaaactgggacaaggtataaaaacgtataattcctttctcacactgccttcttggccaagcatcctcagtccagggccatggaaagaaaggttttttcacttggaaagtagtcactacgtccataaagaaggatattgagccatgtccactgagtggcccatggagaggaggtgccagggcctgggacagagctgatgggtcagcaggctttccttggggtctttctttgatctacaatttaaggtatttcagtttctttcgatattcagaaaaaaattaccatcgaaatttaaactttgtcccctagaaaaatcatctagcaaaattgctgctccagaaaggtggtccatctttagcctctgggtgtgtggggcccacactagctatgaagcaccatggcaggtgtagattgtctctgtgattattagaggtgcatccgtgtgagacctgcacagtaggaagtgataggttcacccgtttccctgcatctatcccatacacatgtgaaccttccattcacatttcagttagagaatggactactgatttaggatccaaaccaatcattacatggcctgaaggagtgaatgtagagccagtaccctgagtagcaaatgtgttttatcctttgaaccaactccagttgattagttctggttgcctacagtgctgtcttaaggcatctgtggtgctgagctaggaagagtgctgagattgattagcaatgtctgtcatggcctctggagggacagctggccctatatttgccattctctgcttttaacatgtccataacttctctgtcctctcttcttgtgtaaaatgattttaatactaacaggtgactgtgagcatcatgagagagaacaggtagattccactttaagaaaacctagcatgagaaaatgcaaaatttacaaaatgcataaatctggagccaattatttctattacagaaagattccatgaaaggttcctttaaatagccagctcccctactgcattaaaatgatgattcaatttacaaaaattcactttgcatgcaactcttcaagaccatgtctgtggagtaaagccagccacacctgattttttaaaaccatggcctaaataacattgaggatagctgccgccacctatcttgagtctcttggtaattcccactctctgcagtcttccttcttactcctatcccagtgtggggagtagacaatctgggtggtggacaacagctgctggcttccaccctgacacggctgcatttcattagtgggtaaactgattgctcagagtatgtttatgtgtgggtgtggttgtacaactctatgcactctgtgcgctatgtatgcagatacagatacacaaaagtcattatctcgctctcagcccaacctaaattcattcctgctgtaagagttataaatggaaggttccaatcccttggtggatatggccttttggtaatatctgccccaaattctggctccccatcctctttgtgtttgtttatatgttatttacccttgcatcagaaaacttccccagactcagggcctgagtcctattatccggacatggaatcttcttcttcctctgaggcctagaaagccccaaatggttttctgatttagaaaatgaaatagactttgactcttgtggcaagctatgaaattcccaaccaacagcttccactaaatttataacatatacaacatctaaaagtatcactgatctagcatgaactcgaattatagaggcattcaatgcccatcgggtaagatcaccagcctcttcccaagcactcaaaattgggcagttttccagtggaccataaagctcccaggaatgctgattggcatgtgtgtttgaatttctggtgctttgtaaaaggaacttaatccacagaagagtacctggaagagatggcatcttccctttctctgtgtgtgtcttacccccacatagaatcgtcgtaataacttcccaggcccagagcacaagtatcatctttattttacctatagtattttaaaaatcgcaacataaattcctccccagaaatattttttacagacacatcttttttttttctttttttttttttttttttttttgtcttttggcaaaagcaaaatcagactaacaggaaacacatcagccctactcagacactatcttctggcctgcaatgaccaatcctatttgagacaaaagctctcaggctggtgagctgtcaaatcgctctttttcttccaccttcccaggatcattggtttgagccaagggtcccccatggtactgggctgtgattgccgcataggtgcagccatagatggcagctgccaacatcatgagacacacaatcccacacacaacgccagtgatgatgacagtggcaatggcatgacgcaggttggccggccttggcttgggtttgagctcgcactccaagagttctcgctcccccgcgttgtggttctcaggaggcctcaggaccacaccgtgggcagagccgggccactgagcctgcgaggacactggatcaggagcaggaagagggcagggctggtacagctcatgagggatcctaaggaggtcctttcccttccaggtgtctggtgattcacagatgatgccgtctgttagtccccctttaaaaaacaaaagcaaagaacaataacaaagccttgatacaacagagttccaaaatcctctgcctgcaaaaacttaggcagatggaatttatgaagtaccttttttttttttaaatcctggagtcaaagaatttaacaaccatattttatgattttaggattcctaaattggctaaatactaaaaatgccacacactaaattggcaattacttatgaccaagaattcattagaagcccagtaaccttcatgttctctaaatgctcagagaaaacaatgcaaaagctgacaagaaggcacgctgggggccgatggtgagggcacagctgcccactgcattcgtgccacgcatggtcctagtgagccccacagacaagaaaacttttgtaccagattcccattgaaaatctaaggaaaaaataaaataaatgtgcattgttgtgatgttatgtgtttattacaaagatcctgtgtgtctcaacactgttcagtgatgccaaatggagaggtggaatggtcttggagtgatctgtggatttgacaatactggaagtttagttcctggaattcggtaccatgaatgtgtctcctcaggcctcagaacatttacggctttgaatactgaactttccagtgggttattaaacccagtttccattacctgtaaggtgattgatatcctcaggtgtgtagactgctgttggtcgggggaatttgggtggtcggtcattctttcctagagagagccctgagctagcagactgaagtctagtctagtgtgaccactgatttactctttgactttgggaaaatgtgcttcgctgacttaattttctgccatgaaaacatgctatttgtatccaacttgatggtttacaaagcactgttagataagtcctaatactccactcttgtaggtaactcttgtccagactcacagaggtcacgagtggatgaaacaacatccaaacccagttctccatgctcagtccaagttttttccactacactcgctgcctcgccacatcctcctctcaggagcgttgtgaggtcagaggagtgggcaggatggccctcggcactgtctgctaggaagccttttgattggacagaactgccccatgacctgcaccttggccctctcaggctgccataagcacctcccctaggccagccgaaaagactggcactgcagttagcaaagttagattggaggagattcttagtacacacagtaagtgaattaggaaattataccagaaagacatatgtagagggcatcacttcaacattattagcaccctccattgcatggcacttcagagttttaggaatgctttcacatttactctctctaagcttactacaagataagtcataagtggccctgtaagtagatagggcctatcttgcagtgcaaggattatcaggtggccccaacacaccagggtgagtggcagtggcaaaattcaacccatgtcctttttgttgccactgcttaaaactgaatcacccaccaccagagtgtcttgggttcctcctggcttctctagcaatcctttgaggaaacagtcctcaccctaaagcagaaagataaaaggggaatttcttccttttttgagccactgattttcctgaggccagaggttcagagcagctgctccagatgagttcaaagtgccattgagattaaggattcttgcctcatggaccatttcattcctctgcacctgaccataggagcctctgccaggaagttggttgcaagacaaaaaggtcagagagacagaaatgaagtgatggggctttgagaagtagtcgtgatatttaatccagccagagagcatggagacttctatcaggggaagcaagaccacctgccagggggatggacaggttcatcagctgacttccaccttgactagggtggtttacccaatcaccccagacttaagaactgtgtttctccagttccagactttctgttgttcggtattaaggtgggagccacagcctctggacccagagccaaggaaatacccagactggagcctgggacatagctggaaggcaggggctatggctgccaaatgctctgtggtctcctgtgcaggtgatcctcagccgggatgcaactcccactctccaccatttcatgggccatgaccccctcgtcaaatctgctgattacagcttgagggtcccacatccttctagattaatgtaactgacaatgcaagaagctccagcttgccaagcactcattgttctctatctgatcactagtagctcttcacctctgtcttgggagaaactagattcaaatcttgagtctgaacattacgtagctgtgcagccgtgaaaaactcccttgaccacgttgtgcctctgcttgctcatctggaaagtgggagatgaggataattaaaattcacttcccaagattgctctgaggactcagttggataaaatatatcaagtatttagcataatacctagctcagagtaaatgtttagtgaagtgaagatgacttgtttactagtaaatagagagaaatattaatcatacaatctgtgtgcatatttctttggaggagatattattatgtattcaccaaagcacatctttttgctcttaggccagcaggaagactaaattttcccactttttgtggtctatttgaggccatgtgattgaattctggacaatggaattcaattaattgaattaattaatgccacctccaggccataaagcccccgtgtaatccgccatgcattttgttcccacttggggatgaccttagaggccacgtgataaacttggcgacatcacaagctcgaggggtcttatgtccctaaatgactgcatggaatgcagaccatgcccccatttcctttgaactctgccatgaatgagcaacagattttattgcatatataactaaagtctgggctagtctgttatgtcggttagcctgccctaatacctgtagtgtttgcatttgtttatatatctttttttaaaagaagatcttgactcatatctgttcccttattttgcctgtattcaatatatctataatcagactgtctcccatgtttgacacatatttggatttttcctagttatgttgggacatccaggtcttattaccccaaatcaatttctgccttcctccgaagaaaagctgtgatctgtactcatgcagctctgttgtgacggcgtgttgaaatgcgtcacagaatctgaggactggaatgggccgtaggaactccctgacttaaaactatcagtttccctctggtgacactgagtgctagggaagtgtactaattttcccaaagaccaccagcaagtttgtggcagagtagggcacatttcatcccatcccaggttgcttccagtgccctagtcctgggaactttttttttttttttttaatcaagaaatgttctttaatgaaaactatctttctgtgttggctggcctgtgcttacaatttaatccacaatacaatagttcaagccactttacctgtagacgtaaacaattttatttgtaacctcttataaggaagatgttgccatagtatgtggctcctgttgctggttggcttgaatgtcgactggatattgattatgtaatttactattacattgttgagaaggatttattcaatatcgtacgttttaacccatgttgtattcaccctaacctcattcccgctgagaaccgctacaaccatgcagacactgttgacttccctaattcatgtctgtagctccaacatcttcctgagcttcgggcttaaatatacaacctccaactcaacgactccccatggatatgtacagaacatctcaaacttgacatgccccaagctgaagtcctaattgaccacctccccaacacactcactcactccccccagtcccctctttgccccttgtcagctgaaggcatcaccatttacttgattaccactgcaggacaaatcaaaatagactttcccataattatggtcttctcttagtcatccactccaacccattagcaatgtctgccagttcagtattccaagtatctcccagcattgatcatgtctcaccaccctggtttgggccaccatcatcttcgctggctgactgaaatcatcttctccctcatctccctggttcttcttctgcagcctttcgtcagttctcccaagagtctacagagtgaccttttacattgtaatcagatcctattgttcccttgactaaaactcttcaagagctttccatctcacttaaagtccaagcatcttggccttctctgcacacttctgcatgatctgacccccaagtactggtgttgtcttgtctgtgtctactcactcccttcctctgcactggccactgtcttgtccctctttttgtcctgcagccaagccaagttttccccctcatcaagccctttgcgttcactattccttcccccagttatctcatggctcattcctcctcagtctttgggttctgctcagccatgtcacctccttggagacatcttcccatccatcctatcaaaaatgagacccacattctatcactctccccttcccctgcctcattgtttcttagcactaactgctattctaaacatgtatctttatttatcatcttatttaacatctgtttctactaccagaatggaatctctgtgatggttaggcactgccatcttctcagtgcctggcatacaaaaggcactcaaatatagaaatgaatgaatcatgctgagagctaggaagagtgaagcactgtgaagtggaggaaagaatgtcgggtcaagacccaaaagccatgccttctgttctcacctgggcttctgctctgtgatcttgggcaagtcactgaacctctctgggactctgttgcccattgacaacaggggttggcaaacttttctgtaaagggccagatagacaatacagcccctgtcacaactactctgcttttatagtgcaaagcaaccactcactcattatataatgaatgggcatggctgtgttccaataaaactttatttacagaaacgggagatgggctgtggccctggggctgtagtttgctaaccctgggtggtttccagagtccctcatctttaatagtctgagatctcttgctttgctgttgtcatcatgttaaagaaattgtgagtaactttagagagaggccctgttgcacccaatttcagtgacattggtgtttgctaaagcagaaaggacaattttagaaaagaattacagttgtcaaatgggtagaagcagacaaagagagaaaaatatcccagagagagataaccatacccacaattggatcagacttgataataagaggttggtgttatttggggttgagcagttattcaggtggtgattgaatgtcctccttcttaatagcatactcccagataagtaacttcttgttatattaattaaacaagtgaaagttatctccatgcaacatatttgtagattaatttcgaacctgaatttaaacaccttctaatgactcacttgactcttttgccataccgtgaaatggcaccgatgtgtaaaagcccaaatccaccccttacacactcctccacattctttctaatgcagagaacagatgagattcatcctaggctggtaacacacagatggggggttccaaatagacatgactgacctttatagacaaatttctccagccagagtttaagaccgagcaagtggcaattgcatttccagaggttgtccttgagaagtaaaagcctcacactgggcatggattccaggagcgctcgatcaagctgctgaagctggttttgttgaaccgcaagtatagttaggttctcccaagtctctcccaaggatgtgggaaggtggcttatgttgtttgatgacaaatcaagctccctcagctgagggagggaatggaaaagtctgctttccagggaaaggagtgaattctgggttagatttaaaacctgcaagtgctgaagcccatggaaagctccaggggccagatttgaaagggaattgttggacaagtttaaggtcatgagccatggcactgacctaaatgcaaaagcaggaagatggtgtatctgattatcttgtaaatgcagcgttcgagtctgaggaggtaaatgggaagggatttcggccagaccctgctggctgcagtctacaaaatttgtagatgactgacagtaacacttgtccgggcagctgcataccacctggagcaggacaatcacactggaaaacaggagcagttcacctacaacaaacagaaagaaattgggataggaaccagtttgtgaggtgtggtatcagcacttttccgcctttgaatttacaggtaatgtgctttccagccaggtgaaaccttctacaacctgcaagagaggttctgtcactcaccgtctttagtagagccaggctggtcagagtacatccccagtgtcattaccttctgcagtctttgtgccacctatcgtctgaagccttgagaaagatactctcagtgtcttctgattcggaagatggaagacttagtgatatcaaatagaagggtgaaaaaaaatatttggggtgtatatgccgtttgtaggccacaacagaattatttggggccagatgtgtaaaagagtgttagaggatttcagatacttacatttctgtaaagtatgctgcagaacagtgctgtctaatacaactttctgtgatgatagaagtgtcctacatctgctttccagtatgggagccaatagccatgtgtggctaccgagctcttgagatgcaactactgcaaccaaggaactgaatttttatttgtatttcattttaactattttaaacaacagtagccacatgtggctaatggttactgtattggatagggcagatctaaagcgctgctacgtattgatatccatttttgccgttgtaattccatgaacaaggatagtgtctgctgcttttttattcaagattataaaaatatggaaaagcattaagaatagtataataaatacccattttctataatagttctgcaagtccttcatgggttattgtacttccttgattcttttttctttcaactcagaagagcaatgcattacttatgcagttgaacttactttgattcatgcccaatttctattttccagcataagcccttttcctcacaccattactgatgtatccctccagacattttaaaaacaatcattagtaatgacaaaaatctcaaataaacatatagcatgcattttgagccacctaccattctaagtgctttataaatatgtatattaattaatcctcataaccttgtaaatatggttccattattatccccatttgaaagatgaggaagctaggcacagaaaagctgaatcacttgcccaagttcacacagagtattatagtagagctgtgataaggaccaaggctgtcttcctccctccagagtctgtcagagttcttatctactgtgctccacttttcctccctccagagtctgtcagagttcttatctactgtgctccactgcctgtcaaatacacacacacacacacacacacacacacacacacacacacacacacactctgttttacataacactttttaaaaatccagataaatgtaatcatcaatatgtctcattctgcaatttgctctgttcactgaaaactgatctatccacatggatacgtggaaagctaattcattccttttaactgttgtagcatattccatggtgagagcatgccacatttagtattaatatttacccccactcttatgaggggtagttgaacggttgcagtttttttcttcattctaaatgatgctgtaaaacagcatccttgttcagactgccttggctgtgcaggaactgggagagggtctctggaatccagagaaatcttctcacagggctcagagaggagattaagttcacattttcttagatactgctctgtcattcaccaaagtagctgtaacactcccttctttttttttgagacttgaatttcaaaatatgacaaacatctgccaagggcattttactataaagtggtagaggaattcatgagccacacagtaatatccaaaactcaaaatagttatctactcaaagtggaagctcttgaaaggggctttgtttgattgattgtttgcttgcttgcttgttttgggccttaactagggaaatacacagcatggctgtcatgcacttgagccttttcccctttcttccttaaattctctactgaggctaacagtgctctagggcaatagggaagatgtttagagagccttctgaaagagagtcttctcagtttaatttagtttaagggatgcagaacatcacagtccccttcccctttccagaatatcaaagagcaaaaccactgttttcctttctataattttgcaaataatctaaatgactcctttcaaagccaaaacatcttcccctcagtaatgaacggacacccctcatttttagctgtggggctcaagcattaattagttgcaggaaattaattcttaaaccagagaacatgtttgccgcagaatccactgatctattaatgaaaggcttgcctctctgagattgtagccaatttgttcattctttctttggttccacttttccccccaaaggaataatatacgaactccaactacaagcaccatgtttcctatgaaatggcccgtgacatgccaactacatattcatgtcatgactgcatacatttctctccaccctcttcctctgcacccaacatgcgcaaacataaatcattccatgcagagacatttttcatatctgtccagtcttttaagacagacgacttgaaaatagatttcccgcagatacctttgtgaggggataccatctttctcccagacaagaacttttccaacgggaattgatcagggctcacctttcatgactgagtctccttgggcgtccttgctgacctcgtagaccctttaattaatgtgcagagcaacacacgaagggcatggcagactcagagcccagctttacattcagtctttctgaaccctgcccttgcttttcttcaatgcagaaaacagttgttgctttcaaaagaccatttatttaagcagcccttccccttgtctccatctggctgggatcagtttccataagaggatcttgggatcgtgcccctcttctttcttaaaatgttggcctccccaggatcatccctgcctttcccattcagacgatgagccgcgtaaagaatgtttgtcaaaccttggtgaacagctgtagcattcaaacatgaccccagtgcctcggcctttttgattatttaatctgcttgaagtacagggcaccaaaataaaactgccttcttaatccggctgtggcttctgaattctgttgacttattaaccatgccgggtcacccctctttgggttgggggatgctggacgggaccctcacctgggggtcgagcagcagagcccgcagagtgtgtaatatgaggacaaattggcctgctggaggctgacacggtttgcaccgtgcacttctttggtcatcgaagtcttattcagccaacatctgtggggattagctgtgttgacagggtcttgatgccctgaaattcatagccatggtttcctttagtggacatcacaaccttccttctggtgccacaaataacttctcagctgcttgcttgcttgcttgcttgctgcccccacaccccacccactccccagcccccgagttgaattgaccttttggttagtgtgacttaagaaatacttcttaatctttcttcgtttccctgatgctgaggtcctggcccttccctcacttttcacatataaaacaataaagccgccccctgtgagcatcaggcgtcagtcgactgtgactcttctctaattgaagcttcagggaactttcccaccagggactggaaccgtttctttgaatgtggaaatcccctgccatttgctgaggtggggtttcaacccctgaagctgcccttctagataaaacaaaatgttctgctgtgtgtaactgtgtgtacgcttttatggaagcagcatgaagtgcaatccttggctccaggaggtataattgagccattgggtttgggctctggaatcaggtgggtccagagtcgatatttggctccaccatcaccagctgcgtgtctccaggcaagtgacttacccacccagagccccatctctgacatggggacaacattagcccttactttaccaggctgtgcccaggattaaatatggcagtacacgacatggcccagagtgtcttcataagtgttcacaattttgcatgagaaaggctttcaggatttgtatgctgccaacttctgaggacaacctggaccggtcagcaggaggaatgtcctgagggaggtcttgacagagggccatggaacctggcccttcgtgccactctgcaggtacaaagggaagaggccctttgtgaatggaagttgaaaacatcaaattttgattattttcaacaacctgtactttgtggactctttcatcctttggccaagccccttgtcaccccacataacccagtatattcatcctgcctcttccagaaagcccactttacgcaacctgccatcttttgtccttctctccaacatttttttgagcatcacacatacaatgggcaaaagtcaggtgtaggtgacaaagcaagtcaggtgatgaagagccacttaaatcttaagaactcaatgatttcttccctccttccttccaatccctccttcctatccatctgtttcaggtgcacagaatttaatgacaataatttccattattaatggaaatacatacataaccatcaatggcccccattagcattcaatcattaatttatcataacacaacaaacacttgtgaacttaacactccttctaagaactagaaagttactaataactcatatctacctgtgtgcctctctctttccctggggtcagaaacatttttttgtgaaggccagatagtaaacattttagaccttaagagccatcagtctccattgcaattattggactctgctgttatagtttggaaacagccaaagacaatacataaatcaatgggtgtgcctgcattccaataaaactttatttacaaaaacaggtagaggcatagatcggcccacaggctgtgatctgcaaactctggttatcccatcctctggcaactgctctcactagtccaccaccccacctgtcacccaccctcaactcccaccacccaggcaaacatatccactctcctgttgcctcatctatcaaatgagggggttgggtaagatgatctttaaggccttcttatgtccagaaccttgtcattctggtcaaaaagcataaatgggattgaaaggcactctacttaccagctttaagggggcttagacagacagagaatttaaatacctctttaggttatagtggagatatttagctgtgtctataaggcccagctgggatccagatatcttagacttgggggcctgaaaatgatcaatctattgacagcacaattggatgttggaggtcaagaccctggcagagaaccaaaggcagtcaaggacacttctggttaaaagctaaatgaagaagcacactttcatgctgcttattccctaaagttctatggtcctgggaaaatcccaggctctctgagcatcagcattctatctgtagaatgtagataatacctacctcgccggaggcagggaggatcaagtgatacttaagtgcctagcacatatctggtagagcaaaagatccaaagtggcatcttggccaagcatggtggctcacgcctgtaatcccaatatactttgggaggctgagtaggtggatcagttgaggacaggagttcgagaccagcctggccaacaaggtgaaaccccatctctactaaaatacaaaaattagctgggcgtgatggtggccttctgtaatctcagctactcaggaggctgaggcaggagaatcgcttgaacccaggaggcagaggttgtagtgagccgagatcgtgccactgtactccagcctgggtgacagagtgagactccttctcaaaacaaaacaaaaaacaaagtggcatctcttactagcagcatggatttacagacttcaaagagtctgagctggctgctcccacctaaaacacgaatgcccaggaaactcctagagaagccccagagctaatgggttcctggcaacatctgcttactgcccaaggggtttttttggttctgttttactcatgctgaccccaattgggggttaaaagatggacaatgcacacatggcctggactgcccgccccggacacttggatgtggaggctgattgatttattccatctgacctcagccaagagaacaaagggagggtgtgtgatatgcatgctaatgctaggcagtgccttttctttctccctccctcccgtggtgagcagatccaagaggtggcaagacagccatgcttgcaaaaagaggaaccaaggagagatgctgaatgcagctcaggccagagccactccttaaagaggagaactgcactatgagggtctcctggccccaagacctgccaggaccccaggttcccacatgggagctagctgcagatgcacccgtagagtaaaattgtgtttatattcacactgagatttcaaaaatttccaagcttctgagacatattcttttgccctttttaagccagaatgttttctaatatgttagtctatttaccatttaatttccctgaaatgaaaaatcaatgattattaaccctacaataaaattgacaatgtcttgaaatccagcatgtaatagctctttctcccaggcaatattacacaggtatttaaagaataaaggccaggctcagtggttcacgcttgcaatcctagcactttgggaggctaaggtgggtggatcacttgagtccaggagttcaaagccaacccaggcaacatggttaaaccccatctctaccaaaaatacaaaaaattagctgggtgtggtggtgagcgcctatagtctgagctactcgggaggctgaggtaggaggatcacctgagcccaagagtgggctgcagtgagccgagatcacgccactacacagcagcctgggcaacagagtgagaccctgtctcaaaaaataataataataaatgaaaaagaataattagaactaaatatacccatctgggagaatattcataataaagtgggaggcaaaataaagcaatttgaataggaagcatattgtataatcccatttatattcaaaaaagtgttagagatggaggaattaaccctataaatacgcgttggtttgtctgaaaatggaataagtgggaaaggtcagtcaccaaactgataatgctgattacttggaggggagactaaagaaaaagaggggaaaataaatgttttctgcttatacttctgtatattcaactcgctacaacaaaaattaagaagcaagtaaaggcacatttcctttactggaatatttgagatgtcttatcttctagtgactggctgagttatctgtgtaaatatagcatgcctagagtttgcctcctctctcaccaagagaattagccccacaggtaacatctgtctttctctgccaaggggtctctacgtgtgatgagcccttataacaaatatgagcatttctcccaattgtaaggtctgccttggtaaagtcatggccaagtgctcctccatccctgtcaacaggctcctcatccaaaccatgtggtatggcgatctaatgccagggaaggcagccaggcctagtgacagctgcagccaggaatagtggggagtaggcccttggcaccacaaatccatgcagaaatttcgtttggttagaaagaaagtttgacattggaggcatgtggataatagtgaaaatagtttcctaggaattgtggatgaccaaacggcacccaggtacacagtttatacagagctattttaaagttttaatattgtcttccatccatccatccctcccttccttccttccttccttccttccttccttccttccttccttccttccttccttccttccttctttctggacctctgcctttggatttactatcctataagagatagaaaaataagaaacatagaaaactaggaatatattttaaaatgacaatcccattaatcatgtatttaatgcttacaatggggcacatagtgctaataatttgtattaaaattatgctattttaacaaacaacacccaaatctcagtggtttaacagaatagctcatttatttctcttatcacagtctagttcaggttgacaggggcctgggctccatggtgtcattcagggacccaggcttcttccaccttttggctgtgacctcttcttggctctcagagccctctccatcagttggaaaaggtacttaccacttctgctcacattctattagccagaattaaatcacatgaccatgtctaacagcaagagatgctgggaaatgttgtctagcagtgtgtcttggaagaagaggaggcatagctgttggagatcatagcagtttctgcctccacattttattgcattatctcactttaaagtgacaacaactcactagacattaagtttcaaatgacctgtttgtttcccatactttcttcaaaacccacttaataggtttattaagtaaatattgaatgaataaagatattactattacttttttttttttttttgagacaaagtctcactctgtcatccaggccactgcaggctagagtgcagtggcctggtctcagcttactgcaacctccacctcccaggttcaagcaattctcctgcctcagcctccggagtagctgggattacaggcacacaccaccatgcccagctaattattttgtatttttggtagagacggggtttcgtcatgttggtcaggctggtctctaactcctgacctggggtggtccacctgcctcggcctcccaaagtgctgggataacaggcatgagccattgtgcccatccatgatgttactattacttttgatacaaattacaaaacagggacggagaaggtaaaaacttacccaaggtttccagcgttatttgttgcaaacacatggattgtgagtaccaacgtttaggacaatattaagggaacctatagttgtattcattttatgccctaaggtcattttttacacaacccattcttttgacattaagatgtaaattgaattatctggaagctctgactcaggaggtgagaacatagttccctcttgagccgttcagtggagaaccaaggctgccatacgttttctctagtaagaaagtggggaggttgtgttcatctccttgtttttttcttgcccttttgataaggtaagaattcaggttcaaggaatgcctaggattattccgtttactgcatatgaatatcagcggagtttgaactccctttagcaggccttgagttgcctgataaaattagtggagtagtgggtttgaaatgtatgcctccagcctccctaaagctaaggaagacagtggccaaaatctttcttttcagcatccacgtgtccacagagcctaagacttagccaggttctgtgtagactagaaaagatattgcatactggttcctggtcttcaaagagctcaccagtctgttttgttttgtttttttgtgttttgtttttgttgagacagagtgtcacctgttgcccaggctggagtgcagtggcgctatcgtagctcactgcaacttccatctccaaggttcaagtgattctcatgcctcagcctcccgagtagctgggattacaggcacacaccaccacaccccgctaatttctgtatttattttctagtagagacaggggtttcacaatgttggccaggctggtctcgaactcctgacctcaagtgatccacccgccttggcctcccaaagtgctgggactgcaggcatgagccatggcgcccaagtctggagggtgctatttagcagttttctcatcaccttgaacctgttttccatgagaagactgcacgtgattttgtttgaacaaggtagggtttccctgacactgtctaactctcagggaaccagttcttagaagtccttgctggggaacttcagatggtggcagaggtagaccatctaagtctacctctggggtagacttgcattttgggggttaatcctccctatactgtcagggttagaggaaatacagacttcccattccaatatcttcccaatgtcagccttccagcattcagttgtcctgcactcaggacatgtgtaaagataaagatgcatttcagataagtatgattaaaggtaattagtgagctcatgcggctggtggaataaacataggcagatgctagttgacataaagttaatgaaagaaacaaacggatcaagaaacatggcagcttaggaagcctggccaaagcctcacagtgacacgttgttttacttagatcttttgagtggctacttttgtctgtgccccaggaatataaattggaatcaaattcatgttcatgtttgattgtttgctcatgttaacacatgaaatgagtgttttttgcagttcttgttgttgggtttttatttgcttttgtacttttactataacgtgatagttcagtttctgtaatagattacaatgtatgtttcatatttttaaattatagcttactgtatgtatatcatgaagcaataacaagtctgtgttatgcttttttctctttaaggtttgttctatatgagttctttgatatatacatagcttgaaaatgctctggaaaacagttagtcttaagcaggacttagattgtagcccacattacacatcctgcacttcaggaatcccctttgtgagtccaatcatttcattttagaacagtgttcctgctaaacacatggaatctggagtgaaaccatctaggctcaaaaataccgcctccaacatttactggctgtgtggccttgaatgagttacttaacctctctgatctttaacttcgtcatctgtgcaaaggaacccagcttgcagatttatggaaagggttaaacagttttttatcacgagaatcatagcaaaaaaaaaaaaaatcttttgcacatagtaatatacattagctagtatcttctattattgtgtctataggtatcaactaggtacttagattgtatctgcttgaactaatctgcttggtacaaaaacaggcaagttaaatgcaaaggagtattctgcccgtggacagagctccccatcttttcgtattataaagcctttgtgtgtgtgcctagaatcaagtgcaatctcagtgaatttgtgctctacatatctctgcttgtcatcaaagtcgctccacaaacaaaggaaagttgattgttagtatcatgcaactaccactttcatgtgggatgtttgttagcaaaataaaggccctgccttgactttgctgcagcctccattcaggtttataatgggcaccttccccttctggtgcaatagtgatgttctcatcttttcttttaattcaaaaatcccatattgggttacctactacatgctcgtgctgtgattttttaaggcttccctgtggaccttgtctccagtcagcccgtcgctagtaggaggccctctttcccatccttgcataattagagaaagcatgtagtcatctccccagggctgcttagctttcatcatgaagcatgactatcagagttttgaggttgataggagtggaaacattgtgttcaacaagcaagctccttcatgtgttgtcaacatttcatttgtgattctaatgagggctgaggagaaaataaactccgtgtatgctctcactgctacggctgatgtttataagttcctatccatggcctccagttgctcccaccatgaaggcatctggaaaggcagctgagtgccgctgtgtgtgaggaggtgctaaggtggttagatttgctgagaaagagcagtgcccgtgttcaccccttagagactggtgtttctctatttttggtgctttccacttctgaaggtgaagacacccttacttaaaaataaggtgtgctcaagggactctcattctggacccctttgtgtgtattctttcttgatgaaagaagtatctactgagtgttccctacctgcaaagctctgtgtttgggaatgtcataggcatcaaaataagacacagctcaatgaatggacctacagtccaaatggccactacagtgtagaaaggggacagaaattcattataccactatgcaaatacagttgtccctcggtatatgagggggattggttccagcaatctgtgcttgcaccagtcctgcaactggccctgtggaacccacatgtaggaaaagtcaaccttccaagtatccaggtttcacattccataaattatgtattttccaatctgtgtattagtggacctgtgcagttcaaactcgtgttgtgcaagggtcaactgtatatgaaaaagtacagccattaaaagtgcaaggaaaaagaggtacatggttccataagagaatgcagtctggcaattcagcctgagaggtgagggcaggcatcccaatggatgttatagccaggctgaaatctgaagtactagccagaatttaccacagagaggggaagagacgagggccattccaggtaaaggcatggcatgtgttacgctgagaggccagtgagatggcacagcatcttagggactagcagaaggcgggcatgatcacagcacagagggtgaggaaggagcttgggcaagcaggtgctggagaaggggtgagaggctggttgctgtccccgacctcatctcccggtcactttattattaatattgaaaaccattggttttcaccatctgaccataaccagagaaaagccccttgctgtccctcagtatgcttctcagaggaggtaaagaggatgttgatttcacaagcattatgaaatccccgtacacgtttctcagatcctgagctttgatgtggagttggcagttgtgggcaaatcctttctgcatgtgtctgaggggcagcagaatggcagagttgcattctcaccacatcagtgcctgggtccagtgcagtcaaggaagaaccagccctgctggggctccagtactgcctggatgggacgtaacatttcctcctgtgagtttgtgtatatgttagtgcagatgcaaacactgcagcagaccagaagtggcaaatgagtgtttacgtcctgcaactacctgctttgtggcctcatggcaaccttgctcagcagcccctggggccatccatggcctcagaatcctttctagtccagtgcttgaagcagacagtattagatagccaactggtggcaccatgctaacataatcctagttggtgttcctgtagtatagatccttgccatttgcaagtttgactagcccaaatgcccctaaagtatataatacaaagccaagcatcattttgctgaagggagaatttgaatcatgccctgggaagctattgaccaagcccccttagttacccccacccccaaattatacatcttgatatagactcagtgtcttctccttgtcctgtgaccatggtaatttttctacagtgataaaaataaatttttatttttaaaaacgtctttcaagggaaacacaaaatttgagagcatgttgaaaaagttgttgtggtctgtgcatttgcacaggaaacccatggcttgcgctagaaatatgattctagaaaagtcagggttgagtttgggcatgtggacaatccccattagtgtgccatgggcagtggacatgctgtcccgctgaagctgtcccaggagagcatgtgcattggcctgcagaaatgaagtacttagtccagaggaagttgatctgaaaagggtagcacacgttagacagcaaactgggaccaagaggaaactgtgatgctacctctccatttgggataatgaggcactgttatttagcagtttattatttggttagcttttcctctgtctagatatccaatttgttggacacagtgcatccttaaactctcaaggctgaatccaacatctgaaactcttacaaccttccagaagttctcagacacagggtgctttacctggaaatgatcatgttatttctccaccactccagggtaggaactattatcttctacatcttactaaagagaaaattgaaacttgatgagactgactcacttgcctgagacccaatttctaaggggcagagctgggacttgaaccctcatctgccggacttcaaagcctttgaactactctgcgtttttatctcatcttattcttcccagtcccttcccctggcatgtggagaaatgcaaaagaagggccaagacattcacctttgtaggttcccgctgcccatttcttcagggaggcagggccacagggaaaagagggcagcctgctgtctgtctgctgtggccagggattgggcaaagtgtgctggggccggaggtggggaaagcaaggcattttgtgcagagagttagcaataacctggtccatcccccagaacggagctatcagtcagatctgggacacatttgtcatggctgtttccctattcagaagccgcccctgcaggcccaccctctcttcattgctgggcaggaaggagggaactccctttgatctatagaccagtagcgggagaagcatggcattttgtgggcctgctcctgcccttcggcccacatgattgtttggacaaccacatgaacaaaagccgctggccatgcttgctttagagcatccagagtctgaagatagagcatgccctggaagaaagtggaagtggaatgaccactccctttccatgatggatttctaggtcataatgcagaggacaggatgcctctaggactcccatctgagcagatgagcatctcagaaagaggggtggaagatggagaaggtggagctgaccttacagccttcccactggacagctcaatcttctatggtcaggaaaaaaccacacactcaccacattggtgtctagtctcaggccacagccccacactcccagtaagaagcatttgcctggagacagattagctaacttttgagacatgtgcacagttttaaaagtagatgggtagctcttggaagactgcaactattttctacttatccttgagaaaggaagatttttgagtcaagtaattctgaatagggagcaactgtcttctaaaaatatattcaacttccctgtagtatagtatactttgatgtattaaaatacagctcatcccactcagattactgcctcggtgcctaatgctgtaaaattaaactgttcctcactgatattttattaagctccaccaacatttcagacacagacagctcacagagcttcgggccatgtgttttatttgctgtcagggtgaactctgacaccagtccgtaaagccccctccccttgtctttatataatgcagcattttcaaaaaccttgctacaggctactcccaaactgtcactattggaagtgaacatcactagttttctgggtgtgaatgcctaaaaggaccaaaaagaagcaaacaataaggctgttgtatgaaaagtctttgtactctggacgttccttttgcatttattctgtgcttgatattattcagtttatttttgcaggttttgcaggggaagggggctttttggtggaatttttctgaaacccatatgcaaaaaagggcatatgtttatggacaatgagttcacctccctagcagggagccaaaggtatctgtatgtttgcatcttgaaaaataaatggatatagccataaatgccgatcctcttaacaagactaactttgtcatttaataagggagattatttcatagatttaaaaccagttaacacatttaaaacttgataaggcaatcctggtatgtttccttttctccagtgattaaagcaaatcaaacactggactaggggaggttttccatggtacgagtaatgccgtgaatgtttctcctggtaatgcaattaggaaatattggccccagttaaagtaacttaaacaaaacatgttgtcctcatcaaacttgttcaagttgttaaacaggcaaagccttgtccaaaaagtaaaaaaacaggggcatatagtgtttccatggaaactctgttaaaatactgatttgtggatatgatcataatcagccccataatctaatatgactgaattaaatgaaaaagaatctcagttatgaagtaagccccctgtgtgagagtattcttacacatgcagaaaacatatggatcctgacggacgctattttcaaactacttattggcccagggatggggctttaagactccagtttcatctgtcgttttccccctccattcattgttcatcgtttttataatgccgggattatgtgggtgagcagtaaataaaatcttaacgacatttgggtttttcaatatctatcattgctcccctcacaatgccccatattgttttcattgtcttttgtgacaagacaacccataacatttaatggtttgtgggatgttacaagtttaagttttattaaagtaataatttcttcctgctaatgggatcttggtagaattctaaccacgagggttcgcatggatgtctttgacctctagaggaagggacattaagtcaaaggctagggtgagtcccttgggtctggggagaggcttcagggacatgcattggcctcctccctgccacacagttctgcagctctgtttgcacctgtctcggctgtagtaaaaatggaaactgctcaccatgggataaacttcaacctcgtgaaatggcaatgacagctgcctttcagtaaacctacttgatttatttgaaaatcattccatccagagatcatcacaagtggtattcttgggatcagtttctttcttgtaaaaatgcgtcctcagtcacataggaacttcaaatagggtttaccaaggaagtgttggctagagcctggcaatcctttgttaccttagccatggcatcccagagcatctgcagaatgatttctgcaacagggcagtgatacaaccgtgtatctctgcccaggtgtgtcagtgcttttaacgccagcccatggtcccttgaaagtcccagcatggctaagactcaccttctgaacaggcagtcagtcaaagctcaaagattcagactctggcccaagaagtaggggctgacctctccccctgagttctgccatcccctcccacagtggcagcagcctccacgagagcatgcacaccttctgatttgggcacagggagaaataagcgaagagggaaatagttttaggcctgaatcttgaggctgggaccttgaatctgctgattatatgctcctcttaatgcatctctatttctaagtaacttggttttatagcaaagtaatatatgaatgcagtttctaaaacttaagtggtgctaaagatgttttaaaaagaaaaagaagcaggagccaggcatactggttcacgcctgtaattccagcagcttgggagactgagccagaaggatcatttgaggacaggagtttgagaccagcctgggcaacatagcgaggctccatctctaaaaaaataaaaaaaattaggccaggcacagtggctcacacctgtaatcccagagctttgggaggccgaggcgggtggatcacaaggtcaggagattgagacaatcctggctaacacagtgaaaccccatctctactaaaaatacaaaaaattagccaggcgcggtggcacgtgcctgtagtcccagctactcaggaggctgaggcaggagaattgcttgaacccaggaggcggaggttgcagtgagctgagactgtgccactgcactccagcctgggcgacagagcaacactccatctcaaaaataataataaaataaaaactcaaaattaaccatgtgtggtagcaggtgcctgtagtcccagctgctagggaggttgaggcaagaggatcacttgaacccaggagttcgaggctacagtggactatgatcatgccacttcactccagcctgggtaatagcaacacgctatctctggtaaaaaaaaaaaaaatgagaataataacaatgttttttaaaaaagaaaaaaatcatgccctgatccatcattcccaacccctattctcacttcctagaggccaccacttccaactctcttagtgtctctgtttctcactgtcaagttaagattgccgttttttagttaattttagacatgtgtatttacttcctttaatacatggtgctttggactttttacaccggctcatcctgccctcttcctattccaccaacatgactgtatgcccatttcattgttcttgattaattagtcagcgaatatattattaggacaatctatgtacattctctattattttaatagcatggtatgtgttttcttttttatgttatttttccctggattagaaaatcccctggtcttcttattgcttggttttccttctactcatcttaaattttcccccatgtgtttcatcagatgtctcaaatatgtattactactattttctaaatgtttggtatttctgcctatttcatcttgctttggtgagatctccctctctgtgtcatcctatttcagtccggactaatagctctctaggtttgctgggcatgcaggcacctaagacttctcttccctatttttctctgtcatctccccctttctcctaaaccctcatgccttctttttttgacttaatttctcatttaggtgatgaacattttccagtagtttactaagaaagggtggtaaaatttcctccgaccttgtagctctgaaaaggtcttcattccatgccttcgtttcctaaccatttgactggccatagaatacctggctgaaaatcattttgaattttgaaggcattgctccattttcttttgacttcctgtgttgtttaggaagtctgatatcataccatttccatatcctttggtaggaacaggattgcccagcctccaccctagaagctttctgcatgttcattatgccaggatgctgtgagttcacttcattcattgtgctgaggacctgcgaactcttttgctttagaaatgcatatccttcagttctaggaaattttcttagattattttttaggtctttttgttttattatctgccacgttttcttttcccaacatatatctttctacttttaaattcatttgtatattttgactgttttattttaaatttcccagggtatttatttatttatttatttatttatttatttatttattttgagacggaatctcgctctgtcgcccaggctggagtgcagtggcatgatctgggctcactgcaagctctgcctcccgggttcacgccattcccctgcgtcagcctcctgagtagctgggactacaggcgcccaccaccctgcctggctaatttttttgtatttttagtagagacagggtttcaccgtgttagccaggatggtctcgaactcctgacctcatgatccgcctgcctcagcctcccaaagtgctgggattacaggcgtgagccaccgcgcccagcctccaagagttattttttatagcagccttttcttgtttcaaagacacaataacttcttttatctctgaatatattgactgtagttagagctgggggtgtgtgtgtgtgtgtgtgtgtgtgtgtttgctgtctctgctgtaacactaactcatttagttgtctgtttttctttcttttttcaaggtgaaggctctccccaaatatctgtagcctagttcacttttaagagtgaggcactaaaatgcagattgaaagtttctccacaaatagactttactattgggtgaatcaatgaaaacttagccaaactggagaatggggaagatgacagtaattctaggccttgtttgggggctataagcttgtttgtcagcatctgagagctgggcagggaaaggaaggttaggaattcccatcaatcagcatgcaggtactcattttcccagttcagcccctcctccctccctcatctgaacattagcagtttttcaggaatatataagttggtgtctgtggcatgtgcagcagaatacatggtgttgatacctgctagtattgtgccctccagtctgtctgtggcagtggttagaattgccaggggatctggctctccgagccttactctgtagtatcttggcctcgaaagtggccaagtagggccaccctgtcttcaaatgccatctcttttttgacctctctctcctgtatccagcccaggcatgtatctctttttccctaggagccaatgagtgtctccagagcaagaacaatgtcttttaggtgcctatccataggaaatacagactttgaggaggcctggacttctttccattccctcccacttattagcaccataacctggggcaagttatgtaagttcttcaaactttagtgtcagtgcctctcagcccacccaatggaatctcaagcttatccagtgcagtcagtccccagccccaccaaatgcaggtttgacagtggttccctatcactaccccattaggtgtctataggcagccttgcttttttcaagattataggtgtcctgggccattgtatgttgggaatcaggcagggaccaggcagggtttgcagcatgcagagaagttatttctgccaggtagtcagtgggcaatgcagcaaagctgaggtaatgccaggcgtaggtagggtggtggatggcgggggccatcctcgttggaataaaggaggaggcctgacctctatcccggctcctgctcttcacaagagttctttgccacgcttattcgcctagctctttccaaacagcaggaaaacgagtaccctgcctcattatcacatttccttggttctaagatgccataaatagaagtggaagctgctaaggaaataaaaagcagtatgcattgatgtgcctgtcctgaaagactctcagttctatggaattccacctcagtgtcttagcttctcatgttctttccctgcctctcactttgcctgttaatgcttacctccacccctagcttcaggctgcaggttaaaaaccatttctcccccagtccccaggacttggttgagtgccccctcttatactcctgtacccatcctgtacatgtcttcagaccaccacaatggttattggttgcataatatctgtatgccttcagagattttagcccagggaacacctgagctgtcacatccttcactgtgtccccagcacagagatcctcagtcagtatttgttggatgaagagaatatagagaggggaagaaaatgaaaggaggggggatgtgagggccgttagcagcaggaaagaagagaaagcctcttagaaacagcccttccagtggaaagtttgacttaacgaagaagagcaggttactttcaccaaggccttgttgcaaaatgccaaataatgacaggagagccgtcctttcatggaagctgggtgcaaacctggggggagctagcattttggccaacctcagaaaagcatgttgctttgctcacttctccactggatgcaaagaatccaatcctttcttaaacacccgaaatcatggaagaaatgaaaggtaagacatacaactttggaagtagatgtggtttattaaaaaaaaaaaaaatgatgggaccatttagtccctgactgagagtactcttaaggcatggagctgtagtgtgaatgatctttatctgtaattgtaacactgtgtcaataaaaatagttaagcattgtgaaaaattaatctgcctgtgaccatagtgcatttaagatgattagaattacctggagagccttagacaagtaattgggtcatcaataatcttttctggaaccccataatgaaagtgatcttccattctaggaaaatactataataccaaaactaacaattactgagctcttactgtgttccagacactgtgcttgatccagttttcatcatcataatcttaaagactgagcagaggcgggttaagtaacttgcctaaatcccttccacagctggtaagtgggatcactggattctaattctgagcccacctttactctatgctgcctcttaacttttccagtagaccaagaaacagaagaaaagggtggaataatcttccaagcagtgctaatgcaaacctaagagacagaaaacaaggtgtataacaggctctggttaggacttgctgagcagggagaaagaaaaagaataccaggattccaggtgatctcagctggcatctgccagtgcaggataggacttctcaggaggcactgaagcattctcctgtgtacctgcaggagaacctatactgttgagtctgtgggttagcagcatatatccacaaaattttgagtgctagatgtccccacagtggcctgatgccctgggaataggcctgattatagtatggagatagtggagacttagtagcaggcaaaggaaatttttgctctggctataccccatgaaaataagaggtcctgactcttatcagtcaggactcggtcttgggaacagaagttaccctatgtattccaaatatgaagggcttggatgctagccctaaggcaactagaagcttttataatcattgcaatgtttggggatgtgggtcaggaagcatccatgtaaatggttctctagcactcactagggagctgcttcaaacctcacatctgccaacaaatttgcctgcagctgcctccagagcaacatggcctctgtctctttgctgccttctaaatctagcaccagctccttattggcaaatgctaatctggaaccacagatgggggagattccaggaaatgcagtcttggcctttctccttcaatacagggcagaccttctacggaggagatggtgatgtccaggtgaatatcacccatcaagtgctctcgaccttcctatgacctcaaattacaatgacattctatttctacttctcctctcacccccagctcactttcccctggttgtcttgactagagagtgagataggaaactttttgactagaaaagtatgtgtgatgtgagcccaaggtccattccaggtgacctcttgagagcccatccagatgagtaattctctcactgtatcacctcacacctgacctcagtaaaaactggaagattcttgataattgtcattagaaaaaaattaaaatgctcccaagaggttagcaactaggcccttcatgggcatatatgtgtttgccttcttcattgtccagaacttggttactaagagcagttcaatggcctatgtacattcaactagtatgggcaaaggtagcatcttcctgcagtggtttcaccatgagcacctctgcatgatcagctaactcggtacaactggatgatggtcatggttgccaggcacactatgctggaaggatgatgagactccttggaaggaatactaggtttcatgagagacacttgacatgaaatagggaagggcaccattcatgccacagatttgcctttcatgcccatgctgttgtcagctattgtatttgactgtctgcatggaggtgcttatgtgacagatctctatacatgaagataatttgctcatctcctaccaaactagactacagttgcatctgtcaggagctgtttagtgcaggcaacaaccaccaaactcagattggtttaagcaaaatcagtaaattaaaggaagttgattatttgattatttggggatggttggaaatacattgtttcatgtaactaaaaagtccatagttataaccagcttcaggtacagttggatctggggctcagctgaaatcaccaagtttctcagtctcttgttttacttttctttgtgtcagccctgttctcaagcaggccttcctcatccagtgcccccagtattcatctgagcagattggcaaactcagtggaaagaaaccccctctttcctaaaagtttcagttcaatgtcctggggcttgttctccttgatatagttttggtcagtgcctatcactttggcacaggagcataggatgcatccctatgcctagcaggtggagggtgaagcctacacatgccacatggactggaaattggagtcatgacagctccccaaaggaaatggtctaggtgtggataaggagggagggtctctgctgctgaaaaaaggggacatgcctgctcagctggcaaaagtaacagctgtctattattccagctcagctggagttcaaattagtttgagccatctatgaatcacatcaggcaagttgctagcctctttggatcgttcattattggtttatgaaataagcaggttgggttcaatggcccactccaccattccagctcagaacttgtgtaaatctacccattgatgccatacccaaggggcagcactggaatcagggcacattatcaacattctcaagcgcattggtcacttatttcaggcctaattgtgttgcaaacagtaacctgaaaaaccgcccaacatcgttggtcagggcctcagaaaaattcagaactggttttgcaggggcacactccacagaagtgactgtggtctctgccacagatagatgcatccttaggctcctggatggaagactttttttgcctgtgattctttctgaaaactgggcccctgccaagctcatctggcatgctgtgctctgggtagaagtaattatttttatgaggcattattcatgtctagtctacctgagggccaccccaaataatgtttctctagctattaaaggcttcatcaggcatgcagagtctctagtagtttcctttaggggaaaagaaaaagattcgtcttgaagtctaccacctccagtggcaatttgctgtgcatttcagggccatgctaagtggttggcacctgaaaaaagggcgaagtctttttctttcaagtgcagctggaaaatgggagtcataagtgaaaagtagggaactgggagaactatttccatacagccgaggtagctttcttgttttgttctgagctggcaaacttcaacatgctcaagcaatgttttgtcaaatttcttaaatgctgaatgtggcactggcccaaatgaacgtagatgttattttagtgctgggagagatttattttaatgtacagatgcagccactacaaaggccccttttaatctgctgagggctctgttccttgctcttttactctttgcaaccccctcctcattttagggaacctgtgtatgctgtgaaattgcagtgttccttccttccctcttcatcttgcaaggcagcgatataatgctgacaataattataattaagatgctttgtgcaagaagaagcagtttgcaatgcttcctcctgtttcccagcctaccagcaattcaaagaatgctgcttgatcaaagaaaatatgccaacaggagagtggacctgcacagctccaggctgtggcagggcagcctcaacagttttccttatctaggacccaggttctctactcacgaaaggaacccgttcttttactgctcggctgtgagatgggaaatccatcagttgagctgagcctcagataccaatatcttgcaccttgatcggggccaaaataaacgggaagggacgcacagaggaagcatggtgacatgtgaggtttgcctgagccaagtctgtgctttcaaggcaagagcaggagaggagagccacagacaagatggggtgagagggaaaataaagaggatactctctgggctcagtggcagaggggaaactgaagccaggacagtcctgagtcttctcacacccaaggctccttttaaataatcatttgtaatattccctttactatctccaaatgaaattcatagaaaatgtaacttgttttcctatatgctgccaaaaaaatctacagaacgctccaactataatatcaagaactagttgagagttgtttataataggaaaatagatattgtaatattttggggcataactacaagataatacagaataaagtagctagatgcttgtgctgcactttggtgcaaaatctgtcaatgcagtggccactatgtagacatctcacccacaaatcctgccagatacctctgtaatagccaagccgcagacaagataaagaagacccatctctctctttcacagcactatagtaatgtttctagaaaattccatgtgcaagacatactttgtatttggacataaaacagagttccaagccatcgacaccattagggacatggaactgttctttggtgtgcggcccgggggcagtggggtggggggctgctgtcctgtgagttgtaggatttcagttactgtgaactttgaagcatctctacagacttccagaacagacccctagggggtgacgcagccccactgagaaccacaggagagcctgggagccacagggcggctggctctgagtcaggcgtgcagggctccagtcccagttccaagaagtcctggcaactgcacagccctggttaagtcactgaaccgccgtgtaccttttctttaatggagaaaacatcttctcccttgcaggatggctgaagagttaagtaagataacacagggtgggttcctggcccagagtgggccctcagtaattctattttctgtcttcttaggaccagccatgcttgttattttattttaatttttggagacggtctcactccattacccaggctggagtgcagtgacgcgatctcggctcactgcaacctccctaccccaggttcaaatgattctcctgcctcagcctcccaagtagccgggactacaggtgcctgccaccatacctggctaatttttgtctttttagtagagatggcatttcaccatgttggccagctgctcacaaactcgtggcctcaagatctgcccgcctcagcctcccaaagtgctgggattacacatgttagccactgggcctggctggccagctgtgtttataaactgcctcctgcacccctgttggttctatactatttcttccctctgtaaccgccttcttagagacaaaggatgttggccttgcactctgcagcacccctgtgggcacaggtttcctagaaactaagccccccagggctctgatctctctggggccctgcctagtttcccaggaggctccccagttgtcttatttcttcagagggaggccgcaaacatgaagggtctggaggctctggaagatgtcatgagcatcttaggagctctttttgggctctcagagacagatcagttcacagatgtgggaaagaaaaaataaaacatgaggcaaaaacttgcaagaaaatgtggacttaccaatctcatattaagcagacggaatgtcaatcttttctatagggacagggtcattaaatgcatattttttgaagtaattttaggtgagtccctttggctcattcattatagttatttattttctgcttctattctgaagtcagaaagatctggtgttcatgggttcaaattctggtgcccgcatagttccctccagcttccagatgggaaagctctctcatctgttttccagcccagccactccaaaacctcaatgccctcagctgtagaacagagggacaatgacaatatctatctatgaggattccacgtgctctttggatgttttacaaattcagcagagttgggaatgttctgggtggttgagatgacactaggtctggcttacttgtcttccagcaacaaaggaggaaacttttcatagggatttgaagcctaatgttcctgaaggtgacatggagtctgcttagtggatggattgttgagcaggagtcattctccagtcttggaaaaactgtacagagactcaactgcaggggaggaaaccaggatatggattaaataatgcatgtatttaatgtacatacctgttgttatgtgtatgtgtgggtgacatttactgaatatttactatgtgcctggcactgtgctaggctcatgacatacattagctcatttaaggcacaaacgtataaggtgtgcatgactcctgttcccattgtgcaaatgagaaaactgactctgaaggcatgctgcatgtacatgaaacaggcaggactcagccctaagtttgtctgaaattttcaaatctgggaaggaagcagacacagatagtaactaagaaactgctaaagtggtggggcccggtaacactacggcttcttacctatagaggtgagactcatgaaattccccaccctcagtacagatagcactgggccaagatcatgggacgcagctgaagccttcgcgcttggtggtcagatggcccatgctgtgcgtagaggaaaagtaccagtcattacaacaaggcctcaggagaccttattctctcaaagccacttcttgcaatacttggacatccacgatcctttctattttaaagacttctgtccatgctaaaaggtccagttccccaggagctgggaaggaggtgaggattaagccattgtgctggttgtttcccccttgcctgtgaacgcttggggcaacctcgggctcctgcctctgctagcttgacaggctgtgggaatcactgggagtgggtgaggggggtgcactgcaagtcagtgcgcacaaccctaggttctcttccaggatcagccccaagcagacctgaggaaaggcctgggacttggagtctgagtagcctcttgaggtcaccccgttttgctaagtgctccattgtttatgttcttgtgtcatgaataagcagaggccacagatttcagtccacagatttcaggagtgccatccatgcagttttatttgaattcaacctaatttccatcagaagtcttcattatcctagtaggcaagaactttccatgaattcagtgtctctctgcctattcccagggtttacctgaggccaaagagagagggggttatttaatcatgtcatcatgcaggcatttcctgagtcacccagtcgcatctggtcttctgtcatcagtccaggcacaggtcagtgctatggcctcctcattccaagggaaggtcaccttcgagtcagtcggcagctccctgggcctcactctgaagagcctgcgggagcacgaacacttccccactgagttgtctgtctgtggcctctgggaggctgtctcctttctggcagtagcagggcttagagcagggatgctttcacattcttcccagcaataggagagaaaggactgtgtggagcagaatactcctcactgctctggtagtttccagagttagacccaaggtaggaaggcagatgcctgcccagacatcagggtgcatatctttctgtcggggtctaccagcccttcggcttccctttgattctcttccctttccagtccaaatcatctttcctgagcagctcgttcaggaggctggaggtagggtgtggagaagacagggtgcagagaggacaaactggcccaggcagttcccctgtttttcttcctgccctgagattccccaggcctcagcttttgagagtcaaaaatccagaatctgcttctttgttctctggattcctgtgtgtcctcccttccctgaggccttaagcatggaatgctttagctgagggaacagagaagagccagggggtgccaggaatcttcagaaagaagaacaactgggtttcagagttatttctcagagacagcatgagaggcgccgattaacctccttgtgtctggaccacagtgcatttgctcattcatttactcatctagcttttattgaatgcttactgggcaccagctatgcttagggaatatgagaggtgtagagaaaacttccccttcaccctctgaaggtttgctgaaaatcaactgacaaaagaccgattagtaggagagaagacatacaaaattattcgaacgtacgtaacatggggaatcgtaggagaatgattatccaataacccagtggggtacagaagcttacatactgtatatacatttttcacaggggacaggggagatggggacccaccctggaggagacgggcagacattagggaaggtgaggggcagagctgcacagggacaaaggttgtcttattatgcagataatgtcccgcaggtaatctcttgaagctactctcagaagaacagatgaaaagtctgtctgggctggtgatgactcccactctcttctctggtcattgatctttcctggttatttgatgagatttctagggcaggggtttaagacaattgcatttcttttggaaaaaagaaaaaagaaaaaaaagctctcttggtcagatgaggatattccaaagagagtccctccctgcacttaggataagaggagaaacaatactaagctagaggaacgttgattctgaggcagcttctaaggtctatcagcatgtcaaagctccagtctttgggatatcattctttgagtcccaacagaatgttggtggaatggagaaatgtgtaaattgagggacactgagatcagacagcctggctctcccctgaggcctctgtctaccgagggggcttttttgggtattggccctgctgagaaggagttggagttgacctgccaaatcagatgggaaagtgccagccccacctcacagcccaccctcaggagacctgaccagctaagcctgctcacgaaacctggtgagagtcaaggagcagtggcttaacaacagaagatggcttttccagcctcgccatctgcctgatgaagagaaaaaattggtattctccactccagggctgactcccacatattctaaggtcctgagattccaggaaatgagagggaaaaaagtgcgtgattactccagagtgccgtccgcccctccttaatgtttccctgtctccttctccctcccctccctcctcataatcacctcatgtgcagctcttctgggaggatctgccttgggccaggtctgctgcagctgatcatatctgccacccaggtgtttgactttgaagtgggtatctccctggccagagggaaccaagcccagtggcttgccttgccaggctgccttgctgcatgagcagacccgtaagcgcatggtcttcccttggctgttcctggtgtagtcatcctttccatgtacaatgaattggagattccgggaaaagaaagtgatggtcttgttgacccaccaccaaggggacaattttgctgtgtcaggctatccccagaataattaccagtttttgttttaaccttcctgtctttgtcttttaaaggccaggaaatgcagcttcctaacttgcatgggccacatggtcttaacgttctcagtcttttcaaactcgttaccaacctaggattttgtgcacagccaaaaatactttctcccccactccctcttcaactggtcttaggctgtcataaattcctgctcatcctacagaccctgcctctttagtggagagctctttaactctacctccagattaggtaatttgttctcagagtaatcttaaggtaatggcctaatcacctaagcaaatcagtcatcattacctaggggaagacagaacccatttgaatatttagatgcattaattggtgcaaatattctagagtgtttaggtagcaaatgacttaccttgatacctccagtttgcattttatctgacagaaaagaacaccgagagcacactacatcttacagttagggaaacctctttgcctttgctgtataggttgaaaacaggggtgaaggtaacttcttagtaggagacttgaggcccataactttcttctatgacccttgctcttctccaatatcaagtttgcaggatgttattaggattagcaataaagttttttaagcttctagcagacacctggcacatactagagggcttcataaatgggattaattatgattattactactgctatgattactatgtgatataattcctatgaatcaagttataaaataattttcttttttttttttttagagacagggtttctgtcccccaggctggagttcagtggcacaatcatagctcaatgcagcctcaaactcctgggctcaggtgatcttcctacggaacttagactataggtgtacgccactgcactcagctaattttttaaaactttttatagagatggggtctcactctgttgctcaggctggtcttgaactcctggcttcaagcagtcatcccatctcagcctcctaaagtgctgggattacaggtgtgagccaccacacccaaccataaaataattttcatcatggaataagtcttaggtaattcggagacatatctggtgagcagagaaatatgtttcattaaataatttacttggaagccaaagcatgttcaaacttatcaaactaaaatgacagagccttgaggtctggtgtgtgtgttagggagggccggtggggaagtgctgtaactggccagattcagatacgactgatgggcctttggcaaactcaggggttccaggccccacccagtcaggagggttagaaacaagatcacacctctccatccctggtgcccattgctccatgccagtccgtctgtcatctctcacccggtaggatgagcacgcatgacccctacacagtcccccagacacaaaccatgcatcccagcaacttcccctgtagatttttccaaagcacaaatctatttgtgtctcacatccttccctcccctgctgagaaccttttcattgctctctgttgctcttgggacagagtccaaaccacatggatggcagaggtagatgtctggagagagcaaactccctgagaataattgatatctccatccacattgcattcaaccaccccgtgtgtgttcacaagtgcctgcctgtgctggtagcttctctaggtacagggaatacagcagtaaacaaagagcctcaacctctagttggatgaggatgaaacacaataaataatataaaatgtcatttaatgtcaaatattgataaatgctatgaagaagcaggtttaactgctgacaagaaaaccagcagaatattccatgtatcggatgggtgtggtggcttcagcctataatcccagctactcaggaggctgaggcaggaggactgcctgagcccaagagttggaggctgcagtgagctatgattgtgccactgcactccagcctgggcgacagagcaagaccccacctctatttttttaaagagtatttttaggtcaaagtcagtttattccctacagcagtaagggagaatacaaccttgatagtcttagaagtgtctcagaaagaggaagccagggtggatatttacagcattttggagtctgggcaggtcttccaatgtggggatctggttgggattgggacgtctcctgagtaaagcaatagttattatctttctgagcacgaattttctggaactaatagcaaagtcatgaaagtcatgttgatggaggtggccttggtcccagtcctaactgttaagctgcaggatacaaactgtctcaattctctcagggctaagtatgcaacagagatcaccccaggtcattgcctggggatgttctgtgtaacccccagcctagagttgccagatttagtaaaccaaaaatattttatctgcctggcatggtggctcacacttgtaatctcagcactttgggaggccaaggcaggaggattgcttgaacccaggagtttgagaccagcctgggcaacatggcaaaaccctgtctctacaaaaaacacaaaaattgaggcatggtggcacatgcctgtagtcctagctactcgggagactatggtgggataattgcctgagcctgggaggtcgaggctgcagtgagccatgatcgcgccactgcactccagcctgggcaacagagcaagatcttgcatcagcaaaaaacccctttatctggcaatcctattagagtgctgtcagtttttcaaatgaactgtctgtatattgagtctcgtgttccacaaggtaccagttgggccaagctgagctctgcagctccctggagactgcggcacagggtggtgttcagttcaccacagttccctgtcagctctggagggaatttgagtttgggagctccacaggggactcaggtccctccagggagctgggtgtgcttgggcaagttctttgccatctccgtgccctgtaacatgaacctgacagtcagaaggtttgcaggcatccctccagctctgtggactgcccacgtggagattttagtgctattttatattaaataagtcataaacatccaactcagagatgtttggcaactatatgtggctgttctattattattggtttggaaatgtttagaaacttgacccccaattttgttatggtctctttagtaactgttattaggtggtgacctaataagaaattattaactagggagctataacttggaagcttataattttttaaaggacattgatttgtgcagccctgattaaaatacaatgaagcccgaggcttaaatgttttcttctgaaaggttgaaagggtgggaattgactctaaaaatgtattggcttgaaaactttattgaaataatattatttgaagaactttgtgagcataaaatgatctgacaaaaacaatttgatgctagctccggcagcctgggaaagctgagggaatataggtttcttcagatgaagtctggaaaaatgcttccagattacctcaagggtgaaaagaaaattattattccattccacaaccctgctaattcttttcaacatcaatccagtcaagtaattagaacccaaatggaggaaacatttataattgtcatttactctactttaccaaaggtgacagttccgagaagctctgacaggacaaaaaaaaaaaaaaaaccaaagtgattatgaaagaaatgtgtggccaaatggatcaggccttcctacactggttcccagaagccagtcacaggcagcaggtagggatggttacagattaaaataggcctcctcagcaaagaaaatcttctgctgcggccttgtcaatggtgtgataatgtgagctatttctcctccctctctctcaccacagacatatatcatggagtgctttgttatttaaaagcatgtataagaaagattaccaaccccccataccacagggaatacttcagaagtgaaatatgcaatcatttaggggttacatttaaaatacctcctccccttttatcattatatttcttcacttgcactaggctaaaatatgaggtgtttctgctgctgtgagaatttttttttctaatttctgaaataataccatagcttggagattaatgttcaggctttaccaagattataacaaatgcatattgctttgatctaaatatttctccaaaggttgttgctgatcattctcccttgcctataatcttctaagaaagcttttgaatttgccagcctgatacccagggggacaagagtgcagctgccttcccttccttccccctcatcttcccgaggatactctgttctcagttttgcccaaattagtcccaggatttcagttgtcttttttgtccaacattccatcatgcaattcattaacatcttcacatgaaatatttaacagatgagttatgtcctaattcacattgcagttttaaattgttattcatgtggtaagtcatttatcttggacaccaacagacctccggaatgggctcacatttgatgtaaagaaggttggagttattttccttgatgctccagaacagtgccctttttccaaaccctgggttaatcatgaaatattcccaaaaaatgacattcagattcgttgttagttctacttgcagttaactgttttgaaaacaaacagaagaaaacatttaaacaaacgtggcttgggtaatggctattacagttgaccgttaactaaggcaagttggaatccaaacatgccaggccttgttactatcactgctagcaatctttgccatggtgcacaaagaaataaaaattcagagactgtcaaagtggaggtgagactggataagagatattaaccaagccatgtaaaaatacccagtgccctgattaagaaatatgaccagcaaggaagctgatgatctggatgagcatttatctgtacaatttgggttttgggaaaagtcactctactcctaagagatgaaatatatgggaaatccttagcaggtaatttatttattattaacttattgtagttgtattccctctaataaaactacaattttctactatattcctacctatggattggaatctattaggagaaaatcttctgtttgtagaacaagccagtgcaagtcagctcttggatctgtttctctgcctggacaccacaatgaaatggtaattgtccacatttgcaattgtccagcagtagccaggtcattgagaagttttgtgggcaggtggcctgattgatgtgcacaggaagctgatggcaccagtatcatggacagcagtcttcttgggttctgtaccctgacctgtctaaccttgtcctgagtatgcatgaatgatcacaattccagaaggggtgggtgacaggacatcttctgttttcttttgcttttaacagagtggtagaagccgggtaatttgtaaagaaaaggaattcacttcttaaagcctcttctcagaggctgagaagtccaagttcaaggggccccatgtggtgagggacttgctggtgggggctctgcagagtcccagggaggcacagggcatggcatcgtgaggggactgagcgtgctcactcaggtctctctccctcttcctgtaaatccaccagtcccactctcatgataactcattaatccattaacccattaatctattaatagattaatccattcatgaggacagagtcctcgggacccaatcacctcttaaaagtgccacctcttaatactgctgcattagagatcaaattttaacatgagtttcagagaggaccaacattcaaaccatagcacaggttttgaatggtggagcacacctttccttaatcctgaaggaaaaagattaattctctaagagcctgcttggctgatagcatgattttgtaatgcatttgctcactgatataacactctaaggaacattcctaggagtggacagtttgcattggtcatagatgaattttctgctcactctcaacataattggcatgaaaggcatattagccatgaaacataagaataaagaataaaagctctaggagcaagtcataacatgaatgatgacaacactatcaactagttagagtattttaatacccgtgattttatttactctcactgatttttgtcccacaaaaattctgttcagaagccagagccggtgcaactctattggtggagacagagaggtaaagtgacatacccaagggtacacagcagtggtcttaaaacgggtttgcaatcagttctcgcagcaaaacaactcctgattggaattcactgatggtggcaggattgtttttctgccttttggatgagctctctatgtgtatgtgaatatattgtatgactggagggctgggcaaatggaagtaggggtgtttgggtgagcttgtgtgccaggcatagtgagcactattttacaaaccagatctgtgcccctctagtatgttgcaagttgaggccaaccccacaggaaattatttctaaatgaatacgatatgagaaaagttgttttatttctaattttatatgttttatttctaattttatattttgtgagtttcagattacacttgaatgcatgtctattaacatgatatgagatgcatgcatgatttcatcttgaatgcatttaaacataatagcactgcaaatgtaatttgtagtctcaagttttataaagcaaaataaataaatctggagggtggttgttgcattgatttctttagggttcattcaaactcatttccaacttccccttgcaagtccaggttgtctcacgctggcagtcctgtctgatctaaaccccctatacctaagtcatctcatttcttctacctctggggagtggtagtatggacgggtttgtggagaattgtaccttccatccttaaggagtgctagggtccatttcttttctatggttccttctgggatcactggtcatcgtccagtagaagtctctgcaatgatggaaatattctagatctgcatggtccagtaccgtagcctctagcaccctgtggctacggagcacttgacatctaactagtgcaactaaggaactaaattgtgaatattatttaattttagttaatttttatttaaatagccacatgtaactaatggccactaatttggacagcacaggatcagagcattcaaggtcagctgcctgtccctagattcaagcatgccgatcattggtattctgcaaagcaaatggtctatgtgttttggatgatgccctgcattcgtttctgtcagctctggggatgctgaagtgtgaatctctcttcggtgatttgactgccctccccaggcctgtacccctggcggttgtgtctctcacatctttttctcaatacacctatcacccagcacatactgggtttctgataaacatgggagaaaggaatggaggaagggagggtaaaagtagataagaaggaagttagacagttgggaaaagaggaagtctggaaggaagatactttgttgaagtttcgatatctgtagttaagccctcttagagtattgagaggagttgtgagaacagtcacacagatagttcaaaagagaggtcagtgcttcagattcctgaatatttcacatgaaaggattctgggctctttgagatggcaattcttataacaataattttgctgtcttggtttccaaagaccatcccagtatcttggggtcgctgtcctaggaggctcaccccatattggcacatggggaaggatcctatgggataatattttctggatcggttgtgttcctgggtggtgagtaagatatcaccagatgcagttgtgtaaagggactttgtctctatccatgtgatgaagattcccagcagggagggagccctgggacatctgtaatcaaattgaagtaaggagcactgtgacctccggggaaatatgttgatgattttctggactgtctaaaacattacaaaccccaggaatggtgatttttttttttctgtaactctccttgggacttgagtttcacaaaagcatttgctgtctttgttttccttattaaattagcaagactgacttaaatcaatatactgttactgcttgaaatgttgctgaaagaacaaaatagacgggcttgacaaatgtctcaggttccatttaggttatgtgggggctgaagggagagagtgggactcactgaagtagtcgtgttttctctgataaaggtcaagaaaagaaaaatgtggaccaaaactaaggaaaatagtgaaaggaagctacacttctgtttgtggcttgtggcaggtgatatttgtttttctgaatagagttggccataggattcccttaagcatttttgtttatttgcttgtttgttgggggagagggttattcttatttttttttttgttgccttgttttttgcactttaaatcattttcacgctcaagaaataatgagctcaatcccgttactctcgatcccttactctcattctcccatttcccattttataggccctttccctagcacttcctctgcgagctttcagagtgggctttctaaaaatataaacctgatcctgccacttcgatactaaagaccttcaatggcaccaacggcagatgtcagaatactttttctgtaaaggaccaatagtaaataactgaggttttgtgggccatgcaatctcagttaaaactactcagctctgctattggagtcatagacagtgtgcaaaccaattagtgtggctgtgctgcaagaaaactttatttacaaaaagaggctggatttcaccattggaccaatctctggcctacgtactcttgaagctttggcctgacattcaagaccttttgccatttgacctcagcctgaacaactgggtccccgttcccattcttctcaagcctccaaacaaatgatggtctttaaaaaggttctctcccttcccctcccttactgtttcctccatttggattgccatcttccctggcttcttactgttctgtgagtgggctctccatgcctcaccttacacaaagctctcaccaggccaagtcagccccattctctgcacgctccagttctttatgcctctagtgtagcttttacaatggatctactcctcaactggacgtggagggagcttagtacccagtgtagagcttagtactcactgaacaaatggtcgtgaagttgatccatcaatgaaattgtgagtcccttaatcataggagagtatattaacttatgggtaaaagaaaacactgcaaaccccagatatgccacaggaagccaggggccagtgttactggaaaggggatgaggtcagctagccggaacacagctaggtcaaaactagcagaacaattgcagccaggactatccaggagcctttgggcaacaacctcatggtgcaggcaggggtgtgagtgaggagagagggaagcagttctagttcagggcatcaggaccaggacgaggatgcagcctgctggagggagatcagagagaagcagcctgcatgattaatgggatggagggactgactcatgaggaaagatgaaagcgccccaaggagctggggtagaggaccgacaggggcagatgagaacagactgcaagtatgtgagatggataaacacccagcggggagcagctggcttcatcagggaggtgaagatgagggctccatcagagaacgggggtgggggtctcagaaagggcatcaggagactcatggaagctcaagagatgacaggtgggcccaggacagctctgggctgttggagggagaagcaccatggaaaggctaccctggagtgactctttcagggagtcagaccctgttttgcaccctgcaccctggcctgtcaggcatttggaagatgagatttatttgaaatgcagtcaactaccatcagactcaaaatcagcttctttcaggcattctctgaaatgttctccaatgctgggaagaacagcttttgtgttgtgtagtctggccacgtggcccacatcacagtaggtccccaacagctgatttactaaagccatcccccaccttggctgtgcgtgagaatcatctgggacacttttaaaacatacccaagccagccacatggctcacatctgtaatcccagcactttgggaggttgaggcaggcaggtcacttgagcccacgagttagagatcagcctggctaacatggtgaaacttcacctctacagaaaatacaaaaattagccaggtgtggtggtgcacacctgtaatcccagctactcgggaggctgaggcatgagaatcacttgaacccgggaagcagaggttgcagtgagctgagatcacaccactgcactccagcctggacagcagagtgagattctgtctcaaacaaacaaacaaacaaacgattcgcataggtgttactcttctatatttctctctaactgctgactataatatcacttgaaagttttttttaaaaagcaagcatttacctatgggtcgtctgtgtactcagcatcttgctggaggcaggggtccagcagggagcaagaacaggtcctcattcttgggaaggctgtggtccagagaacgaaggacacttaaggcagagcagaatgagcctgggcaccgacatggtgcatttcagaggcttttcacgttctgcatgttgcagccgtgcactgctctagtctttatcctagagtcggaaattctaagtgcaaacacagatggcaaatctctcccaatgtacacacccagttaacctttactctcagggctggcttcaacaatttctttaggaagtagaaatgcccttgatagttatcagggtaacaacagcccaagacctttatgaatctccaagttcctgaagccagcacaacaatgattacccaaatgggaggtccagtatagtggcacgcaaaatttttagagtatttaagtgattttttttcttacaattgtgtatttcttttgatgggtgttccagttttatttaggttgaattactgtaggtctttaagcaaaagaaagaaatgtggaaggacaataagagtattggtggtatgcaaatatggtaaaaatggggaggttgtgtgcaacagactacagtttgcaaaactgcactggggtaaatgacgtgctccagggaattcagtattccctgtagtctcattcttctgaacgcctctcaagttttcccaccatctgaggagcattttgcccttaccattttacttcctgagatggtttcaggtctttcaagtggtttgggcttcatggagaaaaataaggtgaacttcctcatgttatagttttgaggttccactaaatttcacttcccaaagtttcaagtcacattcttaacctcttctctttttggctgtttctgtcactagaactagcattcacagttgctttaggaagcttttcacagacaaagaaaaaattacataattttaccagagttccatgggagagaagaaccttgagatgtggactctaggaggccagttaaactaagacacattatagtaaagtgactcacttctgaattctagcctcatgacaagtgcttttcaaatgttacgtctcaaaaacacatgcagagtacacattttagacatgcaagttcaaacagtaatagctgacaggaactgaagcaatagtgatcttttgaatttttttttttctttcctcttctcagcttgtgttggggtgggggtaggggcagtggtgcaagcatatgaattttagaaatgccgaagtaacatgtctccaaagagcgatctgcactgtgctgtttgttttgtatcgagagttctgtgagtgcaggtaaacttgagaattctttacctgaaagataaaatgttttagttgtatgcttcactgtacattttattttatatgcttatatcagcttcttgccatgacggataattttcaacgataatcttaaataattgtgtaaagggatcactaatgccttgttttatttataatttgtcccagctgtaggcattcagatgaaacttgaatttttccaaaggaagttctggactgccagcagacaggtaagttataatcagcatcttgaagcattagcgacactgttattatacaggtgttcccatttgggtacctggagcctgaaagtgccagatttccgatgaatgtttgtaaaatcaactgccggctgctcagattacctttcatttcactgcaaaataaagggctgtcagcatgttagacaccacatgctgagcaaagcagggaatttgctcctaggaacagttttaattgtgggatcaagatagtgaccttccaaaggagtttttcttttaagtattggggccttttgtgagattttcattctgactttctcctaatcctgtggtcgtgcctggttacttacttgtgaatctcattatcaaaatctagaaaccctttacgtaactagtttctccaaaacatgtatctgacttctttgttcacagggtctaccttggagaatctgggaacattgttttcttttcgctatgctctctgtactaagtcatctcagtggtatttgttgagtaatttggtagaaagggccactgataagttgcttccatctgaccaagaataaatgttagaatggcttatcatcctttaaattaagatactttaggaagctataaactaaggagatggacaggggttttttaaagtcactgagaattaatgaattttaaattaattacataattgtatttttagttaccaaaagatttgagatcttaaaaagatatcattactgtttaatgacaacataaagtagactttttttttttttttttgagatagtcttgctctgtctcccaggctggagtgcagtggtgcgatctcgactcactgcaccctccacctccctggttcaagtgattctcctgcctcagcctcctgagtagctgggattacaggtgcctgccaccacactagggtaatttttgtatgttttagtagagatgggatttcgccatgtggccaggctggtctcgaactcctgacctcaagtgatctgccctccttggcctcccaaagtgcagggattacaggtgtgagccactgtgcctgccccaccccgctcagttgtttcatagatcttttattttacattactacttggaattgatactgattccagagatagtagacaagacacatcatggagcattccttttcaatgaaattgggtatttgaattctagcccatgacttggatagcttgtccttaagtagctcagtggcagccacagcaggcactgggatgcccaagtaacatagtaacacatttccctccactttttgccttcacagtgtgcttccctggatggcaaatgctccatcagctgtgatgatgaggtaagacggcctcctggtcctgtttctacccctgtggatagaaggtgacagatggtgctttatgaccgagggaatgcccttataaacaaggccaggttgacgcattgtactgggccaatctaaaaaaaaaaaaatcatttgctttatttgctttgtttctttttttttgttccccacctcccatcagtttatgacagctggaaatgtgctttaaatgtctcatggatagcactattggaattttgacattttgtaggaaataatacaaactcctaactcctactgtttgaagctcacattacaattctcaaacctttttctacatgccttaatctctttccatccttgcaacaaccggtgaaataggtaggacttgttgacccatcttgcagataagaaaaactgagcatcagagaaattaagtgattcagctaatttcatgtaataagcaaacaaaaaacctaggagttaaaaactttgaaactcaaaatgtttctttgtagcatactgcttctctcctacaaatcttttcttttttcttttctttctcctcttctgttctctctctctctctccgtctccctcctctcctcccctcccctcccctcctctcctcccctccgttcctcacccctctcctcccttcccctcccctcccctcctctcccctcccctcctctcctatcctttcttctcctctcctcccctccgttcctcacccctctcctcccttcccctcccctcctctcctctcccctcccctctcctctgctctcctctcctctcctctttttctctctctctgccttttgggaggagggattttaatcctacacatgcgcaatggaagaagaaactatgccactacccaaagtgtttccatctgccttatgtttttataccttgccatcccataccctctgccccacgttttggagcaggcagaagcatggtggccttttcacttctcctgaggtagcctttctctctctgcatcagtgaaacagcagtcaatatgtaaactagaccttataaatagtcacatatttatattccttctgcttatcatgaggacttaagaaatcctaaccaaacaatttcaacccagaaaacatagattaggaagtagatttcaaaaaggtggacaaaggaaaaacaagtaaggaaatataaaaggaagtccaggatgaagttaaaacaaaatgctcggtcccagaggatctggctgctggttagaaaatcataatcattgtatgagtcacagtatcaaaaaaaaaaaagccagtcagcaaagttttctgcagaagcccaagtttctgtgatcatcagatcaaaactaatttccccttaggaaagaataccctgtgaagttgtatggtccacacccttttcagcaagttcagggataatttttgtaggatagtcaagtgggcctcaagcctctcccatgtctttgagacatttattgtcttattggagtgctcagctcaagaacaacacaactcaatagtagtagtgattaatcagtgtctcgaggccctgtgttaagctcttcacttgcacagtgggtataattatgaatcccagttttacagtaagaggagtgaggatggttagttggttagttggctgattgtacagatggttggacgggtggctcacagctagggcagtagcttgaatagttggttggctcattggttggttggttacgtagttggtcgattgattggatagatggttggatagttggttaaacaattttataactaaagccagagacagtaatcttcccagaacccacactgcctcagtgcatccttatataaaaacaagtggaaatggatttccacttagagttggaaacatccaatacatgttcattcttcaatgactgctttcacaggcagtctaacatggtggttaaaggcaaaactatttacactgactagcttcaagtcgtgactctgacagtaataaaatgtgtgaccttgggcaagtttccaaatctttccatgcctcagttttctcaactatacaatggggatagaaatatccacctcacagagtaatggtgaagaatgaatagataagacatgaacaatgcatggtatggctcctggaaatgataagcattcaataaatgttgtttataaatttaaaaaaaaacaaactctgaagatgttttcttccatgctgtggtttcaggttgctggatttgaaacctcagacagcaatggtatatacactttgggcaagtgacagtttcccctgggcatagtaagcacaggctacgacctcttgctcactgctaacaatgttcttttagcaaccattgggataaacccctattcaaatgtcatttaaaggtccacatgctttgaaaattaagccttgaagttgccctgatttctgaacttgatctgatgctcaaatatcctgagtttgtactttgaagctgtcatccgttgtcctctttgactcttaaattttggttccaggcaaccaattgacactgttttaaatagaaaagtcagtcctgccttctcaccaaggcccctttccattgtttcagcagactcttgccatgtgtcattctcttttttgtaacttttaattaggcatatgagaccatgttcctctcccccaactgccctcgaatgatcaggtctccattaaaaacagctgtgggggctcattaagttcagtggtctgacttctccattgcacttatgacctggcccaactccctcgggcttatcagacacacttagccttagatccactccagcccctttgtctccccagtcaatgcactctctgggccttggcaggagtgctgtggctggtaggtggagccagtgtgccagatgctctgccatcttgtagaggtgcatctttggttggcccagtcagaacctgagccatgtgacttgagggcctggccatggggctgacttttaaggagctccatttcacccagggtgaatgttaacttccaagccattgaggcaacagttcacacactcatttcttccttcaagacatctttaccgagcccttcttaggcacctggtgcctggctgagcacggggcagtcaatgggaagcagtcagaaaaggccctgctctcctgaagcttaccggttagcaggagagataaacttatatgatcatcaattgtggtaagtcctgcagagtaaactgacatgcggtagtcagcgaaggcttctctgagggggtaacatttaagtcagccaaagaaggagatgatattgaagacaattcctgaagcctgagaagagctttgcaagcagagaacaccactgtagaggcaccaaagtggcaaagggtcattgtggtcaaggaaaacacagttagcattcaggacagaagggaggaaggagggccacgttcacctctgatctcagtctgacctgcaggtgctagtgtttcctcactgctttcagtctctttctccttttccactcacctgtgcaacacttctcatctcctgatgagagtaccaggagttagcaaagacggtggaaggtgagaaggtgtctcctactgaggcattggaagaggtgtgacggcagcgagagaatcgaaaacttcatgatcaaagtcagctctaccctttcttgttccaaaggaatagaggctaataacccttattaaaaatctctaagacttttctaaggcttgtaggcatttcctctggcatcagaaagacctgcttgaattatgacagggcaacgagaagggctgcctccaggcagccaggcgcctgcctgcatgttggactgcccacctcagccagagggtaggtttgaggacgatttgaatagcaaaggaggacaagggggcacaggtgacccctaccaagtgcatctttcctaggtgacccctctgcaataaattttttcaaaagacagtgttttgatatgatcattagttaatgcaaagatagagcaaatgatgtgaagtaagtgtcaagcgtattccacaatggaaatattagggattggatcatgagacctggagaaaagtagcaaggagtggcaccttcctgtgcctgatgtacagagattcaggccccaccctcagatgcaagaacctagtgtgtgtgtgtgtttctctctccctctctccccacaaatgaagacaacaggcagtacaataccgggtttctaagtgagttgtttctccaatcaaacaaaaggcatccttccaaacaaaaggcaaaaagcagcaaagctcagccagtcagccgggacctcctgctatgaactatgtaacaacttccgtttctgaaaaactgtacaattgtagcattaggatacttgtaaaaatcacacatcataggtgaccaataaacatttgctgagcagatggaagcctgtgttcttggaggacttactatgcactaggtactatgctcagtactttacatgcaccctcccatttaatctcagcaacattatgaaatagttggtgctatctccatctttcagatcagaaaacagactcggagtgttagaaagactttgtttgaggtcacaccgacagcagatgtcatagtctgtgattctcaaactggtgtcttagcctttgggctagtaccccttccagtgtacacaaggttagtactgccatttgtcactcccaggcaccctgcccttccaatctgtgactgcccaattcccatggcctgggtttgggctttaacttcaggtatctacctgatccacctctgtgactaagaatcagacttctctgagtaatacggagccatccgaatagttgcaggaagatgccttttttaaaacatcaacttccctctgtgctctccaccctgccctttattgctgcctttttaaaaacaacctcatccccagatgttttgccaaaggtagttgtggagtaggtgcttacaagtgtctgtttgaactcctaatttcttcaagctcttcaacttgttagtgcacccttggggcagggtgacagatagacatcttctaagatgttgggcttaatttgggaggaaagggtagcacaagcgagggaaagctgagaaaatagttcccatttccttttattggacaggccatatggagaagggaattgaatattatttattgtaaagtgatatggaaaaaacagttgatcagactggactctagctaattctgtcctaatttatccataaacccagcactctgaccccctaactccagtgggctcactccactgcactctacttctcaataataatttaatccaagtggtcattgacagggaggtctgtttagaaagtcatcttgtcactcaatttgccttttaatgtttacagttagacaaagtaacagcagtgtctataaagaaaatgtggctgggcacgatggctcacacctgtaatcccagcactttgggaggccaaggcaggcagatcacttgaggtcaggagtttgagagcagcctggccaacatggtgaaatcccgtctttactaaaaatacaaaaattagctaggcattggggtgtgcacctgtagtctcagctactcaggaggctgaagcaggagaatcacctgaacctgggaggcagaggttgcagtgagctaacatctcatgccactgcactccagcctgggcaacagagtgagacttggtctccaaaaaaaaaaaaaaaaaaaaaaaaaacaacgtggccccctttggtggaaatggaagcttaggcatgttgtccttcaggatccctggccagttctccgccttgttctcttcccatcattgtttgctaggatgtagagcaatcttaccaaaatgagtggttcattaagtatatttttagactctagcctataatggacatatttttttcttccatagattattctgtagcaagttgtggagatggatagaaaaaatccccctaaactatgtcttggttcagatattagctcaagaattgctatgcccagggagtctaggaacctataattggggttgataccacttgaccaaactgacccagacgtcagtcacttttattgtttttacttgctttcagccacaataataacaccccagacacttggtacattgatttttctgccatttgttgtggtttcctttggtagcaggtgtcagacaagatctgtcttaggtatccatagagattagatataaatataggtatagatatagatacacacacacacacacacacacacacacacacacacattatataaagggattgcttttttcaaacaagcaaagccttccatgagcaggcaaaatccctagaccctactgtgtcctgctgtcttttagaaagtaagggtgggggtcagccagtagaaagagtgtgggctttggagtcccatagcaatggactcaagtctcacttgtgtgtgtgtgaccttggagaagacaacatctcacaacagtccccagagtgtgatgttccccttcctgttgtggggtggggggaggggggagagatagcattgggagatatacctaatgctagatgacgagttagtgggttgcagtgcaccagcatgtcacatgtatacatatgtaactaacctgcacattgtgcacatgtaccctaaaacttaaagtataataataataattaaaaaaagacaacatctcagttttctcttctttccaagagaaaaattccctgcttgatgctgtgaaaagtgaggttttcatgagtcgatgtcctcctgtagctgccatcctccttattcttcttcttacattcttattgttactattattagtgacagtcatgttttatgaaaaacttctttgtgtgatagttttcatctggtattctcccaaggaggccactcccctatttttgcagcttggttttccaagttctgagttaaagcagtgtttgcccctgctccagagctctcagctctgttccttccacaccagaagtgggagtgggagggagcagggcagacgcctgagaagtgagtcttctgatctcccttctactggtgctggctgttataaggagcattataaggagggcctcgttctaagaagaaaggtcagaaaaagaaccaaatgtttacagcaaataataaaaagttattttgaatatttttctctaaataaagtggaaagtatgaaactgtgtttattttttaaataaatttaggttatatttgcaattgtactctaattttccaaagaaacaaatggggtaaggggccaggagtttagtgtttctgataagatgataaaatagcacaatatgaaatccttcactttatattttgatttttctcagaatgaccacaaaaagggtaaaatatagtaaagagtttgatcaattttcctagggtacttttcttagtcctttgctgttgaaattattctctttggaagtacagctcatgttttatttgtagcaggtattttttcatctttctgcctctgacagattctaatgtgccaatggcttcctgtgcgattggagctgtttaacgttactttcatggacttcatgaaatcttgcctctttgtcaagattttcaattgactttataatctatttgccttgtacctgtattgcattgctcaatatttacagtattaggcaaacagaaagatattgaccaaagatgtaggtctaatagcaagagtactaattagttagagatgttggagtagggactaagttttaactaggagtagaggttatgatgatttgtggccttatatgcagctgtggggatttgaatattgacagtatctgaatatggaggccacttctgtactcaacatgtatttactgactcaacagaggttagccgccccttgcttcattgtctgtatctgcagaatgagcatcatgatgttacctgaaagggatcccaatccagaccccaagagagggttcttggacctcatacaagaaagaattcatggaaagtccacagagtaaactgaaaacaagtttattaagaacataaagcaataaaagaatgggtgttccataggcagagcagcctcgagggctgctggttacccatttttatcgttatttcttgatgatatgctaaacaatgggtggattattcatgcctctcctttttagaccgtatagggtatcttcctgacgttgccatggcatttgtaaactgtcatggcactggtgggagtgtagcagtgaggatgatcagagtttactctcatcaccatcttggttttggtggttttagccagcttctttactgcatcctgtttatcagcaagatctttatgacctgtatcttgtgctgacctcctaactcatcctgtgacacagaatgccttaaccgtctgggaatgcagcccaataggtctcagcctcattttacccagcccctattcaagatggagttgctctggttcaaacacctctaacatttcccccgtcccttttataagaaaacccttaatcctaagggttgcagagggataaagatgcatcttctgtaacttcttcaagctgataggggcaatgccattcctgcctaactattgggtctcttgcattcagggtagatagagaggagctcagtcagaaagcattggtatggcaagggccgttcatgactccgagttctgacaaaagatgatatctagaagattaaaaagtgctcagtgtaagaaaacatttagtaagcttgtccagcatttctacacaaagagtacaatagcaacgtattccaaaacagtaaaacaaaataagtaaaattatcccaagtaaactaaataaggcgttccatgaactgggcaactattggaaccaagctgatatgaggttgctagctgattccaatacatgcccagaattagaatattgatccagatttttacattacccatccctgttgtttcttctgagcagcagtcaagagatcactggttggttcacaggaataaacagggttggcctaaattacagaaaaaaaccttaaaatcaactgatgagactagaacttaataacaggttataccacagttcttgaaacataattgttctctagtttcccatttttgctggagacaaatcatagtaagactaatttgctttattatacttggcctgattatttgtatacagtgcagcaagaataattatttttcacataggcttttaaatttgtctttgatgaaattttgttccatagagggaatctcagataagacttttttttaaagccaagcctagccatgggtttgtaccccagatatctatgagttgagtaaattcttctcctcttgaggtcccaaaataacttggggctcctgggcctttcagaaggtgacattctttacttaccacaggtcaggaaccctgtacagggactgtgtagacaaggtatgaggctagtttttttcaaggggctcttcttggctctctaagtcaagtttgattccttaaaggtaaacacaccattccagtcaaagccttggtaaaataaccagtttctccagttgtatcctattacaatagaaaagagattcttactgcatttatgcaaataactatattgccataagttaagatactctcaaatagtttccaaattctggaggaaccaggtagagagaaacaaatattctctaaattttttcgcagaagtatagtttactcaattgttaaaagctgtaaatagctcaaaagaaaaattttcttggccctggaaaacaaaaaggatcagcaatgttttaagcaaaaaagtaaaagaaaaatattacttcagttttttattagttcagttcatgcagttgactcctattctgcttgaacagaactcctgttctgtcatgaacatttcagctctctgtgagagtcctgaaactttcttcctctattctaatgtcacaatctccaacattatcagaaatctgcattcaatagcactgtcagagttctatagttgattataaaccatctcttgaagaagattaaaacaagacaacagttgtctgtggatgataaaaagtcttaggacagccactattaaagccacaattgataaagaaatttggttacttctgtggcatccaaatcttacataacaattataactattaataacatacagtaagccatgttagaattataggacttcttataattttggaacacataccaatagcacaactatataaatatatcccaaagaaagccaaacactgtttcacatttgataatgcttcctgttatgatttttataccaaataagccaagttttacctttgcattagtgtactattaatgttaaatccaattcttaataaaaccttatagacaaatgtattcagtcttaatcagtttgaccacgaggtaagattttcataaaccttgtataaccctttacatttttttgtgaaagagcagatcagtgttctaagaaaaacctgttgtgcttttattccagtgtttaatttacagaaaaactgaatactacctctttaactttagtcaatgtccacacacagaatttcttttaccattaatttttttacaaaccttccacaagtcattcaaacttttagctttatcctaacttaaaacaatcctttaaccctttaatctaggcagaaaaaatccaccttccaaaatatattctacttttcttacacaccttgagtgtagaactgtttccttggtggtctcaaatacatgttacagtgttaactcttagcaacttttacttttggtaaaaaccttggtaagtaagggattttaattatgtactaggtgccgagcctaggacaccataaggtctgactgtttccagcataactagagggcatgactctccatatgtccccaggccttatctagagtctaatgctgcaaaataggtaagctgaacaattttcaaaaatcaaagaagcagtttatgaccttaaaatatttagcaaagctaatatctgacttgcataatttagaccaaatgtttacatttttgaaggtatttttattttatcaataatctttaaaactatctttatttcccaaagattactaaagtcacctgaactaaaagacattacactttttacttttctgacaatatttgatttaagcacctattatttttaagccaatgaatcaaagctcttttatattacacatacaacacatataaatacacagacaggcagaagataaaagactcattccctaaaccaggaattgaaccctgaacccatgctgccatggtgaaaagagaaagcacagtcacatggttacaaggtcaagtttccaaggacatacaagacaatagggaaatgtcatccagttcttttttcttttttcagggatgtgcagcaaagtttttaactgaccagtttgttgcgccttcttgaacagtggttttatgggagtcctaggctcgcactgtatcttagagtacccctcttttatgacagaacaatacagaaagacacacacagcacaccagattcactacagtttaagactagcctcacaaatcctttttcccatttatcaaaactttacagaggattttttacctaacagaggataaatcctttacagagaatttttacctaaacagtgatttttaccattcattcaacccattgggagcgagggggagagaaagaaagagaggaaaaaggagagagagagagaaaggggggctggggagagagagaaaaagaggctagaagtctgactggtaagaaatgtttacccttttattggcatcccaggcttctgggttccctttccctgagcagccgtagtgaccgggctggctggaccacagccctgggagccaagccgcaacacaaaggaaaatgattttccattctggccagagcaaaatacatgtgacaaaacacagacattagcccctttgcttagcgcccagtatcaaactggcaaggctcatacttgcccccccattgggtcccatcattgttaatccaacctctgaccaggagtttcaacttgttgcctctgggcaagatggtggccctgggtaacagaaaagataagaaaggtaaaggagagagagcaaagcactgcctgtggcagggtggggaaagtgaagagctcagggaggccagaaaaagactcacctattgcagtgaaactaaaaagttcaggtggccacttgtcggtagtgaagggatgttttctggcagtcccatcagctctcaagtttccctttttcgggggaggaaaaagctccccatgtcctgtggtcctgtacatgccttatcctgtcacccatagcccttagcaacaagtgcaagacagattaatccaaagagaatagtagttaacattccatagtgccaaacccgttcttagctgagagggactttactgagaggagcctctaaccccctaaatcctaggaatgactctaaccttcctgagttgagccttgaacccaagtttgatcaagcatctttgcctttcattaataggagcctttagcccactctgccttaggagagactcttaactcccctaagttgggcctctaacccagtcccatcctttacccaggtagatgcaccccacttacccaaagtcagtcaactggtgcatgcagatgattttcctttgggttgggggtctcttcagtatcatccacctgggattcaccagaaagatgttactggaaacgggtcctgatccagaccccaggagagggttcttggatctcatgtaagaaggaattcagggcaagtttataaagtgaaaacaagtttattaggaaagtaaagggatcaagaatggctacactgtaggcagagcatccttgagggctgctggttgcccatttttatgttttttttttttttaattataggctaaacaaggggtggatgattcatgcctcccctttttagaccaatagggtaacttcttgacattgccgtgacatttctatactgtcatggcattggtgggagtatagcagtgaagacgaccagaggtcacactcatcgccactttggttttggtgggttttagccggcttctttactgcaacctgttgtatcagcaaggtctttatgacttgttgtatcttatgccgacctactatctcatcctgtgacttagaatgccttaactttctgggaatgcagcccaacaggtcttagcctcattttctccagcctctaaagatggaattgctctggttcaaatgcttctggcaatgacattcagatcagcaaggatacagagttgtctgttatgacccaatgtagactaggttaaaactcattgtagtactagtataatctaagacattgctgtccagaagaactttccacaatgatataaatgtccaaaagtgtagtcactaaccagaggtagctgtggaacccttgaaatgtgacttgtgcaactaaggaactgaatttttagttgcattaattttaattaagttgaaattaaatttaaatttacataaggctggtggctaccatattagaaacacagttctatgagattgcttccatgatgctatctcctgacaatggagaaagcttatcaagactccctccaggaccaaggtagtttccctgaggccaagagcttcttcaaatagcaaagctgtgaacaggttactcaagtaattcatctgatccctttgtataaccaggagaagctctgctgttcaccagagcagccaactcttttataagaggtgctagcagggcttttaattttctgttgattctgcacagtcactgtctagtaataaaggacggaccattctgaccaactcactgctgcccttttgtgcctaaccaaaaccacccctgtggataggcaaatgtcccagaaaacatcagccccgtggtggcctggagctaggcggaatttagctcagagtaaagatatgttacaaattaaatgttgcagttggtatgtaaagctgtaataaatagaaactgagttacatcaaggacggaattaaaccttaagtttaaactccacagcactgtaattaaaacttagcctgtagcaaatcattcacttgagattaaagtagtgtgggggaagcagaggtttgggcttaccttgctttctacaatttataagtctgagctaccaaaagctaacggccctgcccccaaatccagctcccaattaaaaacacagtttgaaaacctttaggaggcctgaggggcccctttaacagaagtctgccccttcccccctgcctcagtctatgaacaaattaaaaaatattacctggtcccctgatggtcctctgagctgacacggtgttttcattaatacatcattagagtaatgacattgtgctggcgttttgctttcaaaacagcctgcacttcaaccgccaatacaggcttgggggcttctgagcactttgttcctgggaaatattattcaggtcatataaagaaaaaaaaaaaggaagacaaactgtaattcatcattttttaatgcaattttattccaatctggatcattcaagactcgttcagtcttttatttttgttagttttgcaaagtaaacaccggggttatcttaaccgtggccttaaagcctagaaccagcaggcttttgcaattgcctgaaaacaattgctttccaaaaaaataagtttgtctaaggttggaagtgtgtcattctgtttaaaagcagtgtgatggcccgaagttgaagctgtttttttgtttttgttttttttttaattttctagactgtgaattgttacctcatagacaataatggatttattttggtgtctgaagactacacacaggtgagtgaaaattttctaccagctccaagtaaggatctcagaatgtgcttgggtcagggggaacaaattatggtgttaaaacttggagacaatgatctttatttaggaggtaatagcaggagattataaaaccttatttccatccctctaagaatgccacagtctgcttctcagcaggccccaaagagtttttacctcccactggggggtgcaggggggtgacagtgcccagggtctgttctctcactcataaaatgttcaatttatagaactcttagccaaagagttgtctgtgccacataaagaacttttgcctcgagggtggggtgccttaaatagtttgggcaactttaaggtttttttccttccgatatttcatcttcatatgtgtgcacacacatacacgtatgtttctacataattattgtttatggctttcgttctggtttttgctttttaaaaatcagttatctgagttcaaggattaacagcttgggctctcaacaccgagggacaagggtccagagatagaagaggaatattcttcatttgactgcaccatgtgcagtgtaggggtgggagggagagagatgaaaagaaaccaagctgtggacttgagcacagaaatctccactctgcctggaaatcaaaataagagttaaagtcgatggtactgtaatagaaaaacgagtttttccattcaaattttctgcattaaaacttttcctgcaattagaaattacattaacgtataaaaaaaggtaaaatacaaacaagttcaacagtgcatataataaagtaacgccatcacaggaggaaggtggtttctgatgttagctctcttccttaactagttttgggatcatcagcaagttccttaacttgtctagacctctagataggctctgtgcaatgaggatggttgacgatataaggtttcttctaattcaaatatttgagtatactaatacattataatgaagtctcttttaaatcatttaaaattctttagtagtcagcagtatgataggttcactgcttaatcaattagttaattgtccttaagtgtggcttcttagggtctgaaatgaatggtttggtaatttataaacaggggctccaggaaacttgaggaattgtgctttcatttcctgtcttattttatgagaatgttgtaggattttcagtgccccttggttgcgctattgagactcaaaatgcccattcccagtctcctctgatgctttacatcactagacatgggacagtccgtggacattagataggatgaatgggcccatgaaacaaggccagtccctgagacagcaggaaagtcctttggcctatagttatatgccctgttggctgggaggaggaacataggcattcaagaatctatggagcaagaatacacattagttgcctagagggaggagctctagtcttctgctctactcatgtaggggtgagagaggaatgatcccggggctcaggaagggtgcagtggatgtcttccgggggtgagtcctggagcagccaacaaatgatggaaacagtgtctctgtttcagccatgagcagccatggccactacagattctctgctctatgtctccatggaataagcctgcgatagacccagtgagtttgccagcctgctcagcctgggcttgtttgatgttgtctgacttcctgtgccccaattaggataattcttcatctaacaaccagtttcattgaaactggcacattacacacacgaaatacaaatgtccttcttgctcctagcagtagtacacgcccacagagtttgcaaaagtttccaagtttccctgtagtgaaaaaggaagtggtcaatattcagtcagagaaatgttgtttccttcttcctccttttctccccctttacattttgccaaagtttatatatgtgtcttgctacctgaaaactcccaggagtgtggttgaggtcactcagttagttgcaatggaattggggtttagttaatacaaagcctacggaatatacataatttggattcttattgcagtgccctccacccacccacccacccactcacaagctacaaatcttcagagcacccagagtagagatggggcttctcttctggtcaacactggctcatttcagcatgttggcagaaggcccttactgcaggctctgttccatgcactgcgtacgccctcccccatgggacaccttgcatgatagtagctccagaaattcagagggcatgcatgaggatgttaattcttcattccaccaaagtttgcaaatcttggccagcaccaagaagtagacttacaaaaacatcagcctggtggtggggaatgactgcaaagcttcgaatgaccttaagacagcctcaggtgtggggtaggccattagaagtctcattggccatgctgtctcctcaaggggctggatagtcttactcttggtcaacatgtcaactgcctatgacaaaatgaaagtgatcctcagaaagtgattctgagaaagggtggattctcaactgcaggaactttattgggctgatgaagtggactgctgtatttccctaaacaggtcgtccaggaattataaacaattctttttattagtgcttaggaagccctctcatagtctgtttctgcctatatgaagtagtgttttaatcacacgggattatgtgcatattactacctactccatccaagggtagtggggtatgtgtgtgtgcacatgtgtgtgcatgcgtgttttaatttcagcattcagcatgggttacgcagccccctcccacgtactgtggaagcattcacatctgctctctagtttgctgtgtaatcccatgagttctcatgactgttaaaaccttttccactttcctgaaaacctgccttttgctcctgtcagttccaggacacagactgtgtcccttttcatttcttctctcctgtttgggcacattatttatctacacctcctcatatgtcttcttccccatagactggagacttttttggtgagatcgagggagctgtgatgaacaaattgctaacaatgggctcctttaaaaggtaagggttttatggtccactgcattccccccaaaagttttcctaaataaaataaaacaagccaaggtcaaataaagcaagcccagacttgaccctgtggctggtttttacttgtgttcatgctccaaaagatctctctgaaattcgatgcctcttgcacgagtgttagagtgttagagtcttagaaactcagttcacaatgagtttcctgttcacccagcagagcatttattggaggccagtattgaagtaggaggctgcactgtgatgtgattatgtcagtctgaagcaagtcactgcgaagaagtaggaaaggttttcacctggccggaagggtggagtgtattttgtctcctattgattaacctgggaagctccctagaaatctggaacttggggatgaaaggtggtatttagagacttcttgatgttgttttagaaaatcaagtgaaaattctcaaaatccgctcttgatggaggtaagtttaagtctgcttctggaagaaaacctagatggtgccaaattccacaggtggcagatactgactactcatccaggtgtaagaactctcgctgatcctgaataaagcttgtgtagagcagcttccttatggccccatgtccctcatgggcaggccagccatgctcttgggaatacctaaacttctgggaaaagccatcatcccatgagatcgggtgttagaatgcctccctgggggtccatgctgtctcccttcccttggcctcccaggaagaatgttagcctttcaagtggtgctttaatgggcatatttgatgctgttaaatatataatggcaggaaatgcaaggatggccctccagcttccctgagagatccattgcacatcggtggccagtgggtaggcaggcccctggtttattactcttctgcggctgaatggctaggaagtgttagctcaggaaatcagacttttaagctagtcaacaagaccaactgagcactttgctgaaagcagggaattcaaaaatgatgacccagtgtttgaaattccatagcttgtttgtgccagaagggaagaaaaaaaaaagaaatgatataagaacctggcctagtgccagcacttctgcaatctctgacatacttgcttgctctcaggcctgcctgtagcagatcgtcccctcctgctcccttcccttctaaaaaaaattcaagtacagttttcttctttgctgggagtcattgtacacatgcttgaaaactctgcttggatctgggctggagtggctgtggagttttccaccacttcttcaagcttcctgcagcagctcctggcctgccatccacggcaccactgacttttcctatctttatgtggatgtgtgcatttgtatcatgttaacttcttttcaacttggtggggggaggagacaaaagatgaggaataatcgcacacgtgtttctcatttgaaagcacatttttcaacttctttaacaaacctattttttcctctccctcttggatattcctttcaaactgtttggtgggagaaagagaaagggtgtaatggaattttgaacctctagtcttctccttcatgtgggtgaagtacagttggcatgaatctagaacttccttttactacaagagtagccaacatatttgagaaaaaggaagggctgggaactcagttattacagcaactgctgtcatccaggagcaagttgacaaacctcctgggcttctttgacgggcctcctcactggggccagtagagcattgagagtttgatttttggagtcagacagactggggtcaaatctaggctctgacattaccagctgcttgatttagtcagattacctctccaaacactggtttctctacatggaaaatgaagatgacaataattacttccaagggttgctgtcagagctagtgagatcatagtaagcataaagttcttagcacagaacttggcatgtatgaagagctcaattagttgtgagctgcagccatgatttttgttgtcgatctttgttctgtcttgaatttgctttccacttagcaccaggtattgcttcatctacatttacacgtctccctacaggcttcctatgacaccatatgatgggtctctggtgttggaggaccacagtccttgcaatcacacatttgtgcccttgcctttcccagcatgcagtgcttgctcagagcataaggttgacactcctgtcattcagagaagatctatagttcagaagcagtgaaaggatatagttggctgtaactgacagcactctggatcagaagtcatgcaccatattgaattgagcccaccctcaaacatgggttacatgaagctgcgttgctctggtgctgtggttagcccaggtgaaactcgagatcagtttactgtgctgacccctcatctcagcatcttggacagcaccgggctggccctcagtttctttatctgatagtcttatacccagtcctaaagaaacaaatttcagaccgggtgcagtggctcacgcctgtaatcccagcactttgggaggcagagatgggtgggtcacttgaggtcaggagttcaagaccagcctggccaacaaggtgaaacgctgtctctactaaagatacaaaaattagctgggcatggtggtgtgtgcccataatcctagctaattgggaggctgaggcaggagaattgcttgaacctgggaggcggagattgcgataagccgaggtcatgctacggcacttcagcctgggtgacagagcgagactccatctcaaacaaaaaaaagaaagaaagaaagaaacaagtttcatgcacaagaactccacaaaccatcttctccagaaagacagagctccaagaggagagcactacctcccttcatagcctcccctttgtttctctgtcttggtcattttgctgcctctctccagggaagcaaggtgatgcttgtctgggtgacagcagacctctcccctgaccattctgaccactcacctcgtgacccattggctgttctacctgacagtgccatcagagggaaagaacatccacttctgggtctgtagtgcaggcagaaggaaaaccactgatttatgtgaacaaattaacaacttgaaagaattttgagaaagtctcacagcagcgtgtgaaacaatctaagaggcaaaattgaccactcttgggcactttagttgactctttgacctgactctagccagcttacatatgacctagtatccaggatccaactcacagaccaataggttcagcagcatgacagtaataatcatggctgcgttcgctgagcacccaccagactccaggcttggcttgtccttgacagatcttacctctttgcaggctttccagtaactctgagacaggcataaataggaccagttgcacaatttgcagggcccagtgcaaaataaaaatgtggggccctgtgttcaaaaagtgtcgagtatttttttttttttttttgagacagagtctcgcttgttgcccaggctggagtgcagtggtacaatctcagctcactgcaaccaccgccttctgggttcaagcgattcttctgcctcatcctcccgagtagctgggactacaggtgcacaccaccatgcccagctaatttttgtatttttagtagagacggggtttcaccatgttggctaggctggtcttggactcctgacctcaggtgatccccccaacttggcctcccaaagtgctaggattacaggtgtgagtcatcatgcccggcctcttgcaactatgaagagaaaatctagtctcaaaatcctttcattagaatttgtttacccctggtaatgcaaattcaatgttgtcatgtatctagggaaaagggagaaaatacagcctgtcataggagtcttcttctttcaaggttcctgacggggcctttgtgatactctggacttgaaataagaagacttcaggttgagcacaagattctccactgtgtggccatggacggtgtcgtcagcctctctgagcctgtttcttcattaccaaaatagggatctcaatggattttctgagaattaactaaaatacaatatgttaaaatgcttttcaaattgcaaagccattgcaaacaggagataagaataccttttgagtagagttccatatgtctgagttcttcttattttccaattttctcctgttttgttttgtttgtttgtcttattttatcactaataacccccaaaggatagttactacatagcagttacctttacagcacagtgttggggtgattcatggacctgaactctcttgtgcgttagcatccctggggacctttaaaaacactccaagttcaagctgcagcccaagaaatcgtatattaagttgatttggggatgttgcccaggcacttgtgctctttaaaagcttctctgtgattctcatgtgcagccagcatcaagacacgaggttaaaagcatggtagcagtctagctactacgctcttaggagtcacctgatctttgcagcaaaataggatgaaaataattattcatatacctacaagtgagggatatatggaatgatatgtgagtaactgaggtgtccccagcttaaaggtacatacatgcctacagcccaccctcctgagtgtgggcactcagcttccttcctggatgtctcccattgtgaccacaggggagatccctgcaggacacaatcagctggcacaaatgaatcatatcacaaagtgagagctcctggcggtcctctctgatccacaacttctacctttctctgtttcctctgttctttctcctctttttagacttctaagcaatgtctgaatccgtctcttcctagagggaagagcccccagcccatctttttgaggtcagcttcttggattatcttcttgtccctgcatcctccccttagggtgtgatgggaggggcccccaccttcagtgtcttgatggtgcttgtgttagtcggttctcacactgctataaagaaatacctgaacaacaagaaaaaaaaaaaaaagaaaaaagcagtacctgagactgggtaatttacaaagaaaagaggtttaattgactcacagttccacaggctgtacaggaagcatggctggggaggcctcaggagacttacaaccatcacggatggtgaaggagaagcaggcatgtcttcacatggctgaagcaggaggaagagggaggaggagatgtgctaaacaccttaaaacaacgagatctcgtgagcactcactcactatcacaagagcagtaccaaggggggaaatctgcccccatgatgcaatcacttccatctgcccccatgatccaatctcggccccacctccagcattggggattatagttcaacatgaaatttgggtgaggacacagatccaaaccatattagcactttactctcctagaggcccctggggggcactggaactactgatgctagggcaaaacactaagcacatagacagcaaggataacactctgggttaatctcaggtagggcaccttgctccagcaaaatatctagcagattgctagtaagacatgaaaaagcaaaggctcttccacccttttccaattcctctcctcccttccccttgtaagtaatgtaatacatcttgcctgagttctgcggagctgggcaccaacctggacatgaagtgccatttgttacatgagaagcacaaatatgacttttaggacatttgagccagggagaccgaagggaaagttgaaatgagttcaatatggagcccaaggaaagagcaagagccttcaaaaaacaggtaaagaaagaaatctttactgaaggatgaaaatgtggctgttatcaaatatccagaacttgagggtttgccctgggttttttgcttttaccaacatacttgtgatttctggaaagaccaaaggctcttcccttgttctttgtctatctgattatgctggaggccagaaagaccaatggagcacacctggcccttggcttgccaggaaatggactgctctcgtcgagccaccagtagtacctatctttcatggccattgtcttatctgtctctctctctctctttttttttttttttttggttgcaactgctagtgtgtgtgtgtgtgtgtgtgtgtgtgtgtgtgtgttttgtgtgtgtgtgtggttttgcgtggtttttgttgtttgtatttctgctgtgcttggtgcaacacgcttgagcttttacctgtccaaggccattcatattttccctatgggatctggcaaatgtccttgtcgctgcaccccacaagtgttcattaacatggctggcttgtgtggaattccctgtggcagcttctgctatttaaatcacctttctaaaaggtgacacatccaggtagaatccaagatctgtatcatttctactcctgtctctgtgtggtgggacttgggagctttccctgtctttggtaatcacattacacttcagcgagtgccctggccttggagtgtagagagtgttaaaggagaattctgttatgtttggatggctgctcgcctttaatgccgactgccccgctgatgtctaatactcaacaactcatgtaatgagtgtaatggcttcgtggcttcctgctgacctgaccatgtcctcagaattatgctttgtcagaggtggcattgaagggaacaaggagacagattggtttggacaagtatatttctgggccaaactttctggaaggcagagacatggagcttccaatgaaccactctttaaaatccaaaagctgctgcttgagcatccccagttacagcaataacagtaactgccctcatcttcatcatcatgcagtctgtctcacttattaaatactaactataggcaaggcattattccaggcagttaacatgcattaccttaattaattcccatcacaattccatgaagtaactactattattatttccatttgacaaacaagggactagaagtggaggctcccagcaacttgtcaagctctctcacaggcatgagtgagaagacagaatttgaactcatgtctctcagattccagagcatgttctcctgataaccattcatgtcttctccatagttggagcagactagcatatcttctgcagagtttttctttttacattcatatttgctctgccttaagagatagagaaagaaagtctttctttttatttatttatttattttttcttgagatggagtttcgctcttgtcacccaggctggagtgcaatggtgcaatcttggcttactgcaacctctgcctcccggattcaagcgattttcctgcctctacctcctgagtagctgggattacaggcgcccgccaccatgcccagttaatttctgtatttttagtagagacagggtttcgccatgttggtcaggctggtcttgaactcctgacctcaggtgatccaactgcctcagcctcccaaagtgctgggattacaggtgtgagccactgcacctggccaaagaaagttttttaatcaaacttagagtccaatgtattagttagaattggtccagccacaaataacaggaaaatccaaattaacagggacgacttaaagaacataagaggtcttttttcatctcttatggtaaggaagtctaaaaatactaatttgggaccctcacgttacagacccaggaccacaactttttcttctacctttctccaagatggcttttaagttcaaggttacctcatgattcaatgtagctgctgagccccagccatcatatctgcaattcaggcttgcaaaagaagagttcagggagttccaaaagctccaaaaggccaagtttcaaattactttttaataaatgctttaaataagatttttaatgtattaagcagcctcccatacaatacttgtgcttaatcacttggccttacctcactacaaaggaacctgggaaatgtgcatattaaaaagtcagagttctgctcaccagaagaggagaatagttattgtgaaactactgatagtttctaccacatccagcatgccccagtttgcttcaaactatatgagtcctctggcttcctctgataacccctttggaactccttgagtgatggggctgtattcataactcttctcctagtcttccctccccacagcatgcccaatgcggtcctgaacacagattgtcatagccaccttctaaccacctgtccgtgtgcctgcctgaccccagacaatggaagtaggaacattcaataacacctgttgggttttatgaataataatcataacagcagcaataccaacactcagaggtactaacatttattaagcctcaatgacatgccccacactgccaagtgcagtacaggcatcattgtggtgcagttgctatgaaatatggacctggcttcacgaatgtggcagagcccaaggacgcttccccagaatcagctctcctgcttcaaatgggttttgcattaactcattcccaaagcagaattcagctttttccttctaaggagacaaaagaaatttaatattttctatattgaattaattgtgattccattttccccttcagtttcataagtgaagctaatttccatgggaggggctgcgtgaatgggcaaaccagctggcagctaggtgcatttactgggcacccatgaatttgatcacttgccccaggagcaaagcaaatgcggttggtagagcaacatccgctctgagtggggacagggactgtcttgatgcttgaagtttgttggtctccccagggccaccttctttcagaggaccctctcttcttggctctggggcactcacacttgtttatcaaatcagtgctgctctccaggacaatgggaaactgtttatccttgaggtttgcaggtggcacctcctatttggtgagtcaaggaagtacccctgaatgtgtccagactggtactaagccctgggaggatgcgtctgggttttaaagtggaaccaacccaaatgcccatcaatgatagactagataaagaaaatgtggcacatatacaccatggaatactatgcagccatataaaaggatcagttcgtgtcctttgcagggacatggatgaagctggaaaccatcattctcagcaaactaacacaagaacagaaaaccaaacaccacgtgttctcactcataattgggagttgaacaatgagaacacatggacacagggaggggaacatcacacaccggggcctgtcagggggtggaggactaggggagggatagcattaggagaaatacctaatgtagatgatgggttgatgggtgtagcaaaccaccatggcacatgtatacctaggtaacaaacctgcacattctgcacatgtatcccagaacttaaagtataacaaaacaaaaaataaaataaataaagtccagttcctgcctgcaagctacttacagttaaggtgagaggggaagaaacaacacaagaaaatgcaagtgaggtatatcacattctaaaattcatggctgtcaaacctgtttgcacattagaattccttagggagcttaaaaaatagccccaccccagactaatgaaatattgcagataggaggtgagatgctaggtatcatcatgtatataaaattactttggcccggctcagtgactgatgcctgtaatcccagcactttgggaggcctaggtgggggaagtgcttgagctcaggagttcgagaccagcttgggcaaccacatccagcacgtgaaacctcatctctacccacccccacccaaaaaaaaagaaaaaaattaactagatatggtgacatgcacctgtagtcctagctatccaggaggctgaggcaggaggatcgcttgaactgaggagttgaaggctacagtgagctatgtgccactgcactgaagcctgggtgacagaacaataccccatctcaaaagagaaaagaaaaggaaagaaaatttatttgaagttccccaggtgattccaaagggcagccaacgttgagaatcactgttttaaacaaatgccaatgtgtatgccttaggaattgagagtgagtttacatccaattttccagattcttcgatgaggcctcatcagaggcccatgagatccctaaggagcaagatatcccttgggaattcatgtttgggaagcagtttaagtgtgcagctttaaactatgagacctggactaataatccagcccctttgattactagcgtgctgataatcttggacctgtgacttcatctgtctgagacttagtttccccttatataaaatatgaccatcagagataatgtcaacactgctgacagaaagtaatcaattaattctttttttttttttttttttgagatggagtcttgctctattgcccatgcccaggctggagtgcggtggcacaaatctcagttcactgccacctccgcctcctgggttcaagcaattctcatgtcttagcctgccgagtagctgggactacaggtgcgtgccaccacgccaggctaatttgtatttttaatagagatggggttttgccatgttggccaggctagtcttgaactcctgacctcaagtgatcggcccaccttggcttctcaaagttgtgggattacaggcgtgagccaccacacctggcctttaatcaattaattcttatggttactgttcttcttacctgggtaagatgctgatgggattaatatctcagtatctacaattttgtttctctttatattatcagcacctgttgatgaaaggtgttgatttggtgccaacagaccctctgcttaatccaccaaatgagtgacgctttcttgttgctccccattcagtgttcagcagtgaaccctgggaggtcctgatagcctgtgtggtttattcttggctaatgatgggtgctcattagctaaagttggtttttgttttgttttgttttgttttgttttgttttgttttgttttgttttttgagatggagtcttgctctgtcgcccaggctggagtgcagtggcgtggtctcagctcactgaaagctccgtctccagggttcacgccattctcctgcctaagcctcccgagtagctgggactacaggcacctgctaccatgcccggctaattttttatatttttagtagagacggggtttcactattttagccaggatggtctcgatctcctgacctcatgatccgcccgccttggcctcccaaagtgctgggattacaggcgtgagccaccgcgcccggccagctaaagttgtttaactaatttccagttggagggctcaaaggcagtaggaccagggttttgtaaattcactgcctctgctgtgttagagacactgcaccaatcttaaagaacagtgccatctctgcaagaagttgctgtgggatgagatgatgactgatacgagcaggagagaagggagagcacattttgaatcttctattagcactcctatcaacaggttgagccttctactttcctggctttctgagatgtaagaatgagtaagggcttcccatggcgacggtctctttgttaagaatttcctatgttcctcccccatgccttttcaattgcaagttgaaagctgcccccagaggacacattttatagcgcaacaaagaagacatatttttacatgctaccttagtgagtcattttgcttctcagacttttcaattcggaattgcttaattatgtcccatgataggtctctatgtctaatgcctcccttgtcctgtttttagggctgtatttgcagacattaagctgtttcaagattgtttttaggccagttgtttagccaaagtgagctaatttgatgaatcattacaggaaaattacctggcctcacggtacatagtaggtgtttaataaatgttgagccccacagttgctaaccacccctaaattagccagcctaaattagctgagcttatgctgttaaaatgcagcctgctaattcttagagcaaatatttttcttggtcaggatttttgtctagttggaaaagaaagaacagtatcagcaaaatggctttaaacatgtcttaatgtcatgagtttgtcatccaaggctctacccagcatgggtgcagggctaccaggctttgtttgtattgctttgagttgtttcttcagaggccgtatctgccttctgtcaaagtttaaagtttcaaagttccaccatccatgtgggcacacagcgatgctaatgataaggttggttggagtagcctggtggtgatgtcatggggattaaggcatgttatctgtaataagaatacacccccactgctgagtgcagctgcacacagcaccagtcttgggctgggcatgattctcagagctgattttagagtcaaatgaaagcaggcaattatcatgttctttaactgtaatcagccgaacaggatacaggtagccgcaaaatggagttatttaaaacagtaacaaagtcacttcaaaaagggtaataatctggaagtctcctgctgcaatatctagttaaagctgtccaagtgtggagaagacagggaaggcttattttgtaacctcgtcaatggcaatagtatcaggaaagcctccttttgaaatagaggagtggggaacaaggggagggagagtgttaggacaaatatctaattcacatggggcttaaaacctagatgatgggttgataggtacaggaaaccaccatggcacatgtattcctatggaacaaacctgcttgttctgcgcatgtatactataacttaaagtaatatttaaaaataaataaataaataaaaggaaccttggcctgggggctgccccagagcaatttagtttagccccaacatgtaaactagagcctttgaaaatgatccaaggagaatcctgagtttcctgccatctgtcagagtggttaccatggtaagaagtattcacaagtgcagccagctgttccagtctggcctggtgactcatcagcccttcagcttgggttgaaagttgattctggacattggttatcttgggcagcattttttgtgacattccaataagaccctgggctggggaacaggtctgaagcctaagcatttcttagaatctgtcagagcctgcttctgagcagagagcaaaaggtggtggattcagcttggccccctactaaatctggctctatcaccaatgatctatgtgaacttgggcatatttatttaggctggctaagacttggttttcccctctgtaaaatggagatgattataatctatcttatagggatgtgtttagaggagtacctcgcttatggttgctaaacagagttcagtacacatcagctgttgttatcattgccttccgctaagaagcccatggacagaagttcctgcatcatcgcttggtaacaccagcacagcttctgatggtgtccttgtattgcagtagcaagcatggattttcctctgcattgtctatgccaatgagctaagaaaaccgggagccttgttcatctttcagccagctgggtaatgcctgtgtcaattcccattcctttaaacaccagcccattaattggtagtggcaatgaaaagataccaatacttataacagcagctatagctctgcctcctgttggaatacttcctctctagcaggcactgtgctgaatgcaacacatagataaccttctttaaccctatgaccaccctataaggtagtcattattctcaccatttcacagataggaaactgaggcaccaagagggttaaaaagacattgttgtaagtggatgagttaggatttgagctcaggtattactgacttcaaagatggcattttcactatgtcacattgccttctcttgagcctttgggaacagtgcagctttaagagcccgaactctaacaaagaataaaatcagtcttctgttgtaaggatcttaacaacgttggcacacttagagcatatttcagtgtacttctacacagctggttatttagatctcagaacatctctgtaattgtttaataagtcaggaaacgaagcctttgaagagtaccagcaagctgctcaagaatgcaccctggaggccgagcgcggtggctcacgcccataatcccagcattttgggaggctgaggcaggtggatcacaaggtcaggagttcgagaccagcctggccaacatagtgaaaccccatctctactaaaaatacaaaattagttgggtgtagtggcatgtgcctgtagtcccaactactcgggaggctgaagtgggagaatcgcttgaacctgggaggcagaggttgcagtgagccaagaccatgccattgcactccagcttgggtgacagagagtgagactccatatcaaaaaaaaaaaaaaaaagaatgtaccctgtatatacgacaggaccaacttttgaaaccatggccatcctgcatccatggctatgagactccaagcacatgcacattcctctcaaccccatgctgcctctcacctggctctggcacatgttttaggtgtagagacagcattgggcagtgggaaaaggataagtcaataccaattcttgccaaatgctagaaagcccttgcaggggtacctgtagaaatctcctgagtgaggatggagatggtggcctggcgggccagtcagggaccaattagagttgtccattgtggtctgcagttgattctgtgacatatcccggtgtctgggttagtgctagggctgtgtcaatggtgagagcgtttctgtgagaagtttgtgcggggacatccccaagcctaatgcttggctgatttatggtcttcgtttctgtttgtgtaaacaaagcttcaaagcttcttgcctgcatctgtgtaaggaaaaaagccagaggacagtgaagaaatattctgatgaagaaaagaccttgaggactggctacgtgaccactggtatccccttgggctttgctgcccaaggagtgctgtgtgatgctgctggttaggagctggctttgatcttccatttggtcaaatgtggctggttttctgcttggtacccacagacgactgtgtttaatccatttatcggtaatgtccgtaagttactgtccagataaggagcctccacatcacattttgcagttgaccactttgttctcatcatctgtgtaacatttgtgcaatcaggcaatcatttatgcattcacccttttaaaactgaatgccttctgtatgctgggtgctgtactaggtgctagaggtcggtgtgaaacagagccaacaccagtcctgctgcatgaagcttttacatctacaggtctttccgagcacagcagtaagtgcactcaacattaaccattgtagtattctagaaaggaattcctgtggagagaatttcatccagtcatgtagaagcacatgtattaaagtgtttaaaatctcatctggcagttgttatgtaactcaggctcgactttacatgtctctcctttgggctgctactcatggcaggaggggatgccgaagggaagggtgggaatgccagactcctttggctatacctttcaagcatgggataagatgttcataccatctaaatactggaacatgtgtaggggcaaagagggagagcttgccccatcatcccctgaaggtttgctgaaaatgaactgacaaagggcaggtgaataggaaaaaaaggcacacaaaatttattttaatatggacaacacaggggaatcatagtagaatggttacccagtaacccaatggggtacagatgcttaaatgcccgtcttcgtaggggagggaaaagggggaaatatggctacttgagggataataaatgattttgagggggaaacgagtgggcctaaatggttagtaaataatttcaatggaaattgaatgggatggagagctgacaatgatttgggaagaagttggcctgggctctaggtgtggtgtttaattttcaatctcttcctctgtaatatgaattgtaatcttctcttctctggtgaatgaaatgtcaggaaaggcaattgtattcctctttggcagatctggcttttagatagataagggaacttcagaaaacaactgcatcctgtggtttgggactgtgtggtaagggagacagggagcaaggtcggagaaactttgagactgcttcaagtcaaagcaccatattttggcgtaatggtttctgagtccgaacacatgctaccagaaattgccattcacctttcctttgttgatgggggaattaaaatacattgaataatgttaaagtaaaacatttttgcaacagagtaaaggtcataattgggatgaaagccatacttttatcgccagtgtaggaaaaaaatgtccaccttgtttttgtttcataagctatgctgttttcaaaataaggtacattcactcttatggtgatgacaataaggagtagggattacaattagtaagccagctggtttcctacactttgtcaatgtacagggcttatcctggtccaaacctgtttcctggtgcttaagaaacacagaatcctgccatgctttatcccaaagtggttcttcttagttctcctgtcccttggagacatggcccaagtaaattccatccgggtcttagaatccagttcagaacagcacattccctttggaatatcttgctcaatgcagaccatccttgttcagaccaaatgactgtttcgtcaagttagatgggtcctcatccccctctaccctttccaataccttcgttccctttgtccttcaaattccaagtggtaacatgactgtgcctccagcactggcctttgccaggctccttgttcatcatccatgttagggctgcatggtgtttgtcaccgttgcacttgatgatagtgactgctcaccttgtagtacatagcatcaattggttcccgtgttttctcatttagtgaagctcccttccatttctttcctgtagaattaccctttatgactaccaagccatgtgtagagccaacaaggaaagcagcgatggcgcccatggcctcctggatgtaagtactatgctgtcactcagaaaacagccacacatttctgtctttctccctgtctgagtgttatcttcctctttggagtaatcaagtttatctttttgcaaaatcatgaacattttgactttactcacttaaaaaaaaaaaaaaacacttcaggccgggcgcggcagctcatgcccgtaatcccagcactttgggaggccgaggtggctggatcacttggggtcaggagtttgagaccagcctggccaacatggtgaaaccctgtctctactaaaaatacaaaaattagccaggcgtggtggcgtgtgcctataatcccagctactcgggaggctgaggcgggagaaccgcttgaaccttggaggaggaggttgcagtgagccaagatcatgccactgcactccagcctgggcaacagagcgagcctgcctctcaaaaaaattaaattaaattaaattaaattaaaattaaaaaaagccactgctatatcaactgaaatccagtaattatatgaatgagaaatggatctaaagtctttgatggattaatgcagcagccccttgtgacagatggaaaaagggagaagttttgttaattctctcatttgtatataaaagaacttggttttgttcaacagaacttttccttttagtttgtaacagagttgtgagcttttgccctaattcccattttgatcacaggtattccctctcccctaatcatgccactgggtttcagcatcgttttccctggagctgattccttggtgatgtcacagacgaggatcaatcagcatagctattgtaccattagaaactggctttcagatggccagaaattaactgttaccacttactcccaaattaaaaatataatttacaatgcgtagacaatgtaaatttggccagcaatacctaaaaacacagaaaaaaaaccagacatagtgtacctctggatagtctgtcacatgtgtttaaatataacccttacaatgttattattttgtaaataccaaaaattaacctaaaattttgtttgaaacacaacacttaaaagccattttggctttaaaatgtgcatactttctaatttgcagatgtaagatgttacaaggggattatttaaaaaacagataattaacacggttctcctacactgagggagcaagaaatgattcagagctggcaaatttgtaagaggcaactaaaatgaatattttgaaaaatacagctttttagtgagactcactatgtctttctaacccaactcccctaaccttagcatgaatatttccagacattaaaggttcccaagatatattttcaccattagatttaaaagctcagtggctttacgcttttagatgataatgtgcatttaaatttttttaatcctgtatttgcataatccctttgtttactcatatattgagccaatgcctggcatggaatgcctgagtgccttcccctggcctcagagcgagctgcccctgcttctggccctctttcccccgcaacctccaaagcttccttaatccttttattcactctctccttcccctgacccacattacccacccagcagatacaaagacacaacatcgtcccatagtctgaccagcccggtctttttgaaagcaagatgattatttttcaagccgtaaaatgtaatggcaaaaccgcaggactgcaaagtgtggtttcaggaaactgttaaaagttcacatccttatctgaccctaatcctggcggcccagaacactgtgattcaaggaatgatgtggaagcactcggttgaaccagagcaagagatacaccaagtctgaaatctgggtgggctgggaagagcctcagcattgttgttgttgttgttgttgttctgctcatttactttctggccggactgggaaagttttgagaatgattgggggcatgtaaatttgttcttgtttcatttaaaactggataattcctccattctcagttctagttcttataattaaaatgctcagaaggtgggattaagcagctctagctgcagaagcaaggatttggcatgcatttcaattctccgatatctaaaggcaaccacaaaaggttctgagattcttctggacctgacatctggagcccagagcccgggatttgccagcgtcattgtctgtctctcaagttcacccaccactcacataactggcatagctaggtacaaagaaccaactgagggggagacttggtattttccagaattcaggaaattgaattatccacataggaaatatcacagagtaaacaatccaactgctttttttaattaaaatattctgaaataaagattaggctttcaatgccttcttttatagagtgaaggagattttcagcaaggataaaatcacatgtttatatggttatcattttcttcaagtccaaatatgtaagtgtgagaaaagacagcttaaatcctacataattcgtggacggcattaaaatcaggtgtatgcaatttttgcttattttagtgaatgacatacagtgatggagaacagggaatcacctttccaagaggctgccctgtaaattaccatttgaaattagttatatgattccagccccctcagcattaagcttcaaaatattagcccctagagggtaaaggtttaagcatcgggtgctgaacttcctttttcctcccactgataacccttgtattagatcaggtttattttacttgtaaatcacatctcactagagtggagttcaaagttttaaaatgtttgttttaggatacagtatccaacaattttcttcacttagctagaacgccactgttttttaacatgatatcaatctctctagaagaataacattgtccttatgtaaagccctaaattaagctacaaattttgtgtgcactacattgtttttaatgaactgaattcttctcttcagccttataatgccttcctctctgcagtaaaatggatcatgacagaacttgtcttgtaagtaaaatctgctgcatttttttgaaaagtattaatattttcctttttgtatcataaagtgatctaagagattgtgagtcatgccttcaataaccattagattcctagtactctgagataacttcattgaacatctcaaaatattgaacacagagaccaaaaaatgatcttctattaagtgactgttgatcactccttatgctattaggtcatcgtttagcagatcatttgcaatacacaacaaatttacttattgtggttactgctcaatttcacatggatgtctggctgattttactgcagcctgggtgggctgtggtcagaagagcacactgctgtgactgtccaccatgccactttggctgtcttggcctgtgcaggaatgggtgcctgtgagattgtcagctagggctgggggctttctcaggtatgatttcattgtttattctgtcaaactatggtcttgtttggaggtgctggttgcatctatgacttagataacacttgaaatggcacaaagatgaaagtcttgactttcagactagatattagacacattacagaaacaccgtgtcacacaaaagggaagaattacatagatgaacatgtaaacaagattgtttaagttgtaccaaactctctcattcttatttcccctgcttatttcctacagactccagttctgtgggtttgaggcaaatttcatgccatttgatggatagtcactgtcctcttaacttaatgtaacctatattaatttaataaagtttgtgaattcaaatgggaagtaaattctccatatacacatgaggcagagaaagaacattaacagataatagtgggattttgattgagagagagctgctaggaatagtagccataagcctgaaaaacaaatgaccaaattttgatctctcttcatccactggaggataatttatattatttttgtagtctttaccagccattgagaaatgttgatttttatgaagttccattgtgacataatttcatagagagaagtctgttccacctccctctatacacacacacacacacacacacacacacacacacacagggggcttaaacaagttcaagtcgcagtattcattttgaaagcatgttttattactacagttcatagtcttggtagaggagaatattctatttgtatttctgaactaagggaagagaagcttattagaaattggctttttactgtggaatcaaactagatgatattaagattgaacaactggtgaacaacaacgagaaaagtatttcagcctatacagcaggttattcctcatctaggaatctttgagtctaggtgaacctggctttagggataaaatagcctttcacaagaaagataaacccctgtgaaaatttagtagtaactcagccaactgtgttgatatctccaaattgtgatgttctcaaatgaggtaagcgatgccaaagaatacagaaagtcactgttctgtgatatgggcatggatgacgaagtaacattgggcttttccacgatctgtttaggttcctggtggaatttaacctctgcagttggtggcactccgatatgacagctaaaggtgagcagcaactggtttctgtttcccagcttggagggataagcgctgggttcactggctacttttcatcagggatgtgctggctcacagaaaattccccaggacaaagtgatgatttttcagctctgtcagcaaaaagccagcctttgtgctaagtgctgtgctatctagtctgacacagaattccacaggcttcattcagcccacgttgaatgtacatcttgacctgtttccttaactaaggctttgaggtcatacattgcacaggtaaattcttcagaaagctcatgggcaatgctgaaatagaagggagacagacacactgcctgtgtctcaggctaaatgaatgattagccattctatttctgttttcacagttaccctcatagaacataaatctgaccacattactatcccttctcaaatacctttgatgatttgaggagggtgtaattagtagagactcttggaggcatgggttgtggagttagaataggtttcagtcccagcttagaggttggccttgggcatatcagctgatctgtctccaaggctcagtttccctatgctaagcacaatggggaaaaataatatttatcttagcaagtgaatgtgtgtgtgtgcatgtatgtttaatgctgtgagaaatcatattacgtgctgaccacagtgactggaacataagtcctcaaaaaatagtagcaatactgcatgttctcatgtataagtaaggtaaacactgagtacacatggacacaaagaagggaacagcagacactggggcctacttgaggtggagggtgggaggagggtgaggatgaaaaaactacctatcgggtactacgttcactaccaggatgatgaaataatctgtacaccaaaccctcgagacatgcagttgacccgtataaaaaacctgcatgtaccctccacacctaaaataaaagttggaaggaaaataaataaataaaagaaagagtatccgtaattataatggtggtgacactgtgaccatgacaatgatgatgatcgcctccaaatccagtgatccttaatgaacgctggctccagcagtctgccccaggcctgcccactcatgtgctatttctcagatacactctgttctttctttccttcattcatgttcattttcctacttgggaggccagggactagtaggctattaccattcttattatttctaactgtctgtcttttaaaaaagagattgattagtcacatatcagcattgccccaggtgctggatctattttaatctaacattccctttcctttcccttaagatcccagtctgtgaggattccctcaactccctcaggcagaatgaacattttcttcttgctcctgccccagtcagctcatgcgttatcctatctcttctttaccattattgcctcactgtttgtgttttacactaacctagaatttcttgatggtaggagctgtgtcttaaacattgttctctcttaacacctaactggtgctgagcacacagtaggtgctttatctttgctgattcaatatcctaacaaatctttctggtgctaggcatgaccattagggtcactatagtcatggctttgtaacttacacataggctcgttttgccggaatccaggaactctctgatttctgcttagaacatgagatggagcagaatctgctgagttctgcccctgctgatgcccgcatagtttgctctctgataactgggagcctaatccatgcctgtccaggcttggctctgccctgggaggctgacagcccagtggagcagggcccctgtgtgctgctttcatccacacacatgcacattggtctggtgacccccaggactgggacccaattttgctcctccctgctgggttgagttctgagtgacagtgagtgccccaaatcccacttatagaaattcagcctgaggacataaacctggatgggaacaaaggtttctatgataggatgatcatcaccagggaatttataatcgcaaatactggtaactctttaaatgtctaacactaaagaccattttacaataaattacaacccatccacagaaagaaaaatgattctgtttctgaaaactttttgatgaaattaaaaaaatgctcatgaaattataacaaaacaagacaaaacccaggaaacaaaaccgtatatacacaaaaacacataaaatggtgggaggaaggagatatggagctaattagggtcagtagttggtatgggaaatagggagtcaataaacaaacaccaacatatgagttaggaaaagaagactatcatgtccccgaaaggaaatcttacctgtagtgtcaacttgcttttgttaaaattgcacatgatttgaaaaaagaaagatgaggaagaacctactaaatgcgcacttggttatcttttaccattcgcttttcttatttgactcacttttccacaattttactaataggagtgaaaaaaaatgagatttaaaaaaaataaaatcaatagagcccaggaaaatgagttgcaagttggttaaatggctgctgtctctgcggcaccagtgacctggggacaaatcccctctccctctgaatcagactgtgagctctgagaggccggagcggctttggaacctagtggttaggcaccctgggtagcctttctctgcttcttgcctgctgtgaggttctgggcaagtcacttggtctctctggactttggttccatttgtcaacagaggaaacaatagacataatatggttgtgagaggtgaattaagcaatgcgtgccaagcccttgtgcaagtactccatgcatggtgggtgggcgctcatgctttgggtggtggtggttttttttttaaccgaaatgtctggttatttcttaggagtttgcacagggctgaaggcagcaggcttgttgttttcagtggttttctttttggcattcttcttcatacctagtgaagacgctcccttctcttcatgtctgctttcactcccacttccctcatcctggccttgacctgtttcccttctttgtgacctgccaccacagacatctagtcatactgttattttggtcctatggattctagagtttttactgaatgccattcactatgatctttgcctagaacagtggttttcaaatgggggcagttttgcctcccaggggaatggctggagacatttttgctgtcatagcatgggggaggagggttcttattagaatctggtgcgtagaggccagggatgcagctaaatatcctgcaaaacacaagacagcccccataacaaagaaatatcccactcaaagtatcgataatgccactgttgagaaaccgtggcctagaccaaggggtgcagagtaggggacagtgactaagggagccaggtatggtctgtgcacccatgacgttgagagatacttgtgaaggctcccattctgcaatttcaccacccccaccccagctggaccaaaagtggtccaatttttagctgaaaggaataatatggtgcttcagttctctattttctgtcttaaggagctttgtagaaaggaccccaaatagatcatttcagcatgtcctctgactcccactgccagactgtgagacctcctttccacagactacagagagaccttgtcacataattgcatcattgatgcatggtgtgctgatacataagtgctttgccatttccagagagctggcacatagattatcttcagatctgttcaacatacctgaggggtggggactgctagaatttgccaccaagcctctctgaagcacctaagtcagacagctaagaggcagtggactcagacctaagccaagacctccctcagctaatgacgacagcgagagctgcagctactgcactggaattgtctcattccagctgacagccctctgctgggcatcaatatgactttttccattttatggatgaagaaaagaaaacaagcaaaggtgaattcgtccatctacagggttgctgtcattgggatatcttattaaatgtaaatataaatcccagacccagcgtaaggagggaaatgttccaggcaccatatgctattggcttgcaaggtttcttcattctaaatttaccattccctcaaaagataaagaccctgagctgagacatacatctttgttttagctaaaaatggaatccataattacactgtttatctgctccatttccttaatgaaggggactgtggaagcccatttctgcttgattatcacaaaggtatcattttggtgaagttacacaaagagaacagagcttgctggcacccggttgtgaacaggggtgcattcacagaaacaaaagaagaggaaggcttttcaaatggcaaatctattcaatcccaattgtctgcacataattactgtgaacccaagtcagtttttctcatcagggacatttgttgctaagggaaaattaaagaaattcagttgtgcggacgctcccttgggtgcttcattgtgagtgggtgataggtcatggtgacatcggtgtaactgggataggaggcacagcagtgtgggctccaggatgtgagggccaggctcgcatctggaccccatcactcactgcagtgtgaccttgggcacgtgtcttcgtttctgagctttagtttcttcatctgcaaaatgggacagtagcaagggcttgtttattctatggtgatgaagattctgcccatgctaagggcctggcacagggtttggcatgtagtaagtgcatagtgaagattgatggtgaaggtggtggtggtttactgtgtgagttaatgatgattgtgatgagtcactctctgtgggacccacggcaggcagtgtctgcttctggaacctcatttttcacttcttgtaaaagaaggaatcagccaaactgagctcagtgatccttgaatacctacagctttgtaagatgtgagttctgaatgcctaagagttaaaacagtatccagtatggctaggcacagtggctcacgcctgtaatcccagcactttgggaagccaaggtgggcggatcactgaggccaggagttcgagactagcctggccaacatggtgcaacccccatctctactaaaaatacaaaaaaactagccaagcatgatggcgcgtgcctgtaatcccagctacttgggaggctaaggtaggagaatcgtttgaacccaggaggcggaggttgcagtgagccgagatcacagcactgtactccagactgggtgacagagtgagactctgtctccaacagcaacaacaacaacaaaaacagtatccggtagattgcaagcagcctcagttattggtttgaaattccatagataaatagtagcaactgcacatatatgtggtgttttccatagcactctagacaaagtaagttctagccatgttatttaaattaaatgtggccatggctttacacgataattcacgtttcccaaaagcacatcaagcaatttccagccaatagtcgtgctgcaaatagacccaacggtttatcactatatcagcatggagtgccctacaattgtcaaaggaaaaagaatttcatctccagaaaggatcagagccaaatgagtctcaccattgagagtattggactcattccattgtaactgggcccagacaattagaattagagatggtgcaattatcaggcttattcaaatcacgtgtgctgcctatctcagcctgacccaaagacctttcttattttttttcattggctgaacttcacagagcagttaaacatatacatgctggagccagacagcccaaggtcaaattttggttctgccacatactcagtggatgaatttgggcaatttaccctcattctttttcctccattcaccatctgcaaaacagataacaactgttcatacctcatagtttattttttaattttgtcatgttttactattaaattaattaattcatattaagcaggacagcatctggaacgcagcaatttcttcataaatgtagctgttatgccatcattagttttttatattccatctgcatgcttgtgccgcatccacttataacctaagctattgtatacttaaatctttatttcatgtcaagggactcactttttgaaattcaaataatttaaatatgaaaagaaagttttataaactgaaaaccagaatgacttgccatacagagaaatctgttgtaaaaatcagaaccatgaaaataaaaagtgttgccaaattgtagccagatcctatgagctttgtgtctggcctcttcagcttaaaaggagaggagagcaaatgagagaaagaagtgaaaaagatagaaaggtgttagaaactccctgctatcaaacaaagatgtccttcttacaaaacagacgcactgaaaaagatttgggaagagaatgatgttcccaccacgtgcctcttctgtgttgttactgttgggcctggagcacctaaaattcaccttaccctccatctgaaaggcaagaaacaaatgtgtcgtaagggacagaggttctcacattttttggtccattttattctattttatttgtttgaaaacactactcaagagagtcattcttgtattcagcaggcatttaatgttccctccaatgagctagcatcttggggacagagggatagtgtctgaaacctggcctttctggagaatgactaccagcactgtacaatcagtgtagtcaggagtcagagaggcagccatttgcttgccttttctaccaaaaagtgatggttcaaaaagcccgactccatgaaatagcacgagtgcagcaggagtcatggtggtagtaaaaacatacacttaagcagcactcacagcgtgccagctactgtccatgtaattcatttgattctcaaacaaccacacaagcttggtactgctattcccatttagcagacgaggacactaagatgtaaaatggttaaaagcttacctgctgtcacacagcagtggcaggattcactgcctggaattggtgcttttagctactacatagctagccagcccctggcctgtggatggtaacatttgctaatgactagcatttcatgaaggctgtgtgcatgcatgtaggtgggcaaaagtgcgtgcaggcttcactctgctaagagctgtgcatgcttttgttcatttattcctcagaacgatcctgtgaggttactatagacatttccccttaatgtcagtgaccagttactgaaaattctatattctgactaaaagagctgatgacgagtctacttccttttgttttaaataacaaagattacaatgcattgtgctccaaccccaaacccccaaccaatttcctcaaaataattaaacctcaatgaaaagcctacatataagaaaccgtcatgctaggatactacaaatgcttagaatcgtttcctgatcaccccacaagtgtttggttgttactcagcagttgttttgtgtgcagtagcactgatggcttgcttagtgacagcaacatcccacatggacagtggacaaaatatctccccgtagttctgcccaccaaccagttatatttggaatgtaacatgagagtttgttcacacatagttttgttaaaatcccattgaattttggaattgaaatgtaaataagatttttttttcctacaaaaacaatagctgaaggctttgtacaaactttggtattggaaatctacaaacattctcttggggaaatgttaaccagtagacctcctgtgaagagtacctatgctactagcatccccattttacaggtgagaacagtgaggattcgctagaagtagcaaagcagggattggtactccaaacttctcttacttcagagccttcacccttaaccactatactatagtgtctatcattattgtcatcattataatgtcaaaatggcttcattagaatgctaccgttatctttgttgttgttgctattattattatcattatttgacatttacttaacactcattatgttccagttactgtactaagtactcaatatacattgttttatttacttctcacatcaacctctgatagaactttattatcctcagtttacaaataagaaaattgagacctagtgaggttttggatcttgcccactggacaatcaactgccaagcctctaccgagtgcctactatgtgctcatccacataccagggttatttagtgctttaaaattgacatgttgtattattggacagagagcttcataatagtaggatttggttcatggctgtgcttcaaagacattacgtattttactatttcatatttcaattttctttctataataaaaccatgcaattgtatcatgacctttgtctcaccctaaataatatggtataacttatattttatacatttattcagatacacatatgtgttgttgctaagtttgagtaagtctgaagtcagagacccagtgactgatgttgtcccagaaagtagaattcttgtgatgcataaatgatagctgatccagccaacacaactgttggaggaattatagcttatagagttgcttggcagatgaaatcacttgactaattagaaaataatgcattatgctgtgctagaaaaatcacagagcagcagaagcggaactgtgttctgggttgctgtgggctgccagtcacaattttgagcctgtgccttgcattctttacctttttttttcccactatccctacagcccagaaattgaaacagaccctggagccttgtgatactgaatatccagcattcgtctctgagcgcaccatcaaggagactacagggaatattgcttgtgaagactgctccaagtaagccatccccccaccctctaaccccctacacctttctgctcagcacagaactttcccagatgggtctgtgtgacttgcaggcacagttacaccaatagaaaacatggctgccctcttgcgtaaggaagtatttctatcagcttggaagaaacaccacttggctttataagatattctagacactgggaagcattcagaatgcatgaaaagacatcctgcagtataggagatttgtaggtcagtttgttcatgttttgagaaagtcttaattggtgctttcttaattgacggttggcaatttgaactgtgtgttcaagaatgtccttacgtatctttactgaaggcacaagccttcaggatttacccaaacctgataaattggaaatgtttcttggtggttgagtatgcatttccctgactgctaatgaggttgagcctcttttaatggctttattggttatttggggtttctgacctctttatttcaattggacagttcccgtctgggtgattggatctactcttactgatttgggtgttctttctctttcggatactatttctttacaatcgtatgcattgtatgtgggtcttcctattgtatggtttgactctttacagatgccttttttttttttttttttaagagatggggtcttactgtgttgcctgggctggtctcaaactcctgggctcaagcagtcctcctgtctcagcctcccaagtagctgggactacaggcacacaatgcatagaaattttctttctttctttctttctttctttctttttttaataagtctagtcatgggctgagttcccatctatatgcagatctgtttccagatcttatggtttcttaatacctatatatcaataccgtatctctttaattattatagctttataatatgacttggtatttaagagaacaagctcctttccttattcttcttctaagttttcttatttattcttggctctttactcttgcatactaattttggaactagcttgttaatttccatgaattctgatagggttttcattaaaatttctgtaagtgatagatcaatttaaagataattactattttttataataaactaagtatatgtctttagttatatgccttttctatgccttttaatacaattttataactttatatatttatacctacacaccccatagtttttcttctatcataaatagtatatacttaaaactacttttctaatttgaaataactagtatatgaacatatcactgatttctgtagattgaatattgtatccaacacactgctaaatgctctttgagatcgacttgtttgtgtatggatgctcttggactttttgcatggacagtaatatcatttgtgaaacattttctttctagtctccgtacttaattattattttctgttttgttgcactatacttctgacacatcgttaaataaaagcgatgagattaggcaaccatgtctcattcctgatttaaaggaagtgcctccaataattacatgttaagtatgtttgctaaaggacttttttattgtcataaaatataaagaatataaaatttaccatttaaccattttaaagtgtataattcaggagcattcagtacattcacagtgttgtgcaaccatcactattaattccataattgctgtagatttttggtagtaacgatttatgaggctgaagaaaacttgtaagaatttttgttgccattgttattgttgaaatctaaattgatattgaattttataagaaaattcaacatccattacaaaaaaattttccttagtttgttaacatgttacattaatatttctaaaattttaaatcatgaaatatatatatacatataaaatacttctaaattttcttggttattcttgactctactcttgcatactaattttggaattagcttattaatttccatgaattctgatagggtttttatatgtataatatatgtattatatgtacatatcgtatgtatgtattatttcatgatatctataatgtatattttgtgattctattttcataaaataaatatataatacatatgtatatgtattatacataatctagtatatattacatatgtatagtatgtatgtattacatactttatatgtagtatatattatatattaatagtatgtagaatgtctaatgtgaaaatatacttgctttttcaggatggaccttcattgtcataaacaggccaggcgcggtggctcacgcctgtaatctcaacactttgggaggccaaggcgggtgtatcacctgaggtcaggagtttgagaccagcctggccaacatggtgaaaccctgcctctactaaaaaatacaaaaattagccaggcatggtggcgggcacctgtaatcccaactactcgggagattgagacaagagaattgcttgaactcaggaggtggaggttgcagtgagccaatatctcagcactgcactccagcccggcaacagagctagattccgtctcaaaaaaaaaaaaagtaataatatatcacacatattgctggattcaatttacttacaccatgaactttttgtttttatgctcaaaaaggagagtggcgatactttttcttccttgcactgtcatttggctttcctattaaggtcattttattgccacaaaattacttacattttccctctttctgtaatatctgtagcatttaatataagatggaatccagtatctgtttcttgaaggctttgtaaaacttataaaactattagtgactggtgggatttgtatgtgtgtgttttttcatgtgtgtatacatttacaactatgaaattagtttcttttgtggttagatatttctggattttctttttccttttgaaatggttttggtgattatatttcttagaaaactgcctgtttcatctcatttttcgaggttattgcaggcattgttgatagtgttttcttttgattaaaaatgttactgtatttgtgattttgcccccttttaaagtttttaattgatcctccctcttgctccctttcctcttgcctccttccctctctctccctttccatactgccagagatgtgttttatctttcttctatgattcttgagtttacattgtttttttattttctaacattttgtctttgatgcttagcttttcaggttcattttatatgtatatagatataagcatatatatgtctaggtatacatttctctctgcattccagtgcatctctaaattatatatatatatatatgtgtgtgtgtatatatatatatatatatgtgtatatatatatgtgtgtgtatatatatatgtgtatatatatatatgtgtgtatatatatatgtgtgtgtatatatatatatatagccttcattcttattcatctctaacaagtttctcatttttaccattttttgatctgtaaatgcttaaatcgtgttttaaaatgtccaaatatatgggagttgaggccatcctttttattactgaagcctaattaaatggccttgtggtctgtataacacatctattttagtatctgtggaaacttgctttgtatttccagtccttgtccacatgtttttgaaagcaagttacattctctaatagctgggtacagggatcaatgtgcgtcctttggacaaagtatacaaattatgtttcaaacctacctttattttcagtctattttagatgtcagttaatctctcaccaggcttatggacgtttttgtgccattcaattcattttgctttctgtattttgaagttatgttacttaccatggacatccctgttcatgattattatagctgcctaagaaatcattcctgttatcactatgtaataaccctctttatacatgaaagtgctttatgccctaatgtctatttggtttgctaatagcagaggtacactagctctattttggtaatacttgctagccatattttcccctttccctccattttcaaccctttttcgtcattttgcactaggattttgttttataaacagaatatagctggatttgaagtttttattatttctgttatctgatagtttaatcttttaaaatttatggtgcttaccaacaagtttggagtatttctaccatcattttatatgctcttattcctcatgttttttctttgttcctttcttccttccttctttctttctttccttccttctttctttctttccttccttccttccttccttttttccttctttctttccttccctccctccctcccttcctccttccttccctccttccttcctctctctccttttcttcgtttctttcccttccattggattgattgggtttttctattcctttttttttttccatactctatgtaaagtacacactattcctttagtagttgccctttgcctttttacgatgtttcaattggtgaggatctcctctctcctccagaacaaacaaaaacttacattttgttaagttggattacctcacatctctttcatataatattttctaaccttctagttctactgtgtttttaacccatgaaataactattactattgctgctgcctatagtaaataacatgtttacctgcattttttatatgtttatagttactctttaatttaaaaaaagcattgctttttgttttacagtacttcagaagtttttccaagaatgatctgagagtgataaattctcattctttgtctaaaatcccaaatttagtatgtactcaacagtgatggtttatctccataacctcaaaattaaaatattttgaagatattccattgtcttctcacttttagccttgtacctttgtaggtagtctgacctctcccccgtttcggatggcttttacagtgttcagtctctctcgaatgttctgaggtttcactgaagtgattccagatataaattcatttctatttttatgtgctttattctggataatttctttaaactcatattccagttcactaatttccttttgatcctgtctggtctgctgcttaaacaatctattgagcttttcatttctagacatttcatttgcttctcttaaaaatatatgttttcttttatacagtcttattcttcggttctctgtaccaaattataaaaaccttttaagattgttctaatagtttaaattttaggagtatcaatcctcttttttcttctatctgtgtttttccatgttagattattggctcatgtattttgtcatttttaactgtgaattgatctctactattaaatattatttctctgggaacagaatagaatttgagtttctcttcacaatatatttgcattttggcttctatcatgtatcctattagtaacgactgcctgggaataattgttatgtaagttttttgtatttaggaatttctgtaccatataattagaatacatatttttcctaagcagcatgtagtttaggcttgaagtttgatttctcatgggcaatattggttttcctattcagagcctcagagagtgccagattatccattttttacacttagcagtaaatttacaagttagctttaagtgtcttctcttgtaagatcttttgtatttaaacatgtttgttttgttttactatttcatctagtgtgtctgagtatttagagcaggatggcttccacatttgcccagtctaccatgttatagtttgtttttctgacttgggggcattctagatccaccacaagaaagtactgaagtgtacggttcatgcaggagccttggaagcaatgggttcagaatgtgagttctgacttcactaattattcactctttgaccttggacaaaaaccttaactccatgaagttctgcttattcctgggtgatttgggggattataatagtaagcatatcatggcttgttataggagttaaagtgagaaaatgtgtgttgtgaatttagcgtaatgcctgaatcagattaagtactcagtaaacagtcacatgtaacatgtgcataaggctatggtctgaatgttggtgtccccccaaaatctacttgttggaacctaatccccaatgtgatagtattaagaagagaggcctttaggagatgattagatcatgaggtctctgcccttatgaaaggtattagtgcccttataaaataagtttgagggaatctgtttgaccttccatcatgtaaagacacagctaaaaggtgttatcattgaggcagaaaacaagccctgactaaacactaagtctgctggtgtcttgatcttgggattcccagcctccaaaactgtgagcaataaatttccgttgtttataaattacccactctgagatattttgttatagcagcctgaatagatggaaacacataacaccaaatatataaaaagtttttaacacctgtaaaccattctgctgaaatgtgaatatttctttccacagtctaatgttatttcactactgtagaattccctgtataaaaagctatagcatatatgtctcagatatgatcacaggccgtgtgtgatggaagggttgttgacaattcatgactctatggttttgtgaggtaaatgccactggttttataatgattgagatcctttttgaccaaatgcatactataccctcagtcatcataactacaaactctatgaggcggccagtatctcttagtgaagataggcacaatcatatttagtagagcgagttagggttcttatttctattctaagtgagaaaaccaatagaactaagataggacattgctagagcaagcagtatttttccttattagaaatcgtaattagaaaataaagaaagaaatgcagttggattaaagaaagtgacctaaagatttcaaactaaagaaataactacctttcattcagtaggaataggaggtcattgcattcctgctgtggtctagaaactgtgctggtgctttggggaatgccaagatggataagatacaaaggtgaaggctgggcgcggtggctcacatctgtaatcccagcactttgggaggctgaggcaggcgtatcacttgaggtcaggagttcgagcccagcctggccaatatggtgaaactccgtctctactaaaaacacaaaaattggccaggcagggtggtatgcgcctgtgatcccagctgctactcgggagctgaggcacaagaattgcttgaacccaggaggcggaggttgcagtgagccaagattgcgccactgcactccagcctgggtgacagaatgagactctatctccaaaaaaaaaaaaaaaaaaaaaaaagcatagttgatgctgaagagatttatatcagtcatggctagtctgttttagctctctaataccacgttgggttgaagactcacaggagattgggtagtaagtggagtaaagctttgcacagtgtgctagcagcagtgaaaagacactgtaggcattggaggattttcctttccaagctttatttcaagaccaccacctggcaggtcagtcatacactgcagaagcagaacaataaagccccgggagtctgggtggggacagaaatggggacttgggttttttctttttttttttagtaaacatttgattgaagcatcacacctacagaaaagtgtccaaactgtaagtttgcagcttgattaatttgcacaaagtgaatattcctgcataaccagcaccctggttaggaagtgaaataacattacaggctcctcagaagcaccgacccccacacctgccctcctctaagtgtaacctcactgaccacaggataaccactctcttgatttctaacatcatggaatggttttgcctgtttcttattgctaacttgtgagatggcaatttggcaggtaagatatgagggctgatttattaatgatgttgaaggaggtctctaaggaattcactcagaaaacaaattagggtcataggaagaaaatgtgaagatagctcaggacttgagtaaacatttcttgatcatctgcttgcatcccagacactgggctgcactttgaggagacagtggtgaatgagacacacaaaattcttgccttcatggagtttgcagatgagtaaccaggcaatgccaatactccatggttagtgccatgattagagagtaaatgttacacgggggtcgcagaaggaaggcttaggtggtcaaaaaaagcttcctggaagaaatagcacctaacacaatatcaccagggtgagaagttgggtatgcacacccgggcagagagaagagcattgtggagatgagagaaattgtggtttggtcaacacattgttagaagttccaggaagctgaatagagagttgtgggtgaggagagatgacagaggggacaagggctgatcaaggcctagggcttgttgcccttttgatcctgtcaaagagaactagtcctttgaaggacttcaaatgctaactaccctgacaccggtatggaaccactgaaaggttttaaggaaaagagtaaaaatgatcagattctagatgatgggaaaaatgacatggtggcctcttgaaacagaaactcctcattcagacagccatttgctacccctttgtcccttccttctctctcaccgctaagcgcgcatgcacgcacacacacacacacgcacacacgctggtcctaacagagcaaacaactcacttgttctcttcctcctcctcttctttttagagattagaaattgacagatcactggggtagctagttggatgagaaatcaatttaagactacttttattcctaatccaaaaatctttgtgaagctttgttatagaattacgatttaatgtttatacaatataaaaaaggacccataaacagtttcgttgagtgcttttgaagagtggaacccttttattcttgtcttttgcatattcttttctctttatccctccttgctccattttatgaaatacagtttattagaagatatatttgagtatttatcaaagtatttatgaagctgttgtttggcattttctgtgagctttgtattctcagaatgcagtatattaaggaggaaaataatgttatttgatttttgttgtcttactcttcttgatgacccatagatgtacaatggccagcatgattggtggcatccagaaagctgaatctgtacctctgctttacatctaattcgcatacaaatttatcagcccttccctggaaggaatgagatttttcaggtctagttctctaagacaattactaatttttgaccaactttgtaggtaacttcaggtcaggggcaatgacattcaaaaataacacaattctgcagcgtttggccaggagtgcgctggaaattgagtttggtgaaaattatagtatttcagaaattacgcagtaagatctttttcataggaaaacatctcgccttccgcaatggaacatacagaaccgtgtccattacaaactagtctcaaggcagcgattactttcctccacaagcaatggcaaaccatagagcaacaatcccaaagaactgagcacttcccacgggaacaggcttcagctgcagtttgcttttggactgtcattaacaatctgcccatctcttagaagagatccgctgaccctggtgtctaaacattttgctagaactaagtaaatcatgtcaggtggttctacccatatagcagaagtcttttcagtcttcagaagtctttgaagaacaaagttgagctgcgtcctactccatttctgtgtcctgtttccagaatcattagatggtttcgtatggaaaatacatcaagaggtgactcagttgctctaaatagaaaccttcaaattggcaactccaaaagtggacatttgtatgtctatagcatagacagatctgttataacatacagggacagtatgtagtgtttttaaagggattttcaaaaatatagggtttattaagaatgcaggagcctaaaagaaaataagaatttacataagaatgtcattagggttggtggtttggctgctctaaccaataatttttgtcatccaataccccactgattattaaattaatctgttattcaaacagcaatcgaaaacaactcagcccatattttctgggcatttgtgactgtcaacaagttggacaaaattggaatctaaaaaggatgtaatgttttactattttccagtatgtttctttccttcttgattacccagccccctttgccaagaaagagattcacaaagacttgcttagaatcaattgcaaaataaatagttagaaccagttaagaaaaataattaatcaaaaataaaactttaaacacatgtaacattttcatttcaacatttcagtgttggcaaaatattaatttctaaggtaaattaggtttttgtttttgttttttagtgtgtgcttttttagttagtatcactcatcacttctcataaaaattatattgccgtcggtttcactttgagatctgtacacaagctttgctcatcttcctggaagccccaaaagctgtggctacagttttcttctctcatcgcttctccccacgcacctttcatttatctgctaagctgaaagaaagtaattggtctcgaagctgtgttgacatgtttcgtgggctacagttcagaaaaccatagttcagggattccattttccaacgaacaactccaatttcctgttgaggtctcaagctgggtgggcaatttaccacaagtctttagactgttctcagtgagtgccctgcaggtgtttctaccaagtgaggcttctggaaatgacctgtataatggatccattgcacaatagggacacagcattttccttgagtaaaggctaagaaggtggcctctgggactgaactatggtctgggctaccacacttactagtgcaaagatcttaacacattatttaaatgccctaaccctcactttgctcatctccaagagggctataagcatagtccatgcctcttaggatctatgtgtgggtttaaaaaaagatgtattactttcatacttagcacagtgcatagtgcagaataaatgcttcataaatggaagacatttttatggagcacagtccacaaacccatctgtgttgacagggatgcaggaaaaccacaggactccttactcgagatttctcagccttgaaggtaaaactaatagtttcagtcaggaaaagtagatggtgaggttttttttgctctgatgagactgtcctcgataaaatagctcttggatttttgccacttcctgggtctacttgagctcttggttgacaagaaatttggaattctggatctgggaatacacatactcaacagtgaccagatccttcattacacaaattagatacagactttgtcagtgggagtacattagtgtcatgaataatataatttgtaggtgttaaaatgtaagttttttaaccacttaacttgcaagcatatgctaatttgttgaaatatttttgtatctcctgctctacagattcttgccaaactaccatactcaatcttgtttaaaacatgtaaatcaataggattcattttcccatgaaataatcagcaatcttttcaaatgggctttgtttaatttctaaacgagtcagctttccactctacagtgagagtagcaccagtggtcatattcttccctttggagattgaaggctcttcatcttatttttccccaagttttcccttgttgtctttacttccttatatcttgccatgttgggtggtaatgcacaaaactgtggattacccaagtcaaaatagttcctgtctcaattctacacagtcatacccaagcagcagtagaggaaaaccagccacatcctccctgtattgcctcctcttctgcatctcagaaacatggtagaagtaacttctgcatcataaaaaccaatttctttccagcattaaaggtttaaaacatgactatcacattgaaaagattttcaatgatatgtcatataatgttgaggctgtgctaatcagtctttaatacaagtctgccttctttttgtattatgggtatggggccaggtttgaataattcaatgctagctcttacaatgaatatcctaattagtgctatatgtttatggttgctaaaatcatcttggctttaaattttaaaaaggggaggaagaggtaaatgcttatcctgggcactttattttgcattgttgaaatagtgccataagatgaaagtggggtccaaagatactataataattgggattaaaacctctggtcaatttttctaccaatccctctgaatctcagttcaatgaagcattttactggggacagggtttccctgattcttttcctcagatgctcagaggaaaaagtaccctatttccagactcaaggatgattacaactttgaggatccagatagaatggatgttgttgtgtaggtgttgctatctttacttgctctttgataagcagtgtttggagggttttagtacaggaaatgttataaattactgttttccctcctgagtccatgatataaaatgagaggggcgcatgtctataatgactaggcaggtttctacctgacatgaattagtctcacaatttcccatttgtacatttcttaatgtgtggggaagaggggtgggagcacatggaagtttgtctgggctcacaacacagtgaggctttcctcttccatgccggagggtaggagaccagcagagccaaggaatatttttagaatgtttatttgcatgtggaatggaggcgtgcagagctgtgtccacactattgacgtctgcaagttgcatttctgcggtgcattgtctccatcctggtggttgtttgtgctgtgactccctctatccctacctcaaagagcagtctgtgttccccccttgctgtgcccaatactgcacctgaagtggcttagaagttgccaaaaccctatagatgtgtgtttattaactctccagcttgccctccatttgttcagcttggaaagagtttatatattcctatgggtattaaaaacccatctgatgtattaaaggagctcaaaggatcaaagcagaaatgctgcctgaaatgcagcatgttgaatatagatacaaagtttctagacccaaaccactttttcaaaggacatcccgtatactcaaaaagaaaattcgttttttaatgatcagcttttctttgggacttgaattttttctttctctttagtaaccgcccaccttttggagcatctctcatgattttgacaagaagaccacttggcaccccagggtagagacagtcattaatttccgtatgttgttcgtgccttggaagatatagcccaagaagcttaaccggctaatgacaaaggttcttagtgcatctgaaagaaaatgggtggagagggtacaagatgaggatcagaatcacctatgatccagaataattagaggtgtagatgatcaaagtcaggaggatgtgggagaaattatcaggataaaatcattgtatcagatgcatctgaaaacattgctgtactgacttttagaaaacaaattatatatttcacgagtgattccatttctattgaagtaggttgcccctgcaatcttggattatttcagtagatctaagcctatatgagaattcatatatgattactgtttatcgaatgcctacttttcaaaaagagttttgtgttcatttccacatttattgttttttccattttttccacttcatctgcctttcaccaaggggaacttgaggctcagaggagtaaactctcctgaccaatctaacagagccactatgtgctggagttgaattaagtccagatctgcccgactctgaaagctgacagagaattcctgttggcatccatgtggatgcctctctgtcatgatactagtcatctgtgtagccacatctcagattgagttcatctcaaaatcagggtttgctttggaaactgaaaattctctgatccacttgatctaagggaagaaatctacaagcatccagtttgacaggagccatacacttctcaatgccagtttcatgcaaatctccattaggtgtacccaggggttctctcacaacacttaccacattactgtttaatcatctctttcttagtcttcctcccccattaaaccaaatcaggtaggttgaaatagtagcaaaaaatactggctttggcgtcatgaagacctgggtttgagatctcaatgccatcagttcctaattgggcaacctttgtcagcaagtcacttcccctcttagttgccgtctgtgcctctgtaaaatgaagatgctaatagcacctacaggggattggcttgatgtgaatattacaaggtattatagaaaaaccggtgcctggcatttagttggtgctcaatagctgggaggtcttatatttaattcattgtagacaggaacatgtcatgttaattcctgtgttcctagcacttaacataggaccttgtgtataaagtagtgctcagaaagctgttgattgagacgaggtttcccaagagaataactttgtaaagtgtgatggggggtgggcgggggaggtagggcgggggttgtgtgtaattctagtagctgagacacctgttattttgtgtgatatttaaaaacaagtatctgttttgaaaacaactagaagctcagattcccaagagctgaaaggcaactttgtgattttccttaggaaaagagaaggtggtccagagaagggagggggcttgcctgaggtcctacagggaggaagccccttaggataccagactcaaagcccagtagttagtcctgatgcttacgaatctttcttcacatcattgcttctccatagctgataatttaaaaacaactattaactaacaaaatacataaataaatatttgtatgaagtagcataaacatggtaagtaactagtgtggtacataggatatgcaataagaattaagtctctgccacccataatcccctgagttctctcctctagaggagcaaccattgtttccaagccctggtgtgtccctctccttgcatagatggcttatgcacatacaggcgcttaggtatattaaatgttttgcaactcatttttttatacaatgataacacagtgtatatattgtactttaccttttatttcacccgatatgtctgaaactatcgtgtcatttatgtgtgtgtgtatatatatatatatatatatatctccttgaagtatctgaaatgtgtatatatacccttaaaatatatataaaatagatatataaaatataaatgtgtatatatacccttaaaaaatatatataatatatattatatattaaatatattttatataatatatattatattaaatatatattatataatatgtattatatattaaatatattttatataatatgtattatatattaaatatatttaatatataatatatattacatattaaatatatttaatatataatatatattacatattaagtatatttaatatataatataaaaatacatatatatttaaggttgtatgagattccattttggggaatgttttcatttaatccagattggactttctgttgttccaaaacattggctacttaactcaaagcagaaaggaatatctttgtataagatgcaatttatctatacattaaattactagaagaattgatgagtcaaagggtatacatgtttataattttgatagatccttggggaaaaaaaatgcactctggagatgtgaaaccaaactcttcttctaccaatttatgagaatgttagttatattcataccaacacggtgtgttatgaaatgttctgctctttttcagtctgatagatgaaagatggaatatcattgttgtcttaacttttctttttatgatcaaatttgaacatctgtcatatgttttaaggttatttatatttccatctctgtgtgccgtctaattatgtccttacttctctttgtctcttaagttgttaagtcttatattgttagtcttttcttttaaggtgctagacatttctattgagtttatatagtaagaaaattaaccatttttcctatatattgcattaaaagcatagctcatcataattattttctcaatacaaaagtagtactggcttatggtagtgttagagaattatctgtagtctcatcattcagcagtataactactgataaaattttggtgtacttgcttccattcatgctttctggttttttttcaaaaatagaacaatattataaatactattttataacatgcctttttaaacttgaaatgtcataagcatatttcattgcctctaaatatttctgcaacataatttcttaaaaaactaaccacacagtatgtggatttactagtttctttaaccaacaccacttaggctcttaatatttggctatagatgaatgtctttactctgaaaactctgtgtatttatgtagtgactctttcaagtatcaattcctagaagtaaaatagtttggaaccattctttattaagataaatctcagtaagagttacaaagtacagacataaatgccatttttttttatttctttctctgttgcctattttgggacataagatataacttttataaagaacaggtattaggtggaaattattttccagaacccttctccaggaagatatagtgccaactgagaatggagcctaagaggcctccgcttttatttctcatattaaggtgctaggagaagcctgtttgtaatttaaattgtaagaaaaacagaaaatacagtagtgatagacatgtttatacatttaatgcttttgttagtaattatttacaaaccttctgatactacaaaagaaacggtattgacttttctagcagggtgccgagttaattatttcaacttaataatgagcaacattgaaatgacattacacaggcctgttgagggagttgcagaaaaacgagcttcagaaatactttgtgaatgtgtgagcatggctataagtacaactaatcaggaaaattaaagcaacatgaaaaattgttgagattaatggaccctgattaaaacaggataaagtgctcaggatgtataaagtcacacagttctctgagcaggcccatgtgttccagaatgcgtatttcagttcacagtaaatctctcaaatgaattatgctaatactattgattctaaccatttcctcactggcctgtttatctatttttatgtcatttctccgttataaaggacatgggcttcaaatgcatgcttatcaagctccgaaaattgaattggtgttgaagaaaggaggcaaaacaaataatagacaatcttgtttgccgtgtttggaaactgagcagggtagaaaatatatacccttgaatggtcagggtatttaggataattctaaaaatgctttccggctatggttctatatgttatgtgaagtggtgaattcagacagactgtccagtaactgatgagtgaggatggatattaaaatttggtagccccagtgatgtagataattcaagagaaaggtcttgaatacacgttaacttgaattctccatgcccctttgctgtgtagatacaacatcagttccaccaggtgttgcctgaagtctgatgtggtgttaacaagtaaagtttgacagggtaaaggtagtgactgtgccaagggcacctgtacctgtgggtgattacattaaaccacttggcatagtctattaaccataaaatgaaaacacccttgaccaggtgcagtggctcccacctgtaatcccagcactttgggaggccagggtgggtagatcacttgaggtgaggagttcgagaccagcctggccaacatggtgaaactctgtctctattaaaaataccagaattagccgggcatgatggtacgcacctgtaatcccagctactcgggaggctgaggcaggagaatcacttgaacctgggagacggaggttgcagtgagttgagattgcaccaagccatacacacaaaacccttgtgttttatttttatttttatttattttattttttattttttattttttatttttttgagacggagtctcactctgttgcccaggctggagtccagtggcgcgatcttggctcactgcaacctccacctcctgggttcaagcgattctcctgcttcagcctcccaagtaactgggattacaggcgtgtgccaccacgcccaactagttgttgtacttttagtagagacagggtttcaccatattggccaggctggtctcgaactcctgactttgtgatccacccacctcggcttcccaaagtgctgggattacaggcgtgagccactgcgctcggccgtgttttatttttaagacagtcactatgagcaaaggaatttgacttttcactttaaaaaatgataccattttttaaattctttttctttcagaatatttagcagtagttcctaaacacatgactagcctccccagaatcatctggggtgcctatagaagtgtatgattctgggtctcagcccagaccacctgattcccagtggccaggaggtgagtctgggaatctgcactttggccaggtttcccaggtgattctgatgcatggccaggctgggaaaacctctgcaggatctcctcgtgtataacacaataggacatgacagtaatttcctggatttcattacccaaagctagactctttctcttttgcataaactaggaaaaagtgaacaaataagacaaaagaagaagaaaccaagggtaaagttataccaaaagtttcatttgcactcctccctctccagagatctagaagttgtctgaagtgatgcaccaccattgtgtgttctgggccacgattaggagatgtggttaaaacacaactggctcagagaaagatggtgaacctacagcttaaagttgaacttatggaaaatgagtggcagttaaaatgggatgagtaatcatacttgagcttggaatcagggcttcaggaaaacctcaaccaactccctcagacatcagtggcacttttgagaggaggaatttcagaacttgtgtcctagggtcttggagaaagcagataatacctccctgcaagagggcgggccgaagataaaccaaagccaggatgcagaagtctgccatcgccatcaatttagagagggtagagagtaaacagcgatggatttctccagatcaccaactctgtgatttttaaagaatgggacaaattaatggtttagggtatcatgacatacatcttccatctcattttagtgtatgttttatttctttttataaattgtcgtctgtgatgtcacttctcccctctgaagcaataagtttgtttgctttccctggcgttaaccatatttttaaaagcaaaaactgtaaggtacaaccctgccgtttttagatgaaagtaaatatattttattaaatgtattcatttatgcaggtttctgctccctgtgaacacatgtgaagacagatactgcagtgagcaccagcgattaaaaatcggataaactggggtcttgtccttgagtctgagatgtagttgtataaccttcctgagaagtcactgtattttcctaacaacttattttgccttaaatttaggactctctctctctttcactaacatccatgataaagcaattgcttctaaaagttgtgctgttttatccaaatagacatgaaatcctcaagcaaccaaagtctgtaatagtcggaaaatttggttgtggtacctagaacaagcagattgaaatccatgctaagacccatgcatgtgtttattttcatttaaaccttttattttctcctccttagattattaaggtgaacatagcagttagcatatttcatcctacaattttcacgcaggagacgcatttttccaatgggttttctatggaataatagcatcaccaaatgcctaaagcagttagggccatggagccaaacacatatgagatgtgttgcatatcaatatatgaacatgcattcacaggcgtgacatcaaatgctatagatgcacatacaaatttgcatctacaggtgtgaacataagtgctatatatacatataaaaacgtgaaatgtggtatacgcacatattaatatgcactcacaggtatataacactgttattccttgttcctcttagaaagttagaattcatgttagcctgttaaagaccctgagaagtcctgcagcgaagaaacctgttgaactctttttaaccaggaattcaccaaacacttatcaacaaaacaggtagaacagttccataaaacccaccttgagaggcactcaggctaataatttccatatagaatggatgggataaaagtcagtcgtggttcttgagatagttataagatagtaaatgccttggaaataatgctaagataagtgaagtagccaggatgctatatatatatatatatatatatatatatatatatatatatatacacacactgaatatataaatattaacctattggtgtgattattaagctgggaggttggggggatggactagactagagctgtgtgccaaaaagaagggagtcatcagccatggaaccgggattgtgaagcagagatgctgccctgcaactttagttacaagaaccagaaaggaagcacatgttggctaccctgaaagatcattctagcatcttcgcaaaatacatttcttgaaatagagccatagaaaaacctaaaagaggcagaagcactcatttcttcacctgtagaaaccaaagaacagtgagtcccatgccaggactttatgatgttcatcttcagaaaatgccccagcctgcagcactatgctattctcttatcccccaaaacgataattcagagattgactacggggaaaagacgcagaagagtgagaaatcagaaaaattctgatttgatgcacaaatctctttttgaccttttaatggtcgttggaaaagatgaattgtgaaatgttttctgtggtagtgtgacagacatacaaaattaggaagaatagtggaatgaaccctgtgtacccatatgcagcttcaacaattgttagtgttttgtcttgaagatataatttatttgataacaactttctcgtctttggcctgtggaagccacttcaacttggtccttgtgaccttttgacagtacctcattagtctttgataatttccttgggttctgcataacaagatattacaggcttattttgtacattttctgcctcaaatctggaatcagccattttcaagggagccttggttttgtttattgggaaatgttatttagagaccacaatctgggcctaagtattcattgctaatggctttgccaaaatcttttaagtctttttaggagtcaaacctaggaaatatatttttgtttagaaagagacaataaatcaagtgctcatgctaatagttctacttccaaatcaaaattgcgtgatttttaattaacttcttggattcatacttgtaccttgtttaagtctactctggctgctgtttaaaaaaaaaataccgtaggctggatggattaaatagtagacatttatttcccacatttttggaggctgggaggtcctagatgagggtgccagcatggtcaggttctggtaacggctctcttctttagttagtgaatggccttcttgctgtatcctcacgtgatagatggagcaggttcgtctctggtttcttcttaggagagcatgtattccaccatgagggctctacccttatgacctcatctaaagctaattacctcccaaaggccctgtctctaaagaccatcacattgcaggtaagagtttcaacatatgactctgggtgggatacagttcaacccatagtgtatctcttttctcttacactaaaaatctcacttcctaaccatatcagcataataattatttaagctacaacatacaaaaataatattcaaatatccatatcaatattgttgctaaaagtagaatgactcagtattgtttaagaattctttgtagtttttttatttttaggctaaatcacaagatggaaatagtttgaaaaaaactgtgttttaaagtcatttaaagcggagtacaatggcacacacctgtagtcccagctactcaggaggctaaagcgggaggatcacttgagcccaggagtctgaggctgcaatgatctatgatcatgccactgtgctccaacctgggcaacatagtgagacctcatctctaataataaaaaagccatttgaaatactttttgctttgtggggttactccaacaatttcttatacaggagggtttttcgttattgttatttttgatttgaggagtgcttttttcagttatacaaaatgtgcatgcacatggtgtcaatgccacaaccacaaaatgaggtaatttagagcagcatcgcttccatttcccaatccttcatcctattttctctctctcctaataggtaatcatttttggtagttggtttagctttttatttagctgttgttaaaatataagaaaaattgaaatgtattcatttttttcatttcttttacaaaatgaagcatatcatacacactcttcagcaccatgcctttcttcatattatattatatgccactgatctttcctcataggttttggaaatgagatttccctcattctgtttcaaagctgcatggtactccattgtatagagatacaattgcttgctcagtctcctactcattgacattcaggttacttcgagccttgtcttattacacatgatcttacaatgaacagcttaatgcatgtataatttaacattttgggatcgattcatagacttgggattgctgggtgaaagggtaaacacatatataatttttctggatattaccaaactcctccatggaagttgtatcattttgcatttcttctagtaatgtatgcaagtacctgttactctttagacttgccagtgggggcattatcaaacccttggatttttttccaatctacagtagatttaaaaaatgctaacttattgtagttccaattttcatttaacttattagaagtgagagtgcagttgtttttacatgtgttagaaataattctttataatgaaatgtgttgcaaatgattttctaaagcttttatttgcttttttcaaaaaatcattctttggtgtttaaaaaatatgtccatattgttcactttctatttcattgcctatttttttgatctttatgatttcttctattttctttgggtttatttgctttttttctagtttcttaaggtgaaagcttagatcattatttttagatcatttttattctctaataaacatttaaatctatacatttccctctaggagtggtgatattccacaggttttgatatgatgccttttactgtcttgtagtttaaatattttctaatctgcattgtgatttcttttggcatgtgttatttagaagtgtgccgcttaattttctaattatttttaaagaatttctagataccttaatatgttttattcctacttcaactctgttgtggttggaaatcatattctgcatgatgtcagtattttaatgtttttcagattaattttatggtccagaatattgctattttggtgaatattccatgtgcattttaaaagaatgtatatttggtagttgttagttgaaatattctataaatgtgaattaggtcaagacattgtgttgttgaaatcttctgtattctaatttatttatggctgaaatgtttgataaaatcccaagagagatttgttaaaatctccaactacaattgtggatctacgtctctctccctttagtctgtaaatttttgtttcattattttgaaatcctgttattatgtgcttacacatctggaatttttatgtcttcttggttatcttattttctgtcttattttcactcttagaatatggccgtctttatctctggtgacatcctttgtctttgtctgatcttaatttagccaaaccagctttcttccacttagaattagcatgttacatcttttaccatctttttaccttccacttatctgtgtctttgtatttaagttctcctctttgaaacagcatatgttttggtctttctttttagctgttattgcttatggtatattttactgtatttttatttacattttcaatttactcgtgataaaattggctccttttgccatagacttctatgagttttgagaaatatttacagttgtgtatttactactataatcaagatatagcaattctatcatctgagaaaattctccttaggtgcactggaggtcagtctattcccagtcaatccattcccccaaccacagctcatcggaaaccatgatatttttgtgaccctacaatttggccttttcctgaatgtcatataagtagaatcatacagaatatagcctttaaaatctgacttcttatatcagcataatgcatttgagatttattcatattactgctggtattcactgtataaatgtatcatattttgtttatccattatccagtagaaggacatttggacactttggagtttttggtgattatgaataaaaccaccataaacattcacatgtaggtgtttgtatgaacataaggttgtcatttcacctgaatgaacctgggagtggggttgctggattgtgtgggaaatgtgtgtttaattgtagaagaaagtaacctccaaactgttttacatagtatctgtaccattttgccttcttgtcagcactgtaggggagttccaggtgttccttatccttgccagctcttggtattattcattccttccttccttccttccttgctccctccctccctccctctctttctttctttctttctttcttgccatttttaagggtaccatagtggcatctcattgtggttttgcacttccatgacgaataatgattttaagattcttttcatgtaattccttgtgatctacatcttattcaatatctgttcaaatgttttgctcattttaaaaaaaaaggtactttgttttctttttattgagttttttactgttgcaaattttttgtatattctagatacaaatcctttgtaaaaacatggcctgcagcttgtcttttcattgtcttaatagtatcttgcacagagcagaaagtattttatttcattgaaatcccattgattgactttttaatggattgtacttttgtttcatatctaagaaatctttgcctaacccaaggtcacaaaagtttttcttctatgctttcttctataaattttatactcgtcagctttacatttaggtctgtgattcatttggaattaatttttatacatggtgtgatttagcattatggatatccaattattccattatcatttgttgaaaagactgtcatttctccactgacttgcctttgaacctttgttgaaattccagtgactatatatgtatacatctgattgaacacattttaatttatctatgtgtctgtcttttctctaatataaaaccgtcttgattattatagcattatattaagtcttgaaatcaagcaagaagaatcctttactttattctttttcaaaatgcctttggctattctagtacatttgcctttccatgtaaattttaaaatacgcttgtctagaaatattttgaaaagtctgctgggattttgtttgaaactgggttgattatatagctcagctggggagccctgacatcttaacacaaccaagtcttccagtccataagcatggtgtaaccatctatttatttcagttgtctttgttttttcatcagtattctatagttttcaatataatgatttttccagtttttaaaacgttatacctatttcttgtacctttagtgctattataaattatactttttcatttcaattacgaactgttcattgctaggatttagaaacatgattgatttttctatatttatctcgtttctgaacttttctaaactaacttattagtcaacacttgcttttttatagcatcttagactattctatgtagacagattatatcgtatgtgcattaagatggttatatttcttcctttccaatctgtatgccttttgtttcttttatttcttctttttttttctctctctcttattgcactgactggaacctccagagtgatggtgaataggagagtgccagcagacaccctggccatgttcccagttttaggggggaaagctgttagaattttatcattaagtctaatgtttactgtttgtttatttcaacatcctttatcaagttaagggagttccttctgttcctaatttcttgagatttatttctcttttatcaaaaaaggttgctaaagtttgtcaaatattttttctcatcatttgagataatcatatggacttctttagtctttagataatttttgaatcttgaactggtcttggattcttggggtaaaccatacttggtcatgatatattgttctattttatattactgtattcaaattgctaatattatgttgtggcttttttactctatgttaataaggtctgttgatatatagtggtttttgtttttgagacagagtttcattcttgttgcccaggctggcatgcagtggtatgatcttggctcactgcaacctccgcctctcaggttcaagtgattctcctgcttcagcctcccaagtagctgtgatgacaggtgcctgccaccatgactggctaattttttgtatttttagtagagatggggtttcaccatgctggctaggctggtcttgaactcctgacctcaggtgatccacccacctcggcctcccaaagtgctgggattacaggcgtgagccaccgcgtcaagcctatagtggtctttttataatgctgtcatctggttttgatatcaggatgatgctagccttataaaaacacttgtgaagtgttctctcctcttttatattctagaagattttgtgtcaaatctgtactacttctcccttaaatgtttagtagaattccccagtgaagacatctgggcttagagatttcgttgtagaaaaagttgtagctatgaattcaatatctttatttaagatcattgaagttagctattatttcttgagtgagctttggtagtttgtgtctttcaaggaatttctttagttcatctaagttattgaatttatgagcattgttttgattgttttgtatttccttattgctcttttagtgtctgtagaatctgtagtaatgtcgtttctttcttactaatagttttagtttatgtcttttctctttttactttgtaatagataaaacagtctaaaagtttattagttttattgatcatttaaaagaaccagctgttagtttgatttctctattgttttctattctcaattctaatattctcttcttcattgttttctttgtcctccttgctttgaattttactcttctttttctagtttcttatagtagaaactcagattattgatttgaggactttcttctttctaatataaacatttaatattagaaattttctctgaagtacttctttaactatatcctaaaaattttgataggttttatgttacacttttttttttaacgtctttttttttattatactttaagttttagggcacatgtgcacattgtgcaggttagttacatatgtatacatgtgccatgctggtgcgctgcacccactaactcgtcatctagcattaggtatatctcccgatgctatccctccccccgtcccccaccccaccacagtccccagagtgtgatattccccttcctgtgtccatgtgacctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttggacatttgggttggttccaagtctttgctattgtgaataatgccgcaataaacatacgtgtgcatgtgtctttatagcagcatgatttatagtcctttgggtatatacccagtaatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtatcctgactttttaatgattgccattctaactggtgtgagatgctatctcactgtggttttgatttgcatttctctgatggccagtgatgatgagcattttttcatgtgttttttggctgcataaatgtcttcttttgagaagtgtctgttcatgtcctttgcccactgtttgatggggttgtttgtttttttcttgtaaatgtgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttatgaaatagggaatcctttccccattgcttgtttttctcaggtttgtcaaagatcagatagttgtagatatgcggcgttatttctgagggctctgttctgttccattgatctatatctctgttttggtatcagtaccatgctgttttggttactgtagccttgtagtatagtttgaagtcaggtagcgttatgcctccagctttgttcttttggcttaggattgccttggtgacgtgggctcttttttggttccatacgaactttaaagtagttttttccacttctctgaagaaagtcattggtagctttatggggatggcattgaatctgtaaattaccttgggcagtatggccattttcacgatattgattcttcctacccatgagcatggaatgttcttctgtttgtttgtatcctcttttatttccttgagcagtggtttgtagttctccttgaagaggtccttcacatcccttgtaagttggattcctaggtattttcttctctttgaagcaattgtgaatgggagttcactcatgatttggctctctgtttgtctgttattggtgtataagaatccttgtgatttttgtacattgattttgtatcctgagactttgctgaagttgcttatcagcttaaggagattttgggctgagacaatggggttttctatatatacaatcatgtcatctgctaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcagtacctaatttcttgagagtttttagcatgaagggttgttgaatttttgtcaaaggctttttctgcatctattgagataatcatgtggtttttgtctttggctctgtttatatgctggattacatttattgatttgcgtatattgaaccagccttgcatcccagggatgaagcccacttgatcatggtggataagcttttggatgtgctgctggattcgttttgccagtatttgattgaggatttttgcatcaatgttcatcaaggatattggtctaaaattctcttttttggttgtgtctctgccaggctttggtgtcagaataatgctggcctcataaaatgagctagggaggactccctctttttctattgattggaatagtttcagaaggaatggtaccagttcctccttgcacctctgatagaattcggctgtgaatccatctggtcctggactctttttggttggtaaactattgattattgccacaatttcagctcctgttattggtctattcagagattcaacttcttcctggtttagtcttgagagagtgtatgtgtcgaggaatttatccatttcttctggattttctagtttatttgcgtagaggtgtttgtagtattctctgatggtagtttgtatttctgtgggattgctggtgatatcccctttatcattttttattgcatctatttgattcttctctctttttttctttattagtcttgctagcggtctatcaattttgttgatcctttcaaaaaaccagctcctggattcattaattttttgaagggttttttgtgtccctgtttccttccgttctgctctgattttagttatttcttcccttctgctagcttttgaatgtgtttgctcttgcttgtctagttcttctaattgtgatgttagggtgtcaattttggatctttcctgctttctcttgtgggcatttagtgctataaatttccctctacacactgctttgaatgcgtcccagagattctggtatgtcgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctactaggtccgcttggtgcagagctgagttcaattcctgggtatccttgttgactttctgtctcgttgatctgtctgatattgacagtggggtgttaaagtctcccattattaatgtgtgggagtctaagtctctttgtaggtcactgaggacttgctttatgaatctgggtgctcctgtattgggtgcatatatatttaggatagttagctcttcttgttgaattgatccctttaccattatgtaatagccttctttgtctcttttgatctttgttggtttaaagtctgttttatcagagactaggattgcaacccctgcctttttttgttttccattggcttgttagatcttcgtccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtatgaatttgatcctgtcattttgatgttagctggttattttgctcattagttgatgcagtttcttcctagtctcgatggtctttacattttggcatgattttgcagcggctggtaccggttgttcctttccatgtttagcgcttccttcaggagctcttgtaaggcaggcctggtggtgacagaatctctcagcatttgcttgtctgtaaagtattttatttctccttcacttctgaagcttagtttggctggatatgaaattctgggttgaaaattcttttctttaagaatgttgaatattggcccccactctcttctggcttgtagagtttctgccgagagatccgctgttagtctgatgggcttccctttgagggtaactcgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccatcttggttccattctccccatcactttcaggtacaccaatcagacgtagatttggtcttttcacatagtcccatatttcttggaggctttgctcatttctttttattctcttttctctaaacttcccttctcgcttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgattgtctgaagccttcttctctcagctcgtcaaagtcattctccatccagctttgttccattgctggtgaggaactgtgttcctttggaggaggagaggtgctctgctttttagaatttccagtttttctgctctgttttttccccatctttgtggttttatctacttttggtctttgatgatggtgatgtacagatgggtttttggtgtggatgtcctttctgtttgttagttttccttctaacagaggggaccctcagctgcaggtctgttggaataccctaccgtgtgaggtgtcagtgtgcccctgctgggggggtgcctcccagttaggctgcccgggcgtcaggggtcagggacccacttgaggaggcagtctgccctttctcagatctccagctgcatgctgggagaaccactgctctcttcaaagctgtcagacagggacatttaagtctgcagaggttactgctgtctttttgtttgtctgtgccctccctccagaggtggaggctacagaggcaggcaggcctccttgagctgtggtgggctccacccagttcgagcttccgggctgctttgtttacctaagcaagcctgggcaatggcgggcgcccctcccccagcctcgctgccgccttgcagtttgatctcagactgctgtgctagcaattagcgagactccgtgggcgtaggaccctccgagccaggtgtgggatataatctcgtggtgcgccgttttttaagcccgtcggaaaagcgcagtattcgggtgggagtgacccgattttccaggtgccgtctgtcacccctttctttgagtcagaaagggaactccctgaccccttgcgcttcccaagtgaggcaatgcctcgccctgcttcgcctcgtgcacggtgcacacacccatgacctgcgcccactgtctggcactccctagtgagatgaacccggtacctcagatggaaatgccgaaatgactgtcttctgcgttgctcactctgggagctgtagactggagctgttcctattcggccatcttggctcctcccctcacacttttcattaaattcaaaatattttctcattttccttatggcttcctctttgaccttgaggttatttaaagctgtatcgttcatttgaaaatatttgagggttttccggaaacttttctgttactgatttggagttctattttattatggtttgggagcattctttgtataattttaattcttttaaaattgtaaagatttgctttgtgatccaaaacatgatctaactttgtgaatattccatatgaacatatatatacatatattctatatatatgtttgtgtgtatatatacacatatatatgtatatacctgtgtgtgtatatatatatatatagtgttgttgttaaagttttctataaatgttacttaggtaaagttggtttctatattcttacagattttctatgtattctactttttctgttcattaccaagagaggagtgttgcagtctccaactgtaattgtagatttgtttatttctctttcaatgtgtattcatttttggtctcatttatttgaggtttggtcattagatacatgcatatttaggattgttatgcctttttagtgaattggctcctctgtcattttgtgatgtccctttttacacttgtagtattccttgttctgaagtacgctttgtctaatattaatatagctactgcaggttcattgtgactaacattttcgtggaatctttccccatcttttagctttaatcttttcagtatgcttacaattaatgtgtgttcttatagataggacgtaattgggtttcaccttttaatccagtatatcaatctaccttttaattggtacatttgggccatttattttttttaaacaacttgccacatatttaatgtagaatatactgaccatatttaaaatgcacatttagaaaatttttgacaaatgtctatatccatgaaactatcaccacaaacaagtatgagtatatccattacctctaaaaatttgtttcttcctctttgtaatccctcccactggtttctctccacctaattctatccccaagttactactgattttctttttgtcactatcgatgagcttgtattttctagaattttatgtaaatggaatcatacagtatgtattctttgttggtccagctccttacataccatttaattattttgagattcaccatgttgtgtagttaatagtttattccttactctgataggattttgattgatttgccttttatttataaaataaggaaatcagtatagatagaactgacatcttaacaacactgggacttctaaccaatgctcatactcaagcttcctttaaattctaacagcaatgattcatgattttcagtagtatatagttcctgcacatctgttgtcagatttctctctaaatctgaatatttttatgctgtttaagtagtattacttcattttccaactgctttttgctaccaaaaaatccaagttgcttagctatattgaattttatatcctgcatcctttctaagcttccttatcatttctagtagtttttggtaggtttgattacatttcctacaaatatggacatacggtcatcaaataaagataatttcttcctttctttaaaatctggatgaattttatgtcctttcttgccttactgcacaggctgtaacttcaagtacaatgtaaaggagaaatggtaaaatcagacatgcttttctgtttctgaccttaaggtaaaagcatttggtcattcatatagaccatttatttttaatgaagttactgatattattggcttgaaatctagcacttttctagttgatttctgcttgttcatcctcttttttttctgtcttttatattgactattttatgattccatttttttcctgctattggcttattgtttatatacttttaagcttttttttgtattggttgcactaaggtttacagtatacatctttaattgctcatgttctatcttcaaataatattaaattgcttcaggtgtagtgtacttaccttaggataatataatcccaattcctgtctcttgttttagcccagtcagtatttcttcagtgtattttttgactcattttctctttactcaactctgggattctaaatacttgtttgttagactacttggtactattttactgcttactgagcttctgttcatttgtgttttaaccttgtttttctctttgttctctaatttgaataatttctattgacctgacttcaggtatactgatcctatcttctgttgcattcagtctgccttgaatatataacactcagtgaattttggatttaaaatattttattctttctgttttaagatttgcatttggttcatttatatagtttacatatttctgctggaattccccgtttcatacctcagtatagccactttctaaagtttaattaatatataaatatattatttaatatactatattataaagtataatatattaccattatctactaactctaatacctgggccagatgttggtctatctttagattgattcttctgttgactattttgtcacattttactatgtgacacaattactgtacaagtttcttcacatgcatagtcagttttgtactttggatattgtggatggtacattgtagatgtcctggattctgttatattcttctagagaatgttgagttttattgtagcatgtgtttaaattaccagtggatcttcttgtgcttttggtggcctggttttaggcttcagaaggtgattttgtttcgtttttgcctctagccctggaatatgatatttagttcttaaaacttttctcctttatcatgtacagaatttatctgtactagttagaactgatacacaggtgttacatttctggatttttgaattttaacttttagagtttaaacaagtcttttttatataagaaacatgctgattaaagagagttggtgtcaaatccaaagaatcattgctcagactactgctgcataatttttcccctgtgttttctgctagtagttttatagtatctggtgttacatgtaagtctttaatctattttgagttgatttttgtacataatgtgcgataaggtccagtttcattcttttgcaagtggatatccagttgtcccacaccatgtgttgaagagactgtccttttctcagtgtgtattccagtaaaaatcagttgaccatatttgtacaggttcatttctgggctctttattctgttccattaatagatgtgtttatttctttgccagaatcatgctgttttaattactatagctttgttgtatagtttgaaattatgtagtatggtgtctccagcttcactgatttttacttatgatggccttggctgttagggacttgtggtgatttctcatgaattttggaattttttttctatttctacggaaaatgaaattggaattttgatagagattgcatttaatctgtggatcagtttgggttggatggacatcttagcaatattgatttttccaatctacaaaaacaggatattttccatttttggtggcttctttagtttctttcatcaatgtttaatagttttaagtgtacaggtctttgacctccttggttaaatttactcctaagctttttttgtggctattataaatgggattgtcctcctcatttcttttttgaatagttcagtgttagtgtacagaaatgctaaaaactacacattggtctgggcaatgtttttttaggtttgaccccaaaagcataggcaacaaaagcaaaaatagacagatgagattgtgtcaaactaaaaagcttcttaacagcaaaggaaacaattaacagtgtgaatagacaatctacagattgagagaaaatgtttgtaagccatataccagaaaaagggtcagtatccaaaatattataaggaattcaaacaactcaacagcaagaaaacaaaacaaaaaccccagttaaaaagtggacaagggacctgaatcaacacttttcaaatgaagacatagaaatggccaatagatctatgaaaaacatgttcaatattagtaatcatcagggttatacaaattaaaatgacaatgagatatcatttcacacctgccagactagctcttattaaaaggatgaaagataacaagtgttgagaaggatgtggagaaaagcgaaactttgtacacttttggtgggaatgtaaattagtacagccattatagaaaactgtatggagtttccttaaaaactaaaaatagaattaccgtaagttgtagccatcctacttccgggtatttacccaaaagatttgaaatcaattttttaaagagatatctgcactcccatctttactgcagcacttttcataatagctaagttatggaatcaacctaagtgttcatcaatagatgaatggataaggaaaatgcagtataagcgcacaatggaatactatttggcattaaaaagaaggaaattctgtcatttgcaacatcatggatggaattggagatcattattctatatgaaataagccagacacagaaagacaaatactgcatgttctcacttatatgtggaatctgaaacaactgaactcatagaaacagagtagcatggtggtaacagaggctgaggtagagggaggaatggggaaatgatgtttgaagggtaaaaaatctcacacaggaagaataaggactgtttctggagttctgttgcacatcatggtgaatatagttaataatagtgtattgtacatttcaaaactgctacaagaataaatctcaaatgctctcaccatgaaacatggtatttgaggtgatggattctgatatgatttggctgtgtccctgcccaaatctcatcttgaattgtagctcccataatttccatgtgtcatgggagggacccggtgggaggtaattgaatcatgggggtaggtctttcctgtgccgctctcgtgatagtgaatagccactatgtaagacgtccctttgctcttccttcgtcttctgccatgattgtgaggcctccccagccacgtggaaccgtgagtcaattaaacctttttcctttataaattatccagtctcaggtatgtctttattagcagcatgagaataatacagatatgtaaacaatcttaatcattccacattttattcataaattataacatcacttcatgccccatgaatatataccagtataaattgtcagtttacaacaaaataattttttaaattataaggtcaagattccccccatcccaccaaaaaagagggttagcaatggagagagctcatggaagaagataatggcaatagctaactgaagtctgttaacagcctggagaaatgtgagattttttttgttaaggaggaagcagtgatgtgaaagccaaatattttagtattatattgggaagggatcttagaaatcacttatgaggtaggaaaactaagaagagggaaggaacaaaacacttctcatggtgatttgcccattaatttaatttcacaatgggagttcaattcaagtccattaacttctgaaccagttggctttctggcataccctgttatctcccacctccatttttttcttcccctttattgcatattgatattctttgtgtggatcaagtatacactgaatgggagaatagttctgatttttcttgtgagagatttttttcctatttagaatacaaaatgctttgttcatgtcatgcaaaatgaacaaaatcctttgttcatgtaatgcaagatgtccaaccttttataaagtaattctcaatgatcaaaattttgacaaatcaccaaaaaaaaatccataggaacagtaatttaaaagtctaaaacattgcctttcatccagtgtttctggaatacatctgtctctcttcaaacgtcttcctggctataggtctctaccacggtactcacactattcagagtgaataatcatgctatgttgtgataagggacagttgaataggggtgggaattatttggagcattgatttcagaagtcagaacccaaagtatagcagactacatgatttgtttaattatttccctggtatattaattcaaagctacaagatatattattcagaaagcttagatagagtcaaagtaggaaggcatgaattcagcttttatttcagtcagcaaaaatgtatcaagctccaattgtagatcaggcagtgatacagctgatgttatagagagattcagagaggattccttctggggagaacccaccccaaggatatacggtaaaaatgagtacatagaagaggacagcaaggccactaaggagggatttcattgttctttcaattaatgatcctggaaaagtttcactccggttttagtttctctggtggtcagcaactgagactatagagtaaaatactgatcactgagatttagttttaaaaatacatatatatatatgttttttttaaatagaaagttattattccatggttcttggtgcttattaaaatgtgattcctattcattgcagaaaattgaaaaatagagaattgtgtaaaaaataaaacaaaaatcacatgccagctcattactcagaactaagaggcagaaacgttacatgctcaggctctgaggccaaatggcctgggtttgaatcccaggttcacatcttattagctctgtgactttgagccattgcctcatctgtaaaatcaggataagtagaaggatttaaacggtgtgatacttcccctccccgccgccgctctttttttctatgcaaaactggcttcatatttagctcaattgttttcttaccattaacatggtacacttaacaaaaatattttgttcatgtaatgcaagatgtccaaccttttataaagtacttctcaatgatcacactttgactttgccagatcacataaagggagatgtttaacttcccagtgaattctttatacttttaaagtgtacacttttattcaggcttcctgatgattcattctgaggctattctattttgctaaatgaacccaacaattcacatggaaattgtgaaagacagtataaaagatgatagaaaatagaagattagaactgtgagttctaggtaatgttaaattctcccttcgatgtagggacagattctcttttctctgtttaccagagaatcattacattactattgcccaaacacatttccacatgagatgttgttgtattgaaacaggagagttatctgacccccctcgcaggaagtgcaacaggggtgtggcttgtctgttctggctgtggctgctgctcaaaccccttatgggatggggaacatgcagacgggcaggtgcaggagccggggtggacacttttgggctccagccccacggtggcaactaaggttgtgtggctgaaactctggaagccccagtgggcatgctacagtgctcttttagctctgctgtccatagacagcttaagtattaaccagcttagtgccctcttggtacccgggttcttgtccagcatccgagaagaatcaggtcacatatggacttgaaggatggtggatacggggattttattgggtgatagaggtggcactcagtgggatggattggggggtggaaagggatggaatgggaagatgatcttcccctggagttcagctatcccacacccgttctcctctccaaccgtccccagccaaactcctttcaacattcagatgctccttttcttctctcctctgccaggctgctcttctgtttatctgctcgtctgcttgtagagcctgaggtttggggtttatatgggtacaggatagggagcatggtggatcaagaggcaatatttgggtgcaaaaacaggaataactgttcccatttagagccaccagtttccaggcttgaaggtggggcctttgtcagggacctgctgtctcctacgcagtatttacttgcctcctgtccatatcagtatgatgggtgagatggcaggctctattgcctgagagctggaatccagatcatacctattaaacctgtgctatcttaaagcaaaatcaggtctaattattgaagttcctcacagagttgggaaatgagtccattttaggtaaagactatcatacaatgcctgtatagggtaagtgctcagtaagtggtagacgatgttggtggtgatggtgatggtgatgatagtcacgatgatggtggtgattagttatatagagtgtaaaggatgaaacaaaggttagcatcaagcaggtctagctctgtagagttttgatactttgagatttgatgtctttttaggatttgggaaagttgtttaacttaatgcttgagtgtcttcatccataaaatggagaaaatgatatttctttgagttggtgtgaagattaaaggggaactgcttagaaaagggtttggcattaagtaaacactccgtaaatgttagctattattgtcattatttataagaaaagacattaatagtttcagtgaaaatagttaacaaactccttactcttcttaaggggattagaagaaaaatggttcatgtcataattaagaagatttactgaagaccctagtacaaagaaaaaaaaaactttgaaaaactaaaatgatagccaagttttaaaaatatcctttgttgtgagctcttttgagattcccttcctctgggataagaaaagaaaactgggcccctcttccttttcattccatgggggtttctctcccatatttcaaacacaaaataccattccttgccatctgccttgggctgacaatgccaaagaacctcctgtccaggttgttttcaagctgtaggtcggcaccataaatctcaataaatccttgtgggctgaggatgagtggaagtcattatcatggctcttactgatgcattctgtctacaacagaataaataccaccatgggacactgccctgcaggcaaagcatccttctggctttttgtgtgctttctccatcagcaagtcacaaatggaatgccttaatgtgtctattgtatacatttttgaataaataagtataacaaagagaatatgctggtccgatttaatcttagcacttaactatgaaaacacagcacatttcccacactggtgaaacggagcagaagaggcctataccagcttggttcttggcaggccatccagggtaaaccgggtgtgagccatgcttatggcttctagggctcagctccctaaagcctagattttccaactgcagggtgatcaggcaatgtagtggtgatgatacggaatttaagagcttatcacttgatatccttttgtttacaaatgacagaggctcaactcaagcaagcttaaacaatacagggaaaagttgagatgtaagcttcagatagggcttactcaagtttcccaaaggttaagaccaagatccaggttttctctatgcatttcccagcaggcatttcctttcatgagcacaggaaagctgccagtggctcctgaggctgaaaatgtgtttgttttcatatgtttggagtagagataagaattctgcgtttcagactgattgaaataacttaggttcagtacccatctctgaacccattgctttctccaggggaaggaattgtaccaatccgcttaggtctagacagcatgcctggacaggactagctcctcagaagcacctgggctgcctgagggaagggtgcagtccttcccagaaggaagatatttgtaccaaaagaagggagattggatatcaaagagaaacttctatagaaggtcagacagggctctttgttttctgaaagtggttgtgaaccttgaagaatggtgagaataaacaaaaattctgggctgcttcaaccttgtactatattctatgaaacccatttgccaaagagcttgtgctactttgaattatatttttatctttcattttttgtttgtttgttttttgagacagtgtcttggtctgttgcccaggctggagtgcagtggcatgatcatagctcactgcagcctcaaagtcctgggctcaagtgatcctcctgcctcagcctcccgagtagctgggactacaggcacacatcatatctgtctttttttttttttttgacatacagcctcactataagtttcccaggctggtctcaaactcctggggttaagcgaccctccttccttggcctctcaaagtgctgggataacaggcatgagccaccacacctggctgtatcttctcattttccattgttattcaatgacgtgtagaaaacaaaaaaaaggaggtctctgccttgctctcagaagtctagtaggaaacaaaattacccaaattacaaaacaaaatattaatagctgtctgtctgcctggttacctagagaaagatggaggaaaggaagacagtagctggcctactcactatactgtattgatgattaaatcaattcctactgccaccaacctgtagaattggaggcgtctgtccttacggcttttgatttgagctcctactgggaaaccatttgttttcttatttgttttgtttatggcttcttaatgtgtttgacctctgcctcccatctgacatttacggaagtctcttattggatctcacttttagctgccctagaaggtaactcttccatttgttttcctgggttacaaaaagagaattttctacacactccaaagcttacagttttcagactatcctttgtgtagcctagagtgctgatgtctgtcctagtcatttccagtgtagcagtacaaggatggcaaagtcgctgtgagcatttaattccacacacaaatagaaagctgtggattttatatgggtgatacaggtacctacaacatgtcatgggagaatggaggaagacatacttccctttgagaaggacggcttaatggagaaagtgacatttaataagtcttttataactgaattggggttctccaaaggtatgggaggaggtggcttcaacactcagaggcttgctggtccccgaaccagcagcatcagtattgcctggtagaaggtgagaaaggcagaatcataggccctaccctagacccactgaacagaaactggcatttcagcaagatcctcaggtcatccgtaagcatactcagcttaagaagcacaattctagaccagacagtctcagccttgaaggatgttggaatcactccagaagcttaaaagaaaaaaaaaaaaagatgccttggtccttcttgcaaggattccaatataatttatgttaggcatggccatcagtagaaaaaaaaatgcaaaatgaaacaaaacaaaatgctcttcaggtgattccagtgagcaaccaaggtaagaattagagctccatctgggtctcagcactatgagagaagcagcatggtgcactcaggggctcgtgggtaggtcagcagcctggatgttggacaggaaggtggctttggggctgggatggttgaacacgtcaggctggagagagagccaggtagaacataaaggccctgtttgcttcactcaatgcagaccatcgggtagatgacaggggctgtggaaaggtgtaaaaagagggatggggtgtcagccttgcacttgggaaggaccacctcaagaatgggccgtggcagggagaccagttggaagataagcctaacattttgcagattagcagggttggcttcataattggccaggcccagtgcaaaataaaattgtgggctgcttgtttaaaaagcaagaaaaatgtattcttaaaggtactaaaaggtaaaactttttccttctttctgtggtctctcttgactgttcatgatttttttatttgccattttaatattgtgctccttcagacacagggctgcacattggcccagtgcttaaggagccctgcccagttacctggtggggtgcgcagctcagcagccgcagggcttctccctcccactagccacaggaccgaggtgctgtgtcctggctggaggaggggactgaatctccccttgccaggggcttgctgtccctactcatggggcacagccagtctacaagggatttcaatctttgcatcaaataccaaatacttagtacctggatcagggtgggcgggaggtttgcccctgctaagtcacccactgaacatgctgtggcactgccagtcactcccaagccttgaccctctgcttgcctggcccaggcccagccaggtgccggtgaggtggggggcagggctctagttgctgggctgagtgcaggaggggaataggtagctgggaacaccctggggagatggaggagagtgcaactgtacatgaggcaagcctcaaccaccccctcctcacagccctcctctctccactcctgtgcatgccccattggcctctggacttcacttataaaacacaaattcaaagacacagttaagaattttaagacagccatgcctgcagaacactgaactccaagtgaccagcccttctgagagtaggcccctctgcaactacactggtcacacccataaagctggccctgcaggatggagatgggaggatggatttgagaggcattaaggacatagtcaaaccagagcatggcaatgttcagggaggaagatgttcagagttcattggagatctctggctgtgtgactgcatagagggtaacaccattaagatatatagggaaacggaggaaattattatggggatgggggcaggggcaagctttagggacctgagaacacttccttcgttccaacagagaatcatctgtcttttctctgatttaattgcataggctggtacttttagaacaaggttaaataacagaggagagtgagcctccttgccttcttctgactctaattagcctgctctgagtgttttatcctaagcatgatgctaaatttgattcacaaaggggtgcctacttctgttcttttaaggattgttttcagggatgggatttctgtccagtgtcttttaggcacctactgaacagatcccacagcactgactgttttcccatgctgtatagggtgtcttacatgaacagattttctgggatgtgaactggatgtcaagtggggattttttgtagtcccagatttaggggaggacaaagtgacaccatgcaccacaagttctagagttggctggcactaatttaaagttggaaatcctaccccaaccccctactcccactccaagcttatttggcttagaaaacgggcctgccttttgtctgccatgtgaacactggtcagggcctacccaacaagaatgtcagtattcatgcaaagaggtatttccttccaacagacacttttacccttaggcatgggtcatgctcctgtggtcccagctccttgggagactgagtgggaaggattgcttgagcccaggaattcaaggctgcagtgagctacgattgcaccactgcactccagcctggacgacagagcaagaccatgtcgaaagaaagaagagagaggagggagagggaaggagaggagaggagaggtggggggaagggaaggaaaggaaggaaagggaaggaaaggaaggaaacgaaagaaaaaaaaattgtttcatgtttctattttcattaagctgggaccactcaataatcttgttcacttgcatttctaggccaatcctcactgtggcatgctatgttgctttttcaatgtcctgctgaagtttagttactacatttcatttgagatcattgcatcaataatcataaggagaaaatatttgtgtatttctcttcctgtccacctccctcctactgtctcataagatggctatccagttatgctagaacacatacaaaataattaagctttccttttaatttaaacagtcaccaaatgtttgctctcaacttatgggcccaggtccatgtagggaaacctggtgcttgctggggcagggcaggtgggggatagggccactttccacctccaaggagaacaggatcctggtggagagccacagtcacgtgctccatccagccggggaacaggacactgtgaacagggccagtgccaaattcagtagctccctgggaccgactcattggctttcattttatctttggataaaatctggagaatctatataaagggtaaaaatctataaagggtgaaatacctcagtctagggtcaaaacgttttaagattctatcctgaccaaatatttttcaagctacagttttgtacccatttaatgaaaggcaagccaaacaagctctccacatgtgcaatcctgtggtcctcgggggatcttatccctgcgttcctccccatcccgcgtgcttgtttggagggagtatgagggaggcatggtgatcgctttcatcatttgctcaggaaagcccctctcggaagatagtgtgcggcaaatactctgtcttgtcacgggaggctgtcttgaaatcgcatcatctttttccctccagttcttcctctgtctgtagtgagtgggaaagggaggactggattatttcagttctggcaatggacacatcaaaattgcttccctctcccaactccctttccctcgaggacctaatttatttcacgcattttgacctatccctgcttagaaacaaccgctgtgattctctgctgaggcatttccctcctcgccttttttggcccccaggcaaacccaccaggccacagcccctctgactatgatgtcagcctggctgctgggcccagctggatggaggtgtgttttatgaagttcaaccctgcaccctgggccataaatacacattgtacacataaatgtacagctaacattgcccaggcccctccgaagcaccatgttaataagcagacagtaagtctttaaaatatggaaaagtagttaatctttccgctggcaatcttttgtagcggggggggcttttctcctctcagtgtagctgctttcagggcttttcaactcctaggatttgggaaagaaagaaggaaagttggctgtgggactttgaaaacaatgctatcttgcatttgctgtcattaagcatctgcactgagtgatcactctgggtctgtcctcaaggagtttgagctctaatcgttccagcacgagacagacagtctgctgcctgtggcaaaagaaccacactagcctgggctccggagggctgcaactttgggtttgaacctctgctctgccccggttactctaggtacttagttttttgtttccctatctgtaaaatgggcataattttatcttattcatatagctgtggtaagagtttacttatcctcgttgagtttcagttttctcttttgtaaaatgggcttgaccctcacagttcactttatacttgttttaagaagacattaatacattctccttgtagagaacttcagggttacagatggagttcaagtgtcccttgacagttactccctgtcacagtcctttcttcagaggtaaccactgttgctggtgtggtgtgtaaccttcctgacctttatttatacatccatgcattagatacatacatacatacatacatacatacataaagacagagcgatagatatataaagaatttatagaaatgtgtcttttttttgtactcactttatgtataaatgccaactacttaccaggcaagtaatcctagaggttacaaaacaaaaagccttaccaagaaattaagatgctcaaatcacttggctgattgaattcatttaaagcatatggctagaagcaaggggaaagaggacggaggatctccctccctgtaacctgtgttatgcactgttcctctattctcctcttctctctcccatcttcccttcctttcccttcccttgtctccaccctctcctgctctgtctcccactgatggtgtagcgaggaggaccacacttgagggtcctcagtctggaacagggcctaagcaggcagaaggtgcctgcagccagcacacacttgccttattggagaggtgcaagggcaagtgtgtagcttgcctgtaacctcctgagcagccacacatttatctgtgtgtctcaggcagagaatggatgttgccagtgagttaatttaaggatgagccaggagagagctatcatcaacctagagacaacaaggtctgtgccttaagaattgagcgcatttaattttacgtggtccttcccttccttcttctctataggaagacacttcatatgttcttcctttactatttctgttcaacttgcatacgctctacttattgagtccatttactctagtctaacatgagtcatgggtcacttaagtgctatctatacctaatacatcttataagttttatccatctcatttatttttcttgtttctctgtagcagaattaaatattcttaaatagtcctaaatattcttaaatactggtactttacgtatagttttacaacattattttcccactcaacgtcttgggtctcctttcatgacagtaaatagagatcctcttcaccctgtcacctggtgccaagaagaccaccgagtggacatattcttgcttattcaatcattgccccattgttggacatttaggtggggtttttgctttttctttcttacagtgaacgttgctaccaagagcatctttgtacatgacttcttgggttctgaacatgagtttactttactgagaagtaaaactacagagaaatagggtgtaaaagatttccactataataataacaaattgtcctcatagtagctataagtttcactttcccacctgtggtatagaagagtattcatttcttcagactttctccattatttgatattatcatagacttaaatttttacccatgtcctagtcaaatcattattttcacttatacttctctaatttttagtgagattgaacccgcttttacctatttgttactcatctgtgtttcctcttctatgaattgtctcacgagtttcgatgctggatatggcaagcaactgcccttcccttttttataaaacccaatcttttatgattgtccagactattctctatatttactcttctgaaagaatcctagaatcatgttctcaaattccataaaatatcctatttttattgaaattgctttgaattaaaaagttaattaagagagaaatgacatatttaaaatatgagtgttcctttccaccaccattgtacttccctccaatttttagctagtatttttatgttcctcagtaaatttgcatcattttcttcattaaggcatatgttttactagatttattcttgggccttttatactgattattgatactatcaatggttctttatttcacaaatatttttcgttggttattgccagtgtcaggctgtggttttatatgctgattatgtaactagccagcttgctgagttcttttattagttctagtagttggtcagtgggttcatgtgggttttctatgaacacagcaatatctgttctctgggtgattgattgggtagaattcacctgggggtagattctcaatgagcatttcagttttgttcatggcaattggtctgctcatgatttttatagcttggccaaatgtagataatttatgctttatccccaaaggcgtgttttctcttaagttctcagattgtttacaatgctatacataatggtcaccaaaaaatgttgaaaatgctcccgtatcttacaggttataatgatactttgtgacttaatttcttgatcatgagtgccaaagttaatttatgtcagtaagcttttaaaccagagtttgattctgttggttatcttcacagtttaattttttattcttctgcctttatcatttcaagttctgtcactgactcaacaaatacttactgagaagttgctctatcccaggcacaaccctaggtgctagagataactcacaacctcaggcagtcaggtgcagccctgttgccttggaaactacagtcttttatgaggggcagacagtaaacaagcaaggaagaagaggcagaaggaaagtggtgaagtcattggtgtccttggcaataactgattcagttggagtgatgaggactacagccttgttggaatacaatttctgaaggagggagatgtgtgaagagagagagttggagggagagagagaaggattatagataattatttttaggagttgtgctataaggaaaaacagagaaatggggtggttgcaggagggagggttaagagacagttttgtttttcctgagctgggagatgtgacagcatgtttgccaacctccaggaagggctagtagatgaggggaaccatttgtgcagcggtcacctatctcttcttttccaccagtcacatccttgaagaagcctgaaagataggctttgcagagggacattaatactcaatccagtggacaagggggaagacaatgtatagggcacaggtgcaggtttatcttcttatttttccagcttcttgatttgaaaactgagtcaaatatttgcgacctttatttattttttctgatgaaaatgtctaaggttctaccgcacaaatgtgaatctgggctattatcaaatctcaaggattgatgaaaggtgttttttaacttttaattttcactgtttatatctttttggtattcatttctaattggactctaccataaaagaagaatgtgtaatcagtactataggttctttggaatgtgttgcagttccctgtgtttgaaaataatttatattctgtgctgtttatatctgaagagttttgggtccatatttttaacagatcatgctttcagaaatcccttttgttatttctttcagttagtatactgtgatcattatgtgactaaagaatcatattttatcttgttagtggattataatactttttggtatgaactcttatttactatattttaatgatatttattttactctgaatatctgtatattactgctaaacctgaacctgtttctttttttgttagcatatttttgatatattttccccttctcctgtgtcattctgttttaggagtgtttgtggcaaacaaacatcataatgtttataaacccaatttaagagtctttgcccttttaatatgtgaatctaacaacctcacagttattgtgattggtaataattttaggcttatactggcagtcatgtgtctgtagggggtgtttaatttctcatgctatccatattgatcaggttttaaatactttttaatatttttcaatgattattcctaatttgaaaatataattttctataaatatctacagagatttagaatatagacactggcatacctttgactgactctcttttttcctcagaacttctttaaatattttactctgtttcttcatcttcagtactcccattgagcaactggttttattctcattctaagtaatttgtttctagggaagcttttaggattggtctgtatctttgatgattgatgataggaagttttttactcatgtttcagtgggctcactcattgaaaagaattggatttgttttttcagtgcaagaaatattttctcctttggatcttttatgtcatattttcatctcttctcctttattgttcatctggcagacacacttggcttaatcttctagtcagccatttgttcttcagagtgttttgtgatcttggttttgtacttgtctttgagactctgttaacctgccgcctcaaaggtggaaattgttggttctctgatgagagctagctatctcaggtagaatatatttatgttgatgggcaaaatccattcagtagaggccaactgctggagtaacattcttgcataggcaagaaagagtctagtgttaaagagggaaggtaaagaagatacagacagatatagatgaaattaattagcaaaacagcaagactgaatatttttctgaggccagatatagttctagacaagagtaggaagagcagagagtaggtgtcccagtgtggatagtggttaaggcattgaggaaacatctttgcacagtggcaagccctgtgaacataactgtggaatattagatgggcattgggcatttatagaaaagaaagaaaccaattgtgttgcagtctctctgagaggcattcatggatcattctcatggatcattcaacatatgaggtggcaacaggttaaaaaagggggagtccctttcccttctttataacgtcccataaagcagaagaacttttcttcattgcatgattttagttcaccatggtgatatactcaaaagaatggaacaaatttattgcgagaaaggcaaatgaagataaaactttggagaaactgacaattttgttaatttccatttgttaagttaaaatctattaaactgaatttaatgaaatattatgcgataggggttctaaccctggagttaaatatttagctaatctggttctggaagaatatgagattttgatccctcatttgttcctccaaagaaagagtcagtagtgttttgtgtttgttaaaggattattttatagtgtctttctttgtcacttcaccatgttgggcaatgtgagaaggaggcactgccaagcttgtttaagttggactaactatcctgatggatcagaaggtcagagcagatatacagccttggctctttcttatagaacttgggctctgggaagtgtgggacctcataaatgactagcattaatctcattcaaaacactgttcctgtatactgggcagacgttgtgcaaagcagtataaggaaggctctaagaagttcactatctcttttgccattggtatgacatagtttcagtctatcgttgagggaaggaggagagaaaacgccacttagaggaacatcaaatgtaacttggggtaatgtttaggctctgggagaaggaaattaggctttgaaagtctgacctcttaaaccttgggaacaggtgattcagccaactctgactcttgtgttttgtacatacagcacttcagtctttccaaggtgagttgtatgagccgcatgtcgtcatagctattgttgttttcctagtgaagctaggtatttgtaagtgaagagcctcatggagaaagaaggtaacattagtagtaaaatagtctccaaaatttgctttacaaaatatggtagttgctaccacccaggagagaagtcttcctcatggctctttaattgacggatggtaaatgactgcctcgctacctcttgttccaacaggtcctttgtcatccagcaaatcccaagcagcaacctgttcatggtggtggtggacagcagctgcctctgtgaatctgtggcccccatcaccatggcacccattgaaatcaggtatatccttttgtgtgcaggtccactcactaccacggaaaccagtaaggggtatcagtggtaaggaaacctgggggagaaatattagagaaggaaaattacatcctttccactgttggagagagagagtagttaagagagttgtcattgccaaattttgacctctgaaatgcagagtagaaaaaagcaatccttggaaacatgccttaactacagtcaacataatgaatcccttaagtgtgaacgtctaaaggcccagaagatcagaaggcgcccagaatcttgtcatggcttccatcctgaggtaagtctgagaactgttcctgtttccttttcccatcagaatcaccacgagagtctcacactggtcaaagaactacagctgaaaagttcactcatgagaaaataatccctttcattcagtaaactgaatctgcaccatcatctaggtcccagaagacttcgttcttacgttagagagggggagagaggtctggggaaagttgaaggtgtcctggagtctatttccgtctaaccaacccctgcctttccccataggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 1782 - DNA, 40357 bp, Homo sapiens
cgtagtgttaggaagatttatttccaaacagtggcctccacactgcgcggcagcacttctttttagtatttgtaagcttttgcccactttcaattgagccagccctagcgtggtatgtattgcatgctgaacaatatagagtttgtttttcctttctgatgattttaaactcttaaagaacaggaaagcatctggtaagaagaaatcatgagtccgtcagtgcccttactcatatgcgtctccagtggcctcatgttgtggtcacaggagtttcctgttcacagcaatgtgtgtgatatggacccagcatccactgtcgtgcttttaaactgattcctgggacatagcttaccactggaacagcagaccagtgttgcactgtttctaaagctaagcttttccttatttattttggtactacctaagtgacttggttttgactgtccctaagagagggaaccactttgctgaatttttaaaaagtccaactgctctttcatcttttatgcttagaaacctgttctctccagatgcacttctgaggcatggatgagctgagcgtatggctagaaattggaagtttacagctattaccagggggctaactcccggggcatcgcagtagcttctggcacccgtggcttcatgtctttagcaaagtcttgatgtcatggaaagagaaaaagtgtatgcagttagttacctgattttgtaaacaaacagtggctgacctgggcccttaaatcaccttcacaccttttagaaccacaagtggttctttttgactccaacaaaggaaacgaagttgaaaaagtcaagcccctgtgtactggggccggacttcccatcatttgagtgcagcactttagttcagaatctctgtgccatgtggttttttaaacaggaagattgttggttccttagtattaagatagatagtccctattttgagtggaatttttcatttgtaaggggtatgttccttctctgattcttgctttcctcaaacaggatactgcctgctgtaagaccatcctctatggttgtactttaataaacagtaatttttttttaccaaaaaaattgtattttgtttctacttccttgaaacctgctttccaatttaatttttaagtgggaacctgcacagtggaaataaaggcaccgtgtgtagatttacagatgtgcagattcatgtgtggatgatatgaaggccattcaaatacgtgtaaatggacattttcattcaagtatattaatgtagatattttaaagtgggttataagtttaacattgtctttaaaatagaagtcacagctatcttccagcctgtcttctctaggaacgctgttgacatgccagggctccgtctacactggaagcagctatacagctgtgaccacatcgagctttagccagtcacacttctggaactgtccgttcagtccatcccctagagcaagaaaggagaaaaagccagaatcagctaggctcattcacaaaccaggctccagagctctgtgccacagtagagcaaagctggggtttatgcaaaaacatgttctccagacccctgaagtcctatccgtgcatcctactttttgctacatgggggcaactgcaaaaacaggccgttcaggcggtgaggtgggtattcacatctccaaggcactgacggtgtcaggaggcccctgctgggtcagaggaatcacgattctgcctcagccctcagtctctggtaagctgtccatacagactgctgcacacgtcttgcccaccctttccccctttacatgggtgttggtaaaagctgtccaggaatggtctcaggcttacctccttccaacaattcagctgggtttaatgcctgatttaagatttatattcattctcctgtttttaaaatgcttgtataactgaagaccacagcatataaggaatgttttcttatgagttctcagtagaggattagatgctattttacttaaaaaccaaagcctgaagtaatgcttctgacatgtcataaaatcccaaacattaggccgggcgcagtggctcacgcctgtaatcccagcactttgggaggccgaggtgggcggatcacctgaggttgggagttcgagaccagcctaacatgggagaaacctcatctctactaaaaatacaaaattagccggtcatggtggtgtgtgcctgtaatcccagcttcttggggggctgaggcaggagaatcgcttgaacctgggaggcagaggttgtggtgagctgagatcgtgccattgcactccagcctgggcaacaagagcaaaattctgtctcaaaaaaaaaaaaaaaaaaaattcccaaacattcgctaatatttttaaatttacaaataagacacatccacttaatttccatttgggtctatgaaacagaagcaccagattttgctacatgggggcagctgcaaaaactggcccttcttgggcagcattgtgaacactgtatgtttgtttttagagacaggtcttgtttttgttcaggctggagtgcagtggcacaatcagctcactgcagccttgaactcctgggctcaagcaaagagatccttctgccccagcctcctgaggagctgcctcaacctccatgacggcgtgaactacaggcgtacgccaccatgctcagctaattttttttttttttgagacagtcttaccccatcatccaggctggagtgcagtggcgtgattgcggctcactgcaacctctgccaccagggttcaagcgattctcctgccttagcctcctgagtagctgggattacaggcgcccgccaccacacccagctaattttttttgtatttttagtagaaacggggtttcaccatcttggccaggctggtcttgaactcctgacttcatgatccgcctgccttggcctcccaaagtgctgggattacaggcgtgagccaccgcgcctggccctcagctaattatttttataaattttttagagacagggtctcgccatgttgctcagttttgtctcaaactcctggcctcaagcaatcccactgcttctgcttcccaaatcgctgggattacaggcttgagccaccatgcccagcctttagactgtgacttgtaatacctggttatgggacagatgtgctctggaaaagatttcagacagttcccccccttttttgactactcgttttggttcacattacaccttttttttgagatggagtcttgctctgtcgcccaggctaaagtgcagtggtgcgatctcagttcactgcaacctctgcctccagggttcaagcagttctcctgcctcagcctcctgagtagctgggactacaggtgtgcgccaccatgcccggctaatttttgtattttagtagagacgggctttcaccctgttggccagggtggtctggaactcctgacctcaggtgatccacctgccttggcctcccagagcagtgggatcacaggcatgagccaccgcactggccacattacacttattttttatggcaaggtgagaggtctgaaaagctcattgtgagccctccagccccttccttccactctgtacctgcttgtgccttgaggaccccaccaggagtgtgacgtgagcctttgccacccctctgaatggagcatgtctccaatagtaagctgctaaagctccaaaggactctgggtgctcttcgtcacctttacacacagctttctagctcacaacagcaaaaccaaacccgagcaggacagcctgtaacccttgtgctggcatcagaggcaggggccccgctgggcttctcaaccttccagagaaaagggcatgggcggcaggcagggaaggagctgacctcaagggttcttacatttctggctaagctcctcacgtaggtgcgtaggttctggttaataaaattcactgttgtgtgaaagacatcacggagcaaggacggcgtgtgactggccaccttcttggccagcagcagggccagcaccagcatggtcttctccttctccatgtctctagggtaggcctgcagcagctgctccagggcagtggccaggtccctgttccggtcctgcacagaggggcacacagaacctggtttactaatactcttccctctcaaaggaaagacagtccccagtatgaagaagcacttcaaagtacttattaagtatccagggctgctgggcggaaagaatgagaaacagttgagttctgagaggcaatggaaagggaagactgcaatcactccctgcagggggctcggtaagcaaacgcatgtgtggtgagcccatgtgcccactgttagacggtgatgggatacaagaagcctgggtcatccctgcgcccaaggcacttcgagtccagaactagtgaccacctgcgacgccttaggcccattttattggtgcagacctagctgaatggacaggaggaagggggttcctgggggacactagacagactacaaggctggcaaggaccgtcaggcggtcggcgcacatgcagagttacatgggagtgcgccagccactcctgcgttctaggcagctgctgggacatcacaggctggccccactgaacagaagcatgattggatttctaggaggtgaggacgcctgcattttcagctggtagagtcgaaaaagtggaactttctctcctctcagctcctaccgctacaggcctgcatttggcagttgggaggatgtagttctttccgctaagtgttctggggacacagtgccccggaccaatcttgtatccccaacagtgccaagcagatggtagagctcagaaagttgtgtggattccaaccaaggagctcagcagagcagcaggcaccactcccagggcttacggttctcactggcaccattattaaactccctacaaccaaaggaagcgtctgtttcttctgttggccaaacatgcttcgttcatcttttagaggcttttacccctaaactctttactctgatttaaggttcaggtttcctcgatgtcaaccagctgaaatcttctgcaaggcaatgaaccataccctacgtccagttacttcgtcagagttctggacctgacagtcacgagttgagtggcctcacgggacagtgggctgcctggtgagaggcaggggacaggcccccttggctcacttgcccgcccacgcggtcctcaggccctcactcacctcctccgaccggctggtgttcctgagctgcagggccaggccgttcaccaggcccggagggatgctacggtccatgctgtccccgacctgggcgaggtgcctggcaatattccggatgatgtcttcttgactttcagaatctgtgttcaggcaggggcggcagagacagagcagactcagaaaatgtccctgataccctctcccacaccaccctgccccgggaaaggacaggtccgcgatgggacaaggccagcccccactgggcacgtgctccactccaccagggccacagcgggcgggctgagtaccagcgctgagctgggttctgggcagtgccggagctcagggcctcggctgaggcccaggctcccgcacacaggcaccacgtccccacaggcagggccggtgaagctggggcatcacgaccacgcctgaggtacaagcctggcagcggcttcatggctcacaccacacaacccaacagggttggccttggcctgggcagccgttggggaaggggctctgtgggcagacggcatcccagacccacttttgccctctcaagcctgagagcccccattcctcgcagtcccgtctcaggaaaaccccagttgtcactggcaccggcaaggccctggagaatctcccctgcctttccaaccagagctctcccccttgcccctcagtcctcctcctctggcgcacagcctccgtgctgcccctgcccgagtaccactgtcgcagctccatgaaggccacgctcaactgccacgctccctgccgcctccgtttcttcctcagcacttgctgtgttattgtctgacgcccctgccagaaggtaagctccctaagggctgtgatttttttaatctgttttgtccactgacaaatacccagcacttaatacatggcactcagtaggtgctcaataaacaatggcagggaccaggtgtggtcatgcatgcctgtaatcccagtgctttgggaggctgaggacagaagattgcttaaggccaggagttagaggatgcagtgagccgtgattgcaccagcaacaaagcaaggccctgcctctacaagaaactttttttttttttttgagacggagtcttgctctgtcacccaggctggagtgcagtggcgcgatctcggctcactgcaaccttcgcctcctgggttcaagcaagtctcatgcttcagcctcctgagtagctgggattacaggcgcccgccaccacacccggctaatttttgtattttaagtagagacgggtttcaccatgttggtcaggctggtctcgaactcctgaccttgtgatcctcctgccttggcctcccaaagtgctgggattacaggtgtgagccactgtgccctgcctctacaaaaaacttttaaagggagccaggtgtaccgcacgtacctataatcccagctacacaggaggctgaggtgggaggactccttgaggccaggaattcaaggctgcagtgagctgtgatcataccactacactccagcctgggcaacagagcaagaccccgtttcttaaaaaaagttttaattgcatgaatgaatgaatgggccctgtacctagctcccagtaagtgttcaatagatgccagctattgttatttctcccattaaatcttctattttttctgtgcttgcaacttccctctggcttttttggttttggctgctgctcccaccctcggtcagctgtcaaatctcaccttatgttgcaaatacaagcgttttgcctaccctctgccattgccgccaccctggtgggggtccccttagctctcatctgatgatgacagccccactccctgccgtccagtctactcggccaccttcacagcacagacctcagagcagggcagggttgggagaagtgacgtgctaaggagtgggcacgttcttagaagctgtgctctgggggtttcacggcctccctggagtctgtccatggaacatgcagtaaggctgccacatcacttctcttcaaaacctctcaagtgctcatctctgcttaagtgacaagtcatgacccagcctgaaagtacgtctgacttaacttccacgcttcctaggcaaactcaactactcactgtagcttttttttttcttttttttttcaagacatagtctcactctgttccccaagctggagtgcagtggtacaatctcagctcactgcaacctccgcttcccgggttcaaacaattctctacctcagcctcccaagtagctgggattacaggcacccgccaccccgcctggctaatttttatatattttttttagtagagacggggtttcaccatcttggctagggtggtcttgaactcctgacctcatgatccacctgccttggcctcccaaagtgctgggattacaggcgtgaaccactgcacccagcctcactgtagcatttatagccgctgggcttttgcttaaaagatggccattccctcttcccagtttccaaggaaccaaacatacccaacccccaaggcccagctcaattggagctgcagccccaaagttttcctgattccctgcagagcagagcacccagctcctccagcacctcatcactcccccagcaccgaatctgtgcctcgctcgttcccgaagcttatccaccttgcttcagttacggacacgtcctctctccctctggccaccagccgagtagcaacaggaatctttcctgatccgtctgtgtccagccgagtgaacggactcaccaaagaaaccccggcagccagagcctctaccttgcccctctttccaggctcgccagggactagattcacagtccctgtcacctgcaggctaagtgaactgccatgatcacttttgcaggtgccacttgagtcaaccccggtttctcagtctagaggcaaaggccggcatggagaagagcgagagaaaaacaccagggcagactggggctacagtcacccccacagcagtgctgacagcagagctgtgcctgtccactcctgcccttcctggaccttcccaaagggatctggggtttctcctcagttcagggcgagccagaagatatgctggctggattagaaggcagagacattctcagacacctccccccaccccccacccccacccccaccccggtctagtggggaactccagccacgtcctcaagcacctgatctaagacaggcgggaggcagaaggctgggtcagctgttggtctcccccacagccaccagagggcagtgcaacccttgagcttggaaggcctggaccagggtccggggatccctgcaggctttcagggcagggattctacctgcgtcagaatcctctgggcagtctcccgccctaaaacagcctgatgcaggcagctggagtagggcccaaggcctgcatttggaaaaggtttctcgtgtaattccaatgtgcacactactgaaagccagcgtcgcagggctggatctggaagtgggtgagcctccactcgcccccagcctccactcgggacagcccctgtccatagaagcagccccttggcaaaggggagtggagctggaggctggaggagagtgcagggatcagcaacaggaaaggtgaacagtctggaaaccatggtgacctggagtcagtgccctacagtgggagggcggctgaggcccacctcaagaaggggcctggccccatgtcccagtggtaacatggccacaagctgtgtgatctggagctagtcatttaccctttgctggacctgggtttcctcacctggaaatgaggttccaaatacttctgtgttcttgtataggtaatcacggagcataatgtatgaaaggaaatatgtcaggtatagacagtgcaaaagtcactgtgaaaccagtgggcctcaatcaatgggacagtcagccaggcctgcttggggaggcaggggccgcaccggtagtgccacctgggggctttgcccagacccagcaatgcccagaccaaccaatcagaatctctggaggtgagatgcaggcaccagcatttaaagctccaggtccttgaaatgatacaaggccaagtgtgagaaccccttgggttatataatccagacaagtggtctgcaatctttgtatcagaatcacatttggaaaattggataaaaacaccattctatgttggtccagacaagggactcaagaccagtacatgagattctgtctcaacagaaaggaagaactttctaacagagtcacccaaaaatggtaggcagtgagttcagcagcactggagggaatcaagtagagaccagtcaagtgattaagtgataccagcgtacgtggcagctgaaactgcagaggcagagtgatcccgggggtcccttccagccctgaggctccctgaatgttactggcgacagagaagcccagctttggggaaggaggtggggccggccgcctacctgcctctattcttcccaagcgggagtggctgctgcggttgccatcagtctgcagctcatcgtagccctcccactggggagccagcactggcagctcgtggcccagtgcgtccagctctctgcggaagctgttgtcagaacagctttggaggaagccaaacaccagtaggtttgtgatgcactcatccctgaggctggaaccgttgttgacctgaggggaaaggggagtcaggaagccgggacttcagccaggccagaggcccctcctgcaaagagctccagttgcagctggcccaaagagcctcacaggtcccagagagctgagggaccctgtgggctggagggccctgcaggaggtctcaacaggcagaggcaaggtctgcagccacagctttaagcagcactgcccgtagatggcagggagcgagccccgactctgcagaaagggattcctctgcagaggaatctgctggacctcctgaaacacgcggctggggagcttcccactaggtgagaaggccacaggctgttccggggaggcgagcgagtgtcatgcgggcatcatccgccatcctgtgctggcacgctttcttcaagttcccctgcaggcttcagcaatctgagcccacctttcctggctgtgcttccaacaggcggagcctctttccgctcatctccttcacgggctcaggagggtattgggcagatggaagattttcagtaactactgcggagtggtgaccacagctgggcacctgcctttggccaagcttggtttactttgggtgggtgtgtccttaatccgaatcccacagggagtggtggcactggctcctgctctacccagaggggctgggctcttggccggcagctctccagctccctgggcagcactggcagctgcagcttggccagcatctgtgccgccagagatggcagggactgttcttggggtactgactgtgtttgggggctgtattcttacaggcaaaggtgagccctgcagctgggtgtgcccagaccagagaaagacctaaggtggaagagagaacaaaacacaaagaagggcagggacgctgagatctgcgcagattcacacaaaaagacctcctgggctgccagagaagggtgggagggaagatggaagtgtaggcagaaatttatttctattctctaagtccataatatttttcattagaaaaaccaaaaacttttagaggacagttcttacagggcaaattgtttttttgtttttgtttttgttttgagatggagtctcgctctgtcacccaggctggagtgcagtggtgtgatctcggctcactacaacctccgcttcctgggttcaaatgattctcccgcctcagcttcctgagtagctgggattacaggtgtgcatcaccacgcccggctaatttttgtatttttagtagagacgaggtttcaccatgttggtcaggctggtctcgaactcctgacctcgtgatccgcccgccccccaactccccccaactccttggcctctcaaagtgctgggattacaggtgtgacctactgcacccagcagcaaattgttttaatgctttgctaggtgatgcctgtaatcccggcactctgggaggcagaggcaggaggatcgtttgagcccaggaatttgagaccagcctggcaacaagatccccatctctacaaaaaataaaaattagccaaggtggcatgcacctgcagtcccagctactcatgagactgaggcgggaaggtcacttgagcccagaagtttgaggctgcaatgagccatgatcacaccactgcactccaacctgggtgacaaagtgaaaccctgtctcaaaaaagaaaaaaaaaatgcttaaaataaggagcttggccgggcgcggtggctcacgcctgtaatcccagcactttgggaggccgaggcgggcggatcacgaagtcaggagtttgagaccagcctggccaacatgatgaaaccttgtctctactaaaaatacaaaaattagccgggcctggtggcgggcgtctgtagtcccagctacttgggaggctgaggcaggagaatcgcttgaacccgggaggtggaggttgcaatgagccgagatcgcgccattgcactccagcctgggggacgagagccagactccgtctcaaaacaaacaaacaaacaacaaaaataaataaataaataaataaaaataaggagcttgtgtattgctgcagccataaaaaagaataaaatcatgtcctctgcagcaacacggatggagctagaggccattaccctaagtgaactaactcagaaacagaaaatcaaatactgactgttctcacttataagtgggagctaaacaatgggtgcccatggacacgaagatggagagagcaggcaccgggcactttacagtagggaggcgggggcgggggagcgcagaaagagtccctctccatgcgataccggaagcccagtccccaccagtgcacaatattcccatgtgacaaacatgtacacgtgcccctgaatctaaaataaaataaaataaggtgcttgtgtattgctattcagcctttacttctccaaagttgtttctgaagagaggaaaaactgtatgcaaaattccactgcatcaattcctaacaattcttgtacggagcagccgcatggcacaagacagcttacaaacaggatgtgcttcattcctgcctcaagcgacagtcctggtgacacagttagtgctgggctaagctgtgtcacccaaaaagaaaagcgcaagtcctaaccccaagtacctgtcaatgtgaccttatttgaaaataaggtttttacagatgtaatcaagttaagatgaggtcatattggattagggtgggccctaaatccaatgactggtgtctttgtaagagaaaggagagggagatttaagcagagacacacagagaggacgccatgtgaagacagaggcagccacaggagccaggagagcgccccagaaggaagcagccgggcaacatgggattccagcctttgggcctctagaaccgggaggggatccgcatctgttgtttaaagccactctcctgcttggaaccgcctacagcagccccaagaagctaacgcaggcagccgctgcccaaggacttctttttgacctgcgcttggtaaattggcatccagaatctggacacagagcggtgctgccaccacagcaggtcaggttatcaaactcaagatcccacagaaaataaagactcgaggcggcagggagggagaggaaagaatggcacctgccagaggaggtctaggtgccgcaagtgaccgtgaagccaagcactgggcccactgagtggacagctgtgtggacaggctcctgtctggaccagtgcctcagggacaggctgggccggccctgcaggacaggagtgggctcggaagatggatgccatttaattccaagaatagggcttgtgctgtgccaatatggaatcatgcccttttttgatcttctagatccactttgtttttggagacagagtctcattctgttgcccaggctggagtacaatggtgccatctcagctcactgcaacctctgcctcccaggttcaatggattctcctgcctcagcctcccaagtagctggggttacaggcacgtgccaccacgcctggctaatttttgtatttttagtaaagatggggcttcaccatgttggccaggctggtctggagctcttgacctcaggtgatctgcccaccttggcctcccaaagtgctgggattactggcgtgagccaccatgcccagcctctagatccacttttgataaaagaattgatagttttttatctttttagatcacaggaaaaaaatatgttaagagaaacgatcaagacagtaaatcctgcaagacatgttacaaaaatgatctaatggaggcaaaaataataagatcagttccagtggaaaggaaaagatggtgctggccgggcgcggtggctcacgcctgtaatcccagcactttgggaagccgaggcgggcggatcatgaggtcaagaggtcgagaacatcctgggcaacatggtgaaaccccatctctactaaaaatacaaaaattagccaggtgcggtggctcacgcctgcaatcccagcactatgggaggccgaggcgggcagatcgcgaggtcaggagatcgagaccatcctggctaacacggtgaaaccccgtctttactaaaatataaaaaattagccgggcgtggtggtgggcgcctgtagtcccagctactcgagaggctgaggcaggagaatggcatgaacttgggaggcggagctggcagtgagcggagatcacatcactgcactccagcctgggcgacagagcaaaactgcgtctcaaaaaaataataataataaggccgggcacggtggctcacgcctgtaatcccagcactttgggaggcccagacgggcggatcacgaggtcaggagatcgagaccatcctggctaacacggtgaaaccccgtctttactaagatacaaaaaatgagccgggcgtggtggcgggcgcctgtagtcccagctactcgggaggctgaggcaggagaatggcctgaacccgggaggcggagcctgcagtgagcggagatcgtgccactgcactccagcctgggcgacacagagactcaatctcaaaaaaaaaaataaaaataaaaaatagaagtatctacacagaattaaagttatgatgggaaaaaaggctgaaccctataattgaaaagaaagtttcggagtgtttcgctgtgaccccagctctgtggccctgggcgggctgccgtactgctgcctccgcttcctcactccgaaggcaagaaaggggagtggcgacgtccaccctccctcactgagggggccggggagaggcgggcgggagggcaggcgcctcctccggcgagtcagggcgctgcgcgggtgacggtggtgttctacctgcggaggccgccagagcgcgaagccggaacagcagcggcaggtgggaagggacagtggcacccagagtggtcttttggacactgacaacaagcctggatcagggccgggggagctcctgcaatctcctctgtttatgtaactaacatcaaactcgagccactgcctcagccctccagccaccacgctgaaatccacaccgtccccacctttggaaaggacccccagtaggggcagcttgagaacctcctgggtgccgggtgctctccatgctcaggaactgcgacacagtcactaagtgccaaggcattagacttcgcagatgccttcccagaggctgccaggacagcgtgaggcgcccagaggctgcagaattcggcaggagggaggggaggaggatgtgatgcagcgggtgggagagagcacccgtgtgctgtgatttttctctccccagaccatttaaagggaaggagagacaaggaagcatccagggagcgtcctgctgaaggcgggggctccgggctcccctcccagaactccaccgcttttatctttataaagacggggtcttactatgttgcccaggtttgtctcaatcaaactcctggcttcaagcaatcctctcgcttctgcctcccaagtcactgggattatgtgcctaagccacctcgcccagctatgaagggaaatttaaatccagtgggttaaaaaatttttgaaacaccttacagtttacagtacttttatttgacctttattgatttatttgctcctcatagcaatggcattggttagacaaggtaagtattgtcttgcttttacagttgagagaattatatgaagtgcttatctaatgccccctttcttcttcttaaatctctttcgtgtttgtttggacagggctgcagtgcagtggcacaatcacagctcactgtagcctcgacctcctggcctcaaggaatcctcctgccttggcctcccaaagtgctgggacccacagcctatggctgttaaatggtcttaaacccaaagccccctcgcccttgcagttagccccaggcgcggtgtggaggggctgcaccacaagcggagtgcgaggaaggcgcaggacagggaaaggtaggacttcccggctcccgcctgcttcagtgaaggggctgggcggggttcgtctgtgccgagctgtggtaagggccaggcgggctcagcctcagccctcagggatgcgtggtgggggacacgcaggcccttacccctcgaccccgccccccacaaggcacccgcaggggatctggcctctgacctcacagtccatggcctgggcagcgcggcagctccgactcactcctggttcacagtgtcccagtggcgacctggaaagggacacacagagtgggcggccgctcctgggaagccctggtcaggacccctcgggaggacgacgaagctggcctgtgctccagaaatggcggctgagccgaggtcctggcctgagccccgcatcctgagtttctttctccttggcgggagccaagctttgttttcctcattccagatactcacccaggcgctcagtgccctggggccgaccccgcacctgaattcagccctcccatgccgccccaggaagacctcaggcatcagggaaacggggccgtgggctcacaaattattttattatcataaaatgtaaaatgtttatagagagagagaatggatttgacaattaaaaaattaaatcttccggctggacgcagtagctcatgcctgtaatcccagcactttgggaggccgaggcgggtggatcatgaggtcaggagatcgagaccaccctggctaatgcggtgaaaccctgtctctactaaaaatacaaaaaattagccgggcgtggtggcgggcgcctgtagtcccagctactcgggaggctgaggcaggagaatggcatgaacttgggagggagaggttgcagtaagccgagatcacgccactgcactccagcctgggcgacagagcgagactccatctcaaaaagaatgaccagtctggccaacatggtgaaaccccatctctacaaaaatacaaaattagccaggtgtggtgatgcaagccctgtgggcccagctacttggggggctgaagcaggaggatcacttacacccaggaggtggaggctgcagtgagcggagattgcaccactgcactccagcctgggcgagagtgaaaccctgtctcgaaaaaaaaaaaagatctgtgcggcatcagtacagtaagctgtcttaaaaagactgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaagactgaacacaaatttctacagaacactgtgaatagaataatcctgttttaaaaagtatttgcctgtgtgtgtgtgtgtgtgcgtgtgtgtgtgtagacacaatatcaggttgaaccaaatgaaatggccattttgtaggacaaaaccaagcattggcaatttcacatggttcctgaatacataggaaataaaaagcaaacagaggagaaagcctgtgcccaggcagagaggaggtggcaggaggtagcactgacatgcgcatcacccacctccccacctgggggctcacacaggcctggggaccctgcactgttgcaggctgcaccctactctccctctggggagcccaggagaaaccctggctgtgtgtggccgtgcatttcataggaagggaccaagagcaaatgactgagctgcatgtggacagggaggcaccaggatctggctccggggccatctgccggctccacagcagaggaaggggagtctgcacccacaagagacaaagcgcaagacagaccccaccccaggaaacaggccacagaggccacggcacctcccagggccactgcccagtccacagaacagtggaccagaccctagcttctgcctcaaggtctggaatccccgcccctcaccactttgttctccaaggaacaacttcaggggtctctgtggggaaagtgcccactgtcacctctgagctcgggaggcagctcacaaaaaccagcttccttcacactcagatacacgcccatgtcacaagcaaactgcagccaccttggcactgtggtgagtctcccaccagaccctaacgccgtgtctcatgcagtgtttctctgccagggcgacttggatacccaggaaatatctggagctgtctggagacatttatggggggtgtgctcctggcacgtagcgggtagcagtgggggcacggctcatcagctcaaacccacaactcatccagctcaaagtgtcactagtgctcagggccgaagtcccataccagtgtgttcaaatacatagcaaataccactaacccataccagtgtcatatgcatggcagaatacccactaatccaaactggtgtgtcacatacacagcagaataccactgacccataccgatgttgtcacatcatggaggaataccactaacccatgctggtgtgtcacatacacagtgaataccactaaccccagtgttgggcatgtgaatagcttagcattgtcaccactaaagacagggctgtgatgagtaccccaatgggacattttttttttttgagacggagtctcactgtgtcgcccaggctggagtgcagtggcatgatcttggctcactgcatgctccacttcccgggttccagggattcttctgcctcagcctcccgagtagctgggactacaggtgcccgccaccacgcccagctaactttttgtatttttcgtacagacggggtttcaccgtgttagccaggatggtctggatctcctgacctcgtgatccgcccgtcttggcctcccgaagtgctgggattacaggcatgagccaccgcgcccagtcttttttttttttttttttttgagatggagtctcgctctgtcacccaggctggagtgcagtggcgcaatctcggctcactgcaagctccgcctcccgggttcacgccattctcctgcctcagcctcctgagtagctaggactacaggcgcccaccaccacgcctggctaattttttgtatttttagtagagacggggtttcaccgtgttagccaggatggtcttgatctcctgacctcatgatccgcccgcctcagcctcccaaagtgctaggattacaggcgtgaaccaccgcgcccagccccccaatgggacattttctatcaaatccatgatcatatgggataacagaggggcaaggtgttgtggcagtctcgggagaggacagagtgagggcagctcccctgagctgtgccttgaggccacacggcccagaccctgggggccccatcccttgggacatgaggccgcctcccctaggcaacggtcttggagggctttaggagcagggagtggcattcctaggcctggctggtcaactttaggtggagcaccagccctgcatcgggtaacctctggcttcatttgtcacttaagaagaaatccaatgagtcaactgcagctgtgagtgggcctaggagggcgtggatgcagacgccctggaaaccacagaggctcccccgtcaatagcggccctacgcccatcccaactcctaaacaaagttgctagtaagaaggaaactcacgcagccaggagttcatgccctctctcttccaagggccagtgggaagacggccaggcagatgggaaacgggaaataccctgcctcacctcagtgaggctgccctcatgccaggacactcacagccaggttccccaaggccctcgcagtgagcagggtgaggtgccgagccctgcatgtgccattcccccagtctccaggactctgccagatgggggtgacattcccctagtctccaggactctgcaggactggggtgacattcccccagtctccaggactctgccggacaggggtgacattcccccagtctccaggactctgccggacgggggtgacattcccccagtctccaggactctgcaggacaggggtgacattcccccattctccaggactctgccagatgggggtgacattcccccagtctccaggactctgccggatgggggtgacattcccccagtctccaggactctgccgggcgggggtgacattcccccagtctccaggactctgccggatgggggtgacattcccccagtctccaggactttgccagacgggggtgacaaataccatctctgacaacaaggaccccagcaggcaccgccaggcccctccgcaggcctcccctccaatcctcaccacggcctcgccaggaaggcgcttctgccctggtttcggagacacgactgaggctccagggtgcccagggagggcagggggcagcttcgctgctgctgagccagggggcgccaggccctcacgagtatgctcagatgccagctttgcttctgaggcctatgtgcctcccatgcactctggaagccaaatgtcctggaactcattgaaaacaccatgcagttggtcagatagaggcatgggtcacacggggacaagcacagcacacaggtgctcccagaagaagatttttaagggccagatatctgcagggcagtcctctccttggtcaacatcatccctgtcttcctagtcccactcacaggaaacagctgactcactgaatttcttttccagtttttttgtttttgtttttgtttgtgttttttttggagacagagtctcacctgtgtaacccaggctggagtacaatggcatggtcttggctcactgcaacctccgcctcccagattctagcgattctcctgccttagcctcctgagtaactgggactacaggtgtgtgccaccacacccggctaatttttgtatttttagtagagacggactttcactatgttgggcaggctggtcttgaactcctgacttcatgatcgcccaccttggcctcccaaaatgctgggattacaggcgtgagccaccgtgcctggcctgaatttctttttttcttttcttttttttttttttttttttgagtcggagtcttgctctgtcgcccaggctggagtgcggtggcacgatctcagctcactgcaagctccgcctcccaggttcacgccattctcctgcctcagcctcccgagtagatgggactacaggtgcccagcaccatgcccgctaatttaggaacatcgtgctgctctaggaacgtcgatccacccaccaaacttcacagcatgctccgtgcagtgccaaggaaagctccaacccggaaatgtgaacacacatggaccatggcctagattggtgacccagagaaggggcagtgccatttgggtcagggctgaagaatgcccaagaattaatcagaaaaggagaggggtagggaaaggaattcctgacacttcacttttttgtgccttggtgtcttcagaaaaataaagggtttggaggccgggcgtggtggctcatgcctgtaatcccagcactttgggaggctgaggcgggtggatcacgaggtcaagagactgagaccatcctggtcaacatggtgaaaccttgtctctgctaaaaatacaaaaattagccgggtgtggtggcgcgtacctgtaatccagctactcaggaggctaaggcagaagaatcacttgaacctgggaggcgggggttgcagtcagcagagatcgcactactgcactacagcctgggcgacaagagcaaactccgtctcaaaaaaaaaaaaaaaagaaaagaaaaataaagggtttggagaaggtgatttcctttttggttttttgtttgtttgtttgtttttctgagacggagtctcactctgtcgcccaggcaggagtacaatggcacgatctcggctcactgcaacctctgccttctgggttcaagcaagtctcctgcctcagcctcctgagtagctaggattacaggcacacaccaccacacctgactaatttttgtatttttagcagagatggggtttcactatgttagccaggctggtctggaactcctgacctcatgatccaccctccttcggcctcccaaagtgctgggattacaggcgtgagccactgcagccggcctgttgttgttcttacgtgaacacatgtgaaaggttttattaactcattttttaacaggggaaacagcgatgttaaaaccattcaaaggagtccaagaactgtgtgcgcaggcaacggggaaactggaaatgcgttgacaaactgacgcaaaactgggcccaacagccacaaggcactggtcgttttccactgggcaaagttcagtcgcatttctttctgttctctttctttcttttcttttttctctttctttctttctttctttcttctttctttctttctttctttctttctttctttctttctttcttttctttctttctttctttctctctctctttctgtctgtctctctctttctttccttctttccttccttccttctttctttccttcctttcctttctttcttttttttttcttttttgagatggagtctcgctctgttacccaggccggagtgcaatggcacaatctcggctcactgcaacctccacctcctgggttcaagtgattctcctgcttcagccccccaagcagatggggctataggcatgcaccatcatgcccagctaatttttgtatttttagcagagatggggtttcactatgttggccaggcgggtctcaaactcctgaccttgcgatccgcccccctcagcctctcaaagtgctgggattacaggcgtgagccactatgccggccgcaaaggattctttaacacaaaagggcaggactcatgagactgacctgaccattacatggtgcagtgagagttcaatttaactaagcctccttatgcttctttgactaatttagggccatgcagtgtcaaacagcaatgagggcacaaaagcagcttctccctggctatcttcagaaggaatcttagattgcccttgaacaccatcaacaatctgctatttggagggctggaaactaagcctaagaaaccaccaggcttcggccgggcacgctggctcatgcctgtaatcccagcactttgggaggccagggcaggctgatcacctgagcccaggagttcaagaccagcctaggcaatctggtgaaacccagtctctataatatatacaaaaactagccaggcatggtggcgtgtgcctgtagtcccagctactggggaaggattgcttgagcccgggaggtggaggttacagcgagctgagatcacgccactgcactccagcctgggcaacagagcctgaccctgtcccaaaaaaaaaaaaaaaaaaaaaaaatgccaggcgcagtcgctcatgcctgtaatctcagcactttgggaggccgaggcgggcggatcacaaggtcaggagatccagaccatcctggctaacacggtgaaaccccgtctctactaaaaatacaaaaaaattagccgggcgtggtggcgggcgcctgtaatcccagctactcgggaggctgaggcaggagaatggagtgaacccgggaggcggagcttgcagtgagccaagatagcgccactgtactccagcctgcgcgacagagcgagactccgtctcaaaaaaaaaaaaaaaagaaaaaaagaaagcaattccagcaggtttctcctgtagtgcctgtgcgagtgaagcccacccaaaggtgaggcgagggtgtgttctcagagctcccaacagcaagggactcggccgctgtcactcgcgtttgcctgggagaggctccaaggaaagctacccatcgatccgttacgtgcacctatgggttctctacttggtctcaagttggatggaagcagagacaaaacttcaggaagctgccagtcaatcaagccctggccatgtggggctgacagcatagactctagttactgcatggcttcccggatggttgctagtgacagcacccggctccacaagctggcctgtggcctcctggggggtccttgaaggtaacggggtccagtcatgtctgtttgtacattcagtctcatatctcttttattcaggtccctcaaagagcttaagttccccagctgctggcaagtgaccttcctgccacgctgtgagctggggccgagctactcttcccaggaggccgagacctcgcaggcactgactccacggtcgcctcagttcctctagaagtggctggtcagcatccttcacaaatacggcattccagggaaggccctggccgcactaggaacttatccagttatattttagtttgagaaaaggcacagacgccagtccctcaaaaaattaaacctagaactaccatttgacctagaattcagcttttgggtattacgctgaagaactgaaaagtagagcctggaacacacatttgcacacccatgctaacagcaaacaaaaggccaaaatagtccagatgtctaacagatgagtggaaaaataaaacatggggtgacatacaattgacacacgctacaacacagatgaacttgaagacactacgctgggcgaactaggccagtcatgaaaggacaaatacatgtggttctatctccaaggggtgcccagagtagtcaacttcacaaggatcagaaagtacaaaggcacctgccaagggctgggggtggcaagttagcgtttaatggtaccatttctgttttgaaaggtgaaaaagttctggagatggttggtggtaatggttgcacgacaatgagactgtactgaatgccactgaactgtacgcttaaaaatgcttaaaatgggaaatcttatgctatatctattttaccacgataaaaaaatatacacttaaaaaagagccaggtgggccaggtgtggtggctcatgcctgtaatcgcagcactttgggaggacgaggtgggcggatcacaaggtcaagagatcgagaccatcctggccaacatggtgaaaccccgtctctactaaaaatacaaaaattagctgggcgtggtggcgcacacctgtagtcccagctactcaggaggttgaggcaggagaatcacttgaacccgggaggcagaggttgcagtgagccgagatcacgccactacactccagcctggcgacagaaaaagactccgtctcaaaacaaaaaacaaaacaaaaaaaaaaaaacaaaagaaccaggtgtgggctgggtgcggtggctcacacctgtaatcctagcattttgggaggccaaagcaggtggatcacttgaggtcaggtgttcaagaccagcctggccaacatggagaaaaccccatctctactaaaaatacaaaaattagccgggcgtgcacctgtaatcccagctactcgggaggctgaggcaggagaatcgcttaaacccaggaggcggaggttgcagtgagccgagatcatgccactgcactccagcctgggtgacagagtgagaccccgtctcaaaacaaacaaacaaaaaacagagccaggtgtagtggtgtgcacctgtaatctcagctcctcagaaggctgcagtgggaggactgcttgaaagcccaggagctcaaggccagcctgggcaacatagtgaggccccaactctaaaaattattattattattaaagtttaaaattttttaaatttcaaatttcaattttaaaaaggacagattcttactgaacctatgcaaataactatatcaccacaaaaaataaggagacagtgagaatgggggttcactgagaaagcaatatcatttaaaaatgtttcggccgggcgaggtggctcacgcctgtaatcccagcactttgggaggccgaagcgggtggatcacgatgtcaggagatcgagaccatcctggctaaccctaagtctctactaaaaatacaaaaaattagccgggcgtggtggtgggcacctgtagtcccagctactcaggaggctgaggcaggagaatggcgtgaactcgggaggcagagcttgcagtgagccgagattgcgccactgcactccagcctgggcgacagagtgagactccatctcaaaaaaaaaaaaaaaaaaagtttcatatctggccgggcacaatgactcatgcctatactcccagcactttgggaggctgatgagggcagatcacttgaggtcaagcgttcaagaccagcctggccaacatctctactctacatcccagctctactaaaaatacaaaaacttagccaggtgaggtgatgggcaactgtagtcccagctactcgagaggctgaggcagaagaatcgcttgaacccaggaggcgggggttgcagtgaggtgagatcgcgccactgcactccagcctgggtaacagagcaagactctgtctcaaaaaaaaaaaaaaaaaaaaaaaaaagtttcatatccatctaccagagcagagcctactaaatcatcacggattacagacactaagaatgagaaagcatttcctcttacatctagaaaacagaaatgaacacatcagctatattccaagcaaaccaccacaattcagttccctcagcagcccgtcgcactctgcaggactcggagccagcttccagcctcacgaagccctggcccggcgcgctggggtggtctgagagccattgaggtaatgtccatgcagaagcctgggcccagaggctctattagtcactggtgaaagcaccaggcaatcctttcccacatggggaacatcagcatgggaagactcaaagtctcttttcataacgattttctaatgcatctggccagatgcgttattcagatatttctgaatatttcattcagatattttctgaatgaaaatatcctacacagagcaagggagggcactgacaagcacggggcctcccgccaagcccagaacttctgaattatttccatgaataacatttacacatacacaccgaaccaaggagctgtggccagcgtctcttgtgatttgacaaccactcttcccgtgcaggtcttacaagataacgcttaaaacaaacctcattatgtctatggtatttttctttttataaggtgaatgatcaaatctttgtgattttccaggggcactcagagtctcagggacagttttagaggcaatctggacagttgtttaaggcaggctcgcgggtgtctgagagagacttgattatccattaacaaaacaaacctgatgtttcacaagtgatgaacctttgttctttgttttttccccttaaataagcacaaacataataaagtcaacataaagcatcaaaaatgattctgctatacagaacctctgccatccaggtgcattacacagaaaggaaagaataatctttcacttttttttttttttttttttgagatgaagtctcgctctgtcgcccaggctggagtgcagtggcgtgatcttggctcactgcaagctctgcctcctgggttcacgccattctcctgcctcagcctcccgagtagctgggactacaggcgcccgccaccacgcccggctaattttttgtatttttagtggagacggggtttcaccgtgttagccaggatggtctcgatctcctgacatcgtcgtgatccacccgcctcggcctcccaaagtgctgggattacaggcataagccaccgcacccggccataatctttcactttgaaggcaaaggcattaatgagtaaacaaagaaggcaagaccatcaaggccagcaaactttgctaaaattgtgacataattcattgctgcttttcagactcaggtaccatgatgataaaaggcacatacctagttttgcccttcactatgttttttgtcatttttaccatattctggaaaacactggtaaatcgctttaggagagagtgtggaccaggatatcctagggtgcctgaggcccttttcagagaatctgtgaggttgaaaagcttccataacacagtttcttctgtcattctctcatgagggtacagtggactttcccaggggctgagcgaaagagatactgcaacaaccgagaatccaggtatcctctattcagtcagacacccaggagatctgcagaaacactgacgcaatgctgttcttctcaatagaaatgttttgttttataaaatagttacgttggccaggcgaggtggctcacgctcgtaatcccagaactttgggaggccgaggcgggtggatcacctgaggtcaggagtttgagaccagcctgaccaatatggtgaaatcccgtctctactaaaaatacaaaaattagccgggcatgatggcgtgcacctgtaacccagctactcgggaggctgaggcagaagaattgcttgaacccagaaggcagaggttgcagtgagccaagatcaggccactgcactccagcctggtcaacagagcaagactctgtctcaaaattaattaattaattaatttaattaaacaatttcacaaatttcaaatgaatgaacacttttttttttttggagacagggtctcactctgtcaagcaggctagagtgcagtagcacgatcatggcccactacagcctcaaactcctgggctcaagtgatcctcctgcctcagcttcccaaagtgctgggattacaggtaaggaccactgtgactggcctatttttaaaatttctcagttttaattctaacacagaatatagggataaaagcctacttaatcaaacgctttttggttcctcaataatttttatatataaagggatctagagaccaaaaagtttgagaagtgctgctttgaggaaaaaaaacaaaacctgtttgtttgtttgtttttttaagacggagtctcactctgtcacccaggctggagtgcaatggcgtgatcttgcctcattacatcctccgcctcccaggctcaagcgattctcctgcctcagcctcccgagtagctgggactacaggcatgcaccacctcatccggctaatttttgtatttttagtagagatgaggtttcaccatgttagcctggctggtctcaaactcctgaccttaggcgatccacccgcctcagcctcccaaagtgctggcattacaggcgtgagaaacttcgcctggccacctgtattttttctttgaaaaataaaagcatttacatagctgtttgtctccatcatgtgtattaattataacttttttttttttgagacatagtctggctctgtcatccaggctggagtgcagtggcacaatcttggctcactgcaaccttcgtctcctgggttcaagtgattctcctgcctcagcctcccaagtagctgggattacaggtgaccgccaccacacctggctaatttttgtatttttagtagagaccgggttcctccgtgctggtcaagctggtctcgaacttctgacctcaggtgatccgcccgccttggtctcccaaagtgctgggattacaggcgtgaaccaccgtgcctggccttattataacttttaacaaagtaactgacttccattttacagagaaccgcaggctgacagttgagagctgtctccagacacatgtttagcagacgcctgtgggcacacacaccatagccttcacagccactcgcgcccttctatgcttcctcaacatgaaaacatactttttttttttttttgaaaagcaaccatttattagaaccaatacaagagtatgaaaagagggaaaagaggagggtagaagagggggagagaatgaggtctgtatcagatgtcagttatggaaacacataaatgcttactctttttaaacactgacatttacaaggtgaacatatatatagaccacttataatttaaaaaaaaaaaaaatcaaaagcagacatgtttggctgaaataaaaccaggaaacacaaccaaaactcccccataaacctaaaagtccatggagaattcaatttctcatttccattcagaaatctggctacagagtgatttgtttgctacttgggacagtacagcgtgctgaaagaaacccagctactgagtctcttagatcccatcctgtaggaagtggtgggaaagccagcggaccatgggcaagtcaactcctggctacttggcagggcgtcagactgtgctctctccattccccaggactccacagaaccgtctggtactgctagtgctgggtgaacagtgagagcacagtccacaaaacacagagaaccagaatgtgactgcaagcagccaggaccttgtgctttttcatggattacaaatctagggccaaggagagggaaaggagaaagagccctattgggaagaggcgttggctgtgcccctacactgagatggaaagagtaaggctcttgagcccacacctgggcaagtagaaatagtgtccaaacttttctcaaaccagagggaaaaaaggtcaaggttaggttaagactgcagacactaagagatcacagatgctgaatacagtgaatcggatgaagctttaaggatcaatgcccaattctgagtgttacacacatttctaggaaaaataattccaatgtagctttttgttggggggtggaaataaggtggtcacatttattgaatcagctgtccctatgaggaaggagaggcccgggtacagataccacaaaggggtacagtgacccagctgtcctgggatcggttggggagtggtaagcaatgacataaatcaaaaccattgagggttgctttgatcctgagacagtctgagtctgcttcaaacccatggggaatggaactttcatccccaacctgcagagagaaataagcggtagcatctctgcctcacgattccctaatccaatgctcctgcatctgaaatgacctccctctgtgaatgcaagacacagaaaatcccaagtgccttccccaacaacatcctaagtaagtctggactagtaagattccaacattcatgaaaacactgtcaacatctgaactagcagatctgatgaggggtgggggtagagaatttgccgagtcagtaagtagttccagtcttggagacagctcagtgaggaccaaagcctgtgtgtccggctcaagacatcctccacagaggacccaagacatcctccacagaggacccaagacatcctccacagaggaccctgcggtattctattaactttgacttacaatgcctcacaacaacgcccctgtgaggtaggtcagtatgatcacccccatttgacagatggggaactgaggcattgaaagaagtgacttgccaaggtcatgactgcaggccaagatacggcctctttttagagctgaaaaaaacccaggtatacctagtaaccaatgttttactattctgtcttaccgagtaagtatgtcgatatccaaagaatacctactcaactccatttagtatcagtccaaggttttaagttacctaagctttattttggtacagtacactttcagaataatgaacacatttatttgaacacaaacttatatttttcataatcttaaacattatgtaacagtaatattagctgatttgataagtaaacccgtagaagtttaggggaggaagccaagtagaacaaaaggtacacctgtattatagctaatgctgataaactgaagaaaaggggggaaggatagcattaggagatatacctaatgacgagttaatgggtgcagcacaccaacatggcacatgtatatatatgtaacaaacctgcacgttgtgcacatgtaccctaaaacttaaagtataataataaaaagaaactgaagaaaagacatagctttttaaaacccaaattattagtctcatttgccaaagatttacatcaattacgtgaacttagatgattattgttattattattattggagacagggtctggctctgttccgcaggccggactgcagtggtgcagtcacagctcactacagcctcaacctcccgggctcaggcgatcctcccccctcagcctccagagccgggactacaggcacaaccaccatgcccggctaatcttttattttttgtagagtcaaggtcttgccatgttgcccaggctggtatcgagctcctggactcaagacatcctcctgcctcagcctcccaaattgctaggattacaggtgtgagccactgcacctggcctgaacttaagattcttaaaatattccagtttgtttctgtaagaagaatttctttctttctttttttttttttttttgagatggagtctcactttgtcgcccaggctggagtgcagtggcgcgatctcagctcactgcaagctccgcctcccaagctcaagcgattctcctgcctcagcctcccgagtagctggaattacaggcatgcaccactatgccgggctaattttgtatttttagtagagagggggtttctccatgttggcctggctggtctcaaactcccgacctcaggtgatcgacccgcctcggcctcccaaagtgctgggattacaggcgtgagccacttcgcgcccagccttttttgtttgtctgtttgttttttgagacagagtctcactctgttgcccaggctggagtgcaatggtgtgatctctgctcactgcaacctccgcagcctgggttcacgccattctcctgcctcagcctcccaagtagttgggagtataggcgtctgccaccacgcccggctaattgtttgtattttttagtggacacggggtttcactgtgttaaccaggatggtctggatctcctgacctcgtgatctgcctgcctcagcctcccaaagtgctgggattacaggcctgagccaccatgcccggccaagaatttctttttaaatttaaagtctagtgcattaaaattattagaagtacagccaggcgtggtggctcacgcctgtaatcccagcactctgggaggccaaggcaggaggatcacctgagatcaggagttcgagaccagcctggccaacatggtgaaaccccatctctactaaaaatacaaaaattagctgggcatggtggcacacacctgtaatcccagctacttgggaggctgaggcaggagaatctcttgaacccaggaggcagaggttgcagtgagccgagatcgcgccactgcactctagcctgtgtgacagagtgagattccatctcaaaaaaaaaaaattataataaataaagaaataaattattagaagtacgattttcctacgttctggaaatcttagaaatatttacttacataagctaatcacgaaccaatcagaatagagttcctccaattcaagacacttcatgaccttacccaatgactcaaaaaaagttttccacattcacttagtgagaggcaaaggcctttctgaattacaacttcagccccagggcaagagtaaacacagaaactggaaaagtccctggaccaggtgtcaaagaggtatccttcccggtggacacaaaattctgaattgaattgagctcaaaagaggctaaggacacagagaacgaagtctgatcatccagattctccgtatctgaccacagagaactgatctctgtcatccgcctacaaagatgagcaaaacaatatgaccacaaaccaatgctcaatcactgatgccaccaagccatgggtaagcccgaaaccaacagaacacagagtcaggggcaggggaaacagagacacggagagaaaacggagaaacagcgtccgcgaagtgaaaagttccattgctgcttgaatttgcctctggtagccaagaaaaggccagcactgtgggaggccaaggcaggaggatcacttgagcccaggagtttgaggcaaacctgggcaacacagtgagaccctgtctctacaaaaaatacaaaataaaaaatgaaggaaacattgacacctactgtaacatgagttacagcagttaacatgagttgaaaatatgctacatgaaagaagtcagtcacaaaagaccacgtagtgtgtgattccattagtatgaaatgtcctaaatgtgcaactccatagacagaaagattagggctgccagggctgcggagcagccaccagtgtgtctggagcttctctttgggttactgaaatgttctgcctgtaggcggtggtgacggtcgcacaccgtgtatatactaagccactgaactgtgccctttgatgggtgaattttatggcatgtgcagtatgtctcaatcaaacggtttttgaaaaggcagccagcaggaggagacatgaggaggcaagagcctcttcaggtgactggggccccctcccagaggtcggaggctccaccacaggccccagaagtcagtggacccctatgctccaggtctttgtgacccgggagtcctgcctccctcccctgcccaggccctgggcttctgggtggggcatggtggatggcaggggaaggcaggtgtccctcagctactccagaatccctggtgagcctctggtgagcctcctggtccgcccctccctgaactctctgtagactctgtcataaagaacaaggctgggccgcaaggtggctcacgcctgtaatcccagcactttgggaggccgaggcgggtggatcacgaggtcaggagatcgagaccatcctggctaacacggtgaaaccccttctctactaaaaatagaaaaaattagccggcatggtggtgggcacctgtagtcccagctactcgggaagctgaggcaggagaatggcgtgaaactcgggaggcagagcttgcagtgagccgagatcgcgccactgcactctagcctgggcgacagagcgagactccgtctcaaaaaaaaaaaaaaaaaaaattagccgggcgtggtggtgggcgcctgtagtcccagctactcaggaggctgagacaggagaatggcgtgaacctgggaggcggagcttgcagggagcagagatcgtgccactgcactccagcctgggcgacagagtgagactcgtctcaaaaataaataaataaataaataaataaataaataataactaaataaataaagaacaaggctttcaccacatcccaggcagagtccaagtcagggcagagcctcacagagcacagcagggcctgtgccgtgccaacgccatgcccctgcctggcagaaatgccacccagcccctggcagaaacgcctcccctctcctatggaggggctgatgacccaggagcggctggctgctggtgtgagtacacgggtgacccttccacaaaggcccctagctgggctccctgctcagttggccgggtttggggctggatgtctgcaggggtcctcagggatacccagagggagaaacaaggcttttggggaaatggtgacacctggggccaggtttctcacagccaggccccatctctccctgcctggatttcaggggaagtggggcttgggtaaacaggaacggacgtggccatcaggccggaagggtgtgtgggccacagagaagcaccctgaggctgtgctgtcatccagagtgccaccccgcttttccagggcacagcaaggaagtgcctgctggaaggatcctggggacagttgttaaggcaattttatcttctcatagcatgcctgcctcagttccgcagccaggacggtgccttactgactccacacacagaggcagctgggtccaggaggcagccatcccaaacgcagtgacctccagcacccaaagctcagagttcccagctgaacccaggaggcacccaccttcctgtctctaggcagatgccagctggtgcaggagccactcccagtcccaataccaggcctggtcacgtggtgccccgccaggcttgggggtgtgcacttgcccgctggcctccggtgccctcaggcctagcctcattgtcacaggaacggagctcctcggggatggccaccttcctggacttacccccaggagggacacgctgctgcctcccagggcccttcgtgccactggcccctttctttccacccccatatgctacccctgcctactcccttccctggccctgggttgccactcctgtcctgttctcctgctgtccccaccccagccctgaccccagatggctctccctacaaaaacaccagaaccccagagaagctcaatcccccaagtccatctgcattttaagaagccctcacgcactcccagcccagagagggaagctgtaaaggtggacaggtcatgtcgggctttgaacctgcaatgtgatctcaccttccccgtctgtaaaaggggacactccctgccttgtgggatcacatgcagtatcagaaaaagcacctgacatgtgacatccacttacaaagggttttcccttctctttggttttgggggagaatgggagaggcccaagcagaagctcctggaacaccgcccatcccggacccagggttgtagtcacctgaacactcacccagacaagggaaacttcacagaatgaatgtgaggaataaaatgagacattcagttacacaaattaaaccaaacccagatgcagaggtgccccataacagaaatagagcaactactgccagccttggatgaaagctcttggccaagggccgtgacggcggcggggaggttcagcagctgtccccaagcacacaggacatttggcacctccaagcccagcctgtcccaccaggccacggcacactttccttcctctgaagaaagggggtttgttaagccaacgaggagggaagccaaggactgcccccggcgccagcatggctatgagcatagaagcgggctgagccacaggctgggggatcccatgcagaccaggcaaagcccaggcaggatgctctgcagaaagttccctggtgatccggacccggagccagactgagccgcagccccagaagacaggtatctcctcccctggggccacagcagccacagaggccacccacggcttccactaggacagtgtgtctttccagttactctacgtacctaaaagtgaccagccccctttcaggtctggtctatgatccagatggtgatctttcccccactttttttttgagacggagtctcgctctgtcccccaggctggagtgcagtggcgcgatctcggctcactgcaagctccacctcccgggttcacaccattctcctgcctcagcctcccaggtagctgggactatgggcgccccccaccacgcacagctaattttctgtatttttagtagagacggggtttcaacgtcttagtcaggacggtcttgatctcctgacctcatgatccgcccaactcggcctcccaaagtgctgggattacaggcgtgagccaccgcgcccggctggtctttcccctttaagaccccacttcccacccccaccctggccaagctgataggattcaaggagtgcggcggtgcaatcacagctcactatagccttgacctcccgggctcgagcaatcctcccgtctcagcctcccaaagccacttcctccttttcttagttgttggcttcttctacagaaaaggatcctgaaaacaaacacctaaaatgccaaccaagaattcaatctgcaaggcagcagcacctccagaaatagctgctttgtggcctgtttgccatttatgtgaaacttccccattttggaccaacgcaggcagaaagagaaaaggaggaagaggaaggaaaagaggcaggctgtgttggggctggatggggctgtaggaacctgccagcagtggctcttggggaaaaccccactgcgaggtttctgaacccctgccccggaagcttcccctttcccacacacgtcactcgctgccttggaatctgggctgcctccctcccaggggctcacaggggagcgaggccacagaaaggctccttacccccagtggcctaacaggtgtgacatgtggagggggaatctgggcagtgtgcctgatgctcagagctgagaccctgaagtccaactccctcgggtgtgaccttggacaagttacttagcctctccttgcctcagttacaccatctggagaatggggatgctaccctcgtctgaccaccgtgatgtgagccagtcagcacacatcaagtgctccgtgagcgtccggcacacaggtgcttgtctctgtcctgtgcttcagctccatcagtgtcttcttcagacctgtcattggcttggggcaaggatatatgtggccgctgagggcggtccgccaggtatggcagccatggagctgctaattaggccctgtgagtgggaggccctgtggggtgggcaggggcagacgcccagctgctctcggggacactccaggcctgtgctgccctccacagccccagctggagaatggtgaccagatgtcaacgacaggaagcatttccagaggccacagctctgcagggaggtctctcatgggctgacagccagagccagcgctccgggtcccctgaaaaaacgggcacagtcctcggtcacgtcgaggacctgctcagcccctccacttggcaccggagagaggatgactcacggcccttctgcctggaaggcaggctccagtgtcaaatgtccatccgcctccatcaccctcatccatccttgtcagtccaggggcctgggcactgctggggctcctgggcagacagttcccccttgcaaatgagtgggaccctcagctccttcgatcagcatcctcacgtcagccgagcctgtgagcacccctaagcaaggcctctgagctgggcatgcgacaccccttcccacccaggcaccctccccctagaatcccccataccaccctggggccatgccccgcttccctctctggcaagctcctgcacaaccttgagaccacctgacagccaccgtctatcctgcccaacctcctcagaagcactaacagcacctcgccccagccacggcaggtctctgcacccctcgtctcagtcaccactctcacatctcatgaacagagacacgagctgcttcctcatgctccctgtgcccgtcctgggagatccctgcctttaaaccccagccacgaactgctgaccccgcatttcctcttccctccctgggcaagaggggcagaaggggcagggacgcacaccctgggccgcaggcagaggcttggccagggtcgtcctcccggcagtgcctccctggagctctgtctacctcaactcctgatgccagaggatccctctgcgctccccacacccttaagaccccagctcagggaatctggtctcggtcatcactcccaggggactgcagggccccaggacggcacacattcaggcccaggagagctccccccatctcaaagcctcctgtgggtggagatggaatgtggaaaaaccgcatcctctgcagctcccccacagtgagagcgaggactgagggtgtggataaggctccaggaagggggtgcaagcctgagaaggtggaagagctctgggtgggtccatctgctcctcacctgccccaaccctgcctgcaggtgaaggccggtccagccgcagaaggcccagcccccagcccacttacagaatccgcactgtgctcctccagccggcccggcccctcgctgcccaccgagccatcatgaccccagcaccgctgcacattcgtatttgttgaatgaatgaatgaacccttgccagcccagccacttggtggctgagggcttcagagctctcccagggtcccctggggtcattcagccactcaacagtttcccagcagcagcagcgaggatccgcacatcattgccagtgctctaaggagcgggcgagccccagtaagcggccgctctgaccgcgctttgtcagccctgagctccgctcgggaggagccggcaggtgtctgcggtgctggaaagaccacggtgtgggcggggattccgatccgccggcaagggtggcctgcacccggccaggcccgcgggttttctcctctccggggctggcctcggcccctccccctccccgcgccccgcacccctcccctgaatccccaggccacgtggagaggacacaacaaagccttccccgcctccgaggcggacccgaccctcagcaccgacctgccggccgcgccgaggagggcgcccgggcggaggggaggcgggagagacccggccctcaggtcgctgctgaggcctggggctctgaccccccgcctcccctcctctggctcccaccgcggtcgggcccagggcgggcggcgggccctgagctccacgccggggcaggcggcaggcaggggtcacgggctggggctcggcgcgtaccccgggaggggcgcgggtgcactcaccaccctccagccgcgggggcgcgggcgcgtccgggccgaggcagcgtctcccaggcgcgcggacacggtcgactacccgcttcctccttatggcgccccgcgcgcttcctccttc

SEQ ID NO: 1783 - DNA, 40357 bp, Homo sapiens; identical to SEQ ID NO: 1782

SEQ ID NO: 1784 - DNA, 39904 bp, Homo sapiens
cgtagtgttaggaagatttatttccaaacagtggcctccacactgcgcggcagcacttctttttagtatttgtaagcttttgcccactttcaattgagccagccctagcgtggtatgtattgcatgctgaacaatatagagtttgtttttcctttctgatgattttaaactcttaaagaacaggaaagcatctggtaagaagaaatcatgagtccgtcagtgcccttactcatatgcgtctccagtggcctcatgttgtggtcacaggagtttcctgttcacagcaatgtgtgtgatatggacccagcatccactgtcgtgcttttaaactgattcctgggacatagcttaccactggaacagcagaccagtgttgcactgtttctaaagctaagcttttccttatttattttggtactacctaagtgacttggttttgactgtccctaagagagggaaccactttgctgaatttttaaaaagtccaactgctctttcatcttttatgcttagaaacctgttctctccagatgcacttctgaggcatggatgagctgagcgtatggctagaaattggaagtttacagctattaccagggggctaactcccggggcatcgcagtagcttctggcacccgtggcttcatgtctttagcaaagtcttgatgtcatggaaagagaaaaagtgtatgcagttagttacctgattttgtaaacaaacagtggctgacctgggcccttaaatcaccttcacaccttttagaaccacaagtggttctttttgactccaacaaaggaaacgaagttgaaaaagtcaagcccctgtgtactggggccggacttcccatcatttgagtgcagcactttagttcagaatctctgtgccatgtggttttttaaacaggaagattgttggttccttagtattaagatagatagtccctattttgagtggaatttttcatttgtaaggggtatgttccttctctgattcttgctttcctcaaacaggatactgcctgctgtaagaccatcctctatggttgtactttaataaacagtaatttttttttaccaaaaaaattgtattttgtttctacttccttgaaacctgctttccaatttaatttttaagtgggaacctgcacagtggaaataaaggcaccgtgtgtagatttacagatgtgcagattcatgtgtggatgatatgaaggccattcaaatacgtgtaaatggacattttcattcaagtatattaatgtagatattttaaagtgggttataagtttaacattgtctttaaaatagaagtcacagctatcttccagcctgtcttctctaggaacgctgttgacatgccagggctccgtctacactggaagcagctatacagctgtgaccacatcgagctttagccagtcacacttctggaactgtccgttcagtccatcccctagagcaagaaaggagaaaaagccagaatcagctaggctcattcacaaaccaggctccagagctctgtgccacagtagagcaaagctggggtttatgcaaaaacatgttctccagacccctgaagtcctatccgtgcatcctactttttgctacatgggggcaactgcaaaaacaggccgttcaggcggtgaggtgggtattcacatctccaaggcactgacggtgtcaggaggcccctgctgggtcagaggaatcacgattctgcctcagccctcagtctctggtaagctgtccatacagactgctgcacacgtcttgcccaccctttccccctttacatgggtgttggtaaaagctgtccaggaatggtctcaggcttacctccttccaacaattcagctgggtttaatgcctgatttaagatttatattcattctcctgtttttaaaatgcttgtataactgaagaccacagcatataaggaatgttttcttatgagttctcagtagaggattagatgctattttacttaaaaaccaaagcctgaagtaatgcttctgacatgtcataaaatcccaaacattaggccgggcgcagtggctcacgcctgtaatcccagcactttgggaggccgaggtgggcggatcacctgaggttgggagttcgagaccagcctaacatgggagaaacctcatctctactaaaaatacaaaattagccggtcatggtggtgtgtgcctgtaatcccagcttcttggggggctgaggcaggagaatcgcttgaacctgggaggcagaggttgtggtgagctgagatcgtgccattgcactccagcctgggcaacaagagcaaaattctgtctcaaaaaaaaaaaaaaaaaaaattcccaaacattcgctaatatttttaaatttacaaataagacacatccacttaatttccatttgggtctatgaaacagaagcaccagattttgctacatgggggcagctgcaaaaactggcccttcttgggcagcattgtgaacactgtatgtttgtttttagagacaggtcttgtttttgttcaggctggagtgcagtggcacaatcagctcactgcagccttgaactcctgggctcaagcaaagagatccttctgccccagcctcctgaggagctgcctcaacctccatgacggcgtgaactacaggcgtacgccaccatgctcagctaattttttttttttttgagacagtcttaccccatcatccaggctggagtgcagtggcgtgattgcggctcactgcaacctctgccaccagggttcaagcgattctcctgccttagcctcctgagtagctgggattacaggcgcccgccaccacacccagctaattttttttgtatttttagtagaaacggggtttcaccatcttggccaggctggtcttgaactcctgacttcatgatccgcctgccttggcctcccaaagtgctgggattacaggcgtgagccaccgcgcctggccctcagctaattatttttataaattttttagagacagggtctcgccatgttgctcagttttgtctcaaactcctggcctcaagcaatcccactgcttctgcttcccaaatcgctgggattacaggcttgagccaccatgcccagcctttagactgtgacttgtaatacctggttatgggacagatgtgctctggaaaagatttcagacagttcccccccttttttgactactcgttttggttcacattacaccttttttttgagatggagtcttgctctgtcgcccaggctaaagtgcagtggtgcgatctcagttcactgcaacctctgcctccagggttcaagcagttctcctgcctcagcctcctgagtagctgggactacaggtgtgcgccaccatgcccggctaatttttgtattttagtagagacgggctttcaccctgttggccagggtggtctggaactcctgacctcaggtgatccacctgccttggcctcccagagcagtgggatcacaggcatgagccaccgcactggccacattacacttattttttatggcaaggtgagaggtctgaaaagctcattgtgagccctccagccccttccttccactctgtacctgcttgtgccttgaggaccccaccaggagtgtgacgtgagcctttgccacccctctgaatggagcatgtctccaatagtaagctgctaaagctccaaaggactctgggtgctcttcgtcacctttacacacagctttctagctcacaacagcaaaaccaaacccgagcaggacagcctgtaacccttgtgctggcatcagaggcaggggccccgctgggcttctcaaccttccagagaaaagggcatgggcggcaggcagggaaggagctgacctcaagggttcttacatttctggctaagctcctcacgtaggtgcgtaggttctggttaataaaattcactgttgtgtgaaagacatcacggagcaaggacggcgtgtgactggccaccttcttggccagcagcagggccagcaccagcatggtcttctccttctccatgtctctagggtaggcctgcagcagctgctccagggcagtggccaggtccctgttccggtcctgcacagaggggcacacagaacctggtttactaatactcttccctctcaaaggaaagacagtccccagtatgaagaagcacttcaaagtacttattaagtatccagggctgctgggcggaaagaatgagaaacagttgagttctgagaggcaatggaaagggaagactgcaatcactccctgcagggggctcggtaagcaaacgcatgtgtggtgagcccatgtgcccactgttagacggtgatgggatacaagaagcctgggtcatccctgcgcccaaggcacttcgagtccagaactagtgaccacctgcgacgccttaggcccattttattggtgcagacctagctgaatggacaggaggaagggggttcctgggggacactagacagactacaaggctggcaaggaccgtcaggcggtcggcgcacatgcagagttacatgggagtgcgccagccactcctgcgttctaggcagctgctgggacatcacaggctggccccactgaacagaagcatgattggatttctaggaggtgaggacgcctgcattttcagctggtagagtcgaaaaagtggaactttctctcctctcagctcctaccgctacaggcctgcatttggcagttgggaggatgtagttctttccgctaagtgttctggggacacagtgccccggaccaatcttgtatccccaacagtgccaagcagatggtagagctcagaaagttgtgtggattccaaccaaggagctcagcagagcagcaggcaccactcccagggcttacggttctcactggcaccattattaaactccctacaaccaaaggaagcgtctgtttcttctgttggccaaacatgcttcgttcatcttttagaggcttttacccctaaactctttactctgatttaaggttcaggtttcctcgatgtcaaccagctgaaatcttctgcaaggcaatgaaccataccctacgtccagttacttcgtcagagttctggacctgacagtcacgagttgagtggcctcacgggacagtgggctgcctggtgagaggcaggggacaggcccccttggctcacttgcccgcccacgcggtcctcaggccctcactcacctcctccgaccggctggtgttcctgagctgcagggccaggccgttcaccaggcccggagggatgctacggtccatgctgtccccgacctgggcgaggtgcctggcaatattccggatgatgtcttcttgactttcagaatctgtgttcaggcaggggcggcagagacagagcagactcagaaaatgtccctgataccctctcccacaccaccctgccccgggaaaggacaggtccgcgatgggacaaggccagcccccactgggcacgtgctccactccaccagggccacagcgggcgggctgagtaccagcgctgagctgggttctgggcagtgccggagctcagggcctcggctgaggcccaggctcccgcacacaggcaccacgtccccacaggcagggccggtgaagctggggcatcacgaccacgcctgaggtacaagcctggcagcggcttcatggctcacaccacacaacccaacagggttggccttggcctgggcagccgttggggaaggggctctgtgggcagacggcatcccagacccacttttgccctctcaagcctgagagcccccattcctcgcagtcccgtctcaggaaaaccccagttgtcactggcaccggcaaggccctggagaatctcccctgcctttccaaccagagctctcccccttgcccctcagtcctcctcctctggcgcacagcctccgtgctgcccctgcccgagtaccactgtcgcagctccatgaaggccacgctcaactgccacgctccctgccgcctccgtttcttcctcagcacttgctgtgttattgtctgacgcccctgccagaaggtaagctccctaagggctgtgatttttttaatctgttttgtccactgacaaatacccagcacttaatacatggcactcagtaggtgctcaataaacaatggcagggaccaggtgtggtcatgcatgcctgtaatcccagtgctttgggaggctgaggacagaagattgcttaaggccaggagttagaggatgcagtgagccgtgattgcaccagcaacaaagcaaggccctgcctctacaagaaactttttttttttttttgagacggagtcttgctctgtcacccaggctggagtgcagtggcgcgatctcggctcactgcaaccttcgcctcctgggttcaagcaagtctcatgcttcagcctcctgagtagctgggattacaggcgcccgccaccacacccggctaatttttgtattttaagtagagacgggtttcaccatgttggtcaggctggtctcgaactcctgaccttgtgatcctcctgccttggcctcccaaagtgctgggattacaggtgtgagccactgtgccctgcctctacaaaaaacttttaaagggagccaggtgtaccgcacgtacctataatcccagctacacaggaggctgaggtgggaggactccttgaggccaggaattcaaggctgcagtgagctgtgatcataccactacactccagcctgggcaacagagcaagaccccgtttcttaaaaaaagttttaattgcatgaatgaatgaatgggccctgtacctagctcccagtaagtgttcaatagatgccagctattgttatttctcccattaaatcttctattttttctgtgcttgcaacttccctctggcttttttggttttggctgctgctcccaccctcggtcagctgtcaaatctcaccttatgttgcaaatacaagcgttttgcctaccctctgccattgccgccaccctggtgggggtccccttagctctcatctgatgatgacagccccactccctgccgtccagtctactcggccaccttcacagcacagacctcagagcagggcagggttgggagaagtgacgtgctaaggagtgggcacgttcttagaagctgtgctctgggggtttcacggcctccctggagtctgtccatggaacatgcagtaaggctgccacatcacttctcttcaaaacctctcaagtgctcatctctgcttaagtgacaagtcatgacccagcctgaaagtacgtctgacttaacttccacgcttcctaggcaaactcaactactcactgtagcttttttttttcttttttttttcaagacatagtctcactctgttccccaagctggagtgcagtggtacaatctcagctcactgcaacctccgcttcccgggttcaaacaattctctacctcagcctcccaagtagctgggattacaggcacccgccaccccgcctggctaatttttatatattttttttagtagagacggggtttcaccatcttggctagggtggtcttgaactcctgacctcatgatccacctgccttggcctcccaaagtgctgggattacaggcgtgaaccactgcacccagcctcactgtagcatttatagccgctgggcttttgcttaaaagatggccattccctcttcccagtttccaaggaaccaaacatacccaacccccaaggcccagctcaattggagctgcagccccaaagttttcctgattccctgcagagcagagcacccagctcctccagcacctcatcactcccccagcaccgaatctgtgcctcgctcgttcccgaagcttatccaccttgcttcagttacggacacgtcctctctccctctggccaccagccgagtagcaacaggaatctttcctgatccgtctgtgtccagccgagtgaacggactcaccaaagaaaccccggcagccagagcctctaccttgcccctctttccaggctcgccagggactagattcacagtccctgtcacctgcaggctaagtgaactgccatgatcacttttgcaggtgccacttgagtcaaccccggtttctcagtctagaggcaaaggccggcatggagaagagcgagagaaaaacaccagggcagactggggctacagtcacccccacagcagtgctgacagcagagctgtgcctgtccactcctgcccttcctggaccttcccaaagggatctggggtttctcctcagttcagggcgagccagaagatatgctggctggattagaaggcagagacattctcagacacctccccccaccccccacccccacccccaccccggtctagtggggaactccagccacgtcctcaagcacctgatctaagacaggcgggaggcagaaggctgggtcagctgttggtctcccccacagccaccagagggcagtgcaacccttgagcttggaaggcctggaccagggtccggggatccctgcaggctttcagggcagggattctacctgcgtcagaatcctctgggcagtctcccgccctaaaacagcctgatgcaggcagctggagtagggcccaaggcctgcatttggaaaaggtttctcgtgtaattccaatgtgcacactactgaaagccagcgtcgcagggctggatctggaagtgggtgagcctccactcgcccccagcctccactcgggacagcccctgtccatagaagcagccccttggcaaaggggagtggagctggaggctggaggagagtgcagggatcagcaacaggaaaggtgaacagtctggaaaccatggtgacctggagtcagtgccctacagtgggagggcggctgaggcccacctcaagaaggggcctggccccatgtcccagtggtaacatggccacaagctgtgtgatctggagctagtcatttaccctttgctggacctgggtttcctcacctggaaatgaggttccaaatacttctgtgttcttgtataggtaatcacggagcataatgtatgaaaggaaatatgtcaggtatagacagtgcaaaagtcactgtgaaaccagtgggcctcaatcaatgggacagtcagccaggcctgcttggggaggcaggggccgcaccggtagtgccacctgggggctttgcccagacccagcaatgcccagaccaaccaatcagaatctctggaggtgagatgcaggcaccagcatttaaagctccaggtccttgaaatgatacaaggccaagtgtgagaaccccttgggttatataatccagacaagtggtctgcaatctttgtatcagaatcacatttggaaaattggataaaaacaccattctatgttggtccagacaagggactcaagaccagtacatgagattctgtctcaacagaaaggaagaactttctaacagagtcacccaaaaatggtaggcagtgagttcagcagcactggagggaatcaagtagagaccagtcaagtgattaagtgataccagcgtacgtggcagctgaaactgcagaggcagagtgatcccgggggtcccttccagccctgaggctccctgaatgttactggcgacagagaagcccagctttggggaaggaggtggggccggccgcctacctgcctctattcttcccaagcgggagtggctgctgcggttgccatcagtctgcagctcatcgtagccctcccactggggagccagcactggcagctcgtggcccagtgcgtccagctctctgcggaagctgttgtcagaacagctttggaggaagccaaacaccagtaggtttgtgatgcactcatccctgaggctggaaccgttgttgacctgaggggaaaggggagtcaggaagccgggacttcagccaggccagaggcccctcctgcaaagagctccagttgcagctggcccaaagagcctcacaggtcccagagagctgagggaccctgtgggctggagggccctgcaggaggtctcaacaggcagaggcaaggtctgcagccacagctttaagcagcactgcccgtagatggcagggagcgagccccgactctgcagaaagggattcctctgcagaggaatctgctggacctcctgaaacacgcggctggggagcttcccactaggtgagaaggccacaggctgttccggggaggcgagcgagtgtcatgcgggcatcatccgccatcctgtgctggcacgctttcttcaagttcccctgcaggcttcagcaatctgagcccacctttcctggctgtgcttccaacaggcggagcctctttccgctcatctccttcacgggctcaggagggtattgggcagatggaagattttcagtaactactgcggagtggtgaccacagctgggcacctgcctttggccaagcttggtttactttgggtgggtgtgtccttaatccgaatcccacagggagtggtggcactggctcctgctctacccagaggggctgggctcttggccggcagctctccagctccctgggcagcactggcagctgcagcttggccagcatctgtgccgccagagatggcagggactgttcttggggtactgactgtgtttgggggctgtattcttacaggcaaaggtgagccctgcagctgggtgtgcccagaccagagaaagacctaaggtggaagagagaacaaaacacaaagaagggcagggacgctgagatctgcgcagattcacacaaaaagacctcctgggctgccagagaagggtgggagggaagatggaagtgtaggcagaaatttatttctattctctaagtccataatatttttcattagaaaaaccaaaaacttttagaggacagttcttacagggcaaattgtttttttgtttttgtttttgttttgagatggagtctcgctctgtcacccaggctggagtgcagtggtgtgatctcggctcactacaacctccgcttcctgggttcaaatgattctcccgcctcagcttcctgagtagctgggattacaggtgtgcatcaccacgcccggctaatttttgtatttttagtagagacgaggtttcaccatgttggtcaggctggtctcgaactcctgacctcgtgatccgcccgccccccaactccccccaactccttggcctctcaaagtgctgggattacaggtgtgacctactgcacccagcagcaaattgttttaatgctttgctaggtgatgcctgtaatcccggcactctgggaggcagaggcaggaggatcgtttgagcccaggaatttgagaccagcctggcaacaagatccccatctctacaaaaaataaaaattagccaaggtggcatgcacctgcagtcccagctactcatgagactgaggcgggaaggtcacttgagcccagaagtttgaggctgcaatgagccatgatcacaccactgcactccaacctgggtgacaaagtgaaaccctgtctcaaaaaagaaaaaaaaaatgcttaaaataaggagcttggccgggcgcggtggctcacgcctgtaatcccagcactttgggaggccgaggcgggcggatcacgaagtcaggagtttgagaccagcctggccaacatgatgaaaccttgtctctactaaaaatacaaaaattagccgggcctggtggcgggcgtctgtagtcccagctacttgggaggctgaggcaggagaatcgcttgaacccgggaggtggaggttgcaatgagccgagatcgcgccattgcactccagcctgggggacgagagccagactccgtctcaaaacaaacaaacaaacaacaaaaataaataaataaataaataaaaataaggagcttgtgtattgctgcagccataaaaaagaataaaatcatgtcctctgcagcaacacggatggagctagaggccattaccctaagtgaactaactcagaaacagaaaatcaaatactgactgttctcacttataagtgggagctaaacaatgggtgcccatggacacgaagatggagagagcaggcaccgggcactttacagtagggaggcgggggcgggggagcgcagaaagagtccctctccatgcgataccggaagcccagtccccaccagtgcacaatattcccatgtgacaaacatgtacacgtgcccctgaatctaaaataaaataaaataaggtgcttgtgtattgctattcagcctttacttctccaaagttgtttctgaagagaggaaaaactgtatgcaaaattccactgcatcaattcctaacaattcttgtacggagcagccgcatggcacaagacagcttacaaacaggatgtgcttcattcctgcctcaagcgacagtcctggtgacacagttagtgctgggctaagctgtgtcacccaaaaagaaaagcgcaagtcctaaccccaagtacctgtcaatgtgaccttatttgaaaataaggtttttacagatgtaatcaagttaagatgaggtcatattggattagggtgggccctaaatccaatgactggtgtctttgtaagagaaaggagagggagatttaagcagagacacacagagaggacgccatgtgaagacagaggcagccacaggagccaggagagcgccccagaaggaagcagccgggcaacatgggattccagcctttgggcctctagaaccgggaggggatccgcatctgttgtttaaagccactctcctgcttggaaccgcctacagcagccccaagaagctaacgcaggcagccgctgcccaaggacttctttttgacctgcgcttggtaaattggcatccagaatctggacacagagcggtgctgccaccacagcaggtcaggttatcaaactcaagatcccacagaaaataaagactcgaggcggcagggagggagaggaaagaatggcacctgccagaggaggtctaggtgccgcaagtgaccgtgaagccaagcactgggcccactgagtggacagctgtgtggacaggctcctgtctggaccagtgcctcagggacaggctgggccggccctgcaggacaggagtgggctcggaagatggatgccatttaattccaagaatagggcttgtgctgtgccaatatggaatcatgcccttttttgatcttctagatccactttgtttttggagacagagtctcattctgttgcccaggctggagtacaatggtgccatctcagctcactgcaacctctgcctcccaggttcaatggattctcctgcctcagcctcccaagtagctggggttacaggcacgtgccaccacgcctggctaatttttgtatttttagtaaagatggggcttcaccatgttggccaggctggtctggagctcttgacctcaggtgatctgcccaccttggcctcccaaagtgctgggattactggcgtgagccaccatgcccagcctctagatccacttttgataaaagaattgatagttttttatctttttagatcacaggaaaaaaatatgttaagagaaacgatcaagacagtaaatcctgcaagacatgttacaaaaatgatctaatggaggcaaaaataataagatcagttccagtggaaaggaaaagatggtgctggccgggcgcggtggctcacgcctgtaatcccagcactttgggaagccgaggcgggcggatcatgaggtcaagaggtcgagaacatcctgggcaacatggtgaaaccccatctctactaaaaatacaaaaattagccaggtgcggtggctcacgcctgcaatcccagcactatgggaggccgaggcgggcagatcgcgaggtcaggagatcgagaccatcctggctaacacggtgaaaccccgtctttactaaaatataaaaaattagccgggcgtggtggtgggcgcctgtagtcccagctactcgagaggctgaggcaggagaatggcatgaacttgggaggcggagctggcagtgagcggagatcacatcactgcactccagcctgggcgacagagcaaaactgcgtctcaaaaaaataataataataaggccgggcacggtggctcacgcctgtaatcccagcactttgggaggcccagacgggcggatcacgaggtcaggagatcgagaccatcctggctaacacggtgaaaccccgtctttactaagatacaaaaaatgagccgggcgtggtggcgggcgcctgtagtcccagctactcgggaggctgaggcaggagaatggcctgaacccgggaggcggagcctgcagtgagcggagatcgtgccactgcactccagcctgggcgacacagagactcaatctcaaaaaaaaaaataaaaataaaaaatagaagtatctacacagaattaaagttatgatgggaaaaaaggctgaaccctataattgaaaagaaagtttcggagtgtttcgctgtgaccccagctctgtggccctgggcgggctgccgtactgctgcctccgcttcctcactccgaaggcaagaaaggggagtggcgacgtccaccctccctcactgagggggccggggagaggcgggcgggagggcaggcgcctcctccggcgagtcagggcgctgcgcgggtgacggtggtgttctacctgcggaggccgccagagcgcgaagccggaacagcagcggcaggtgggaagggacagtggcacccagagtggtcttttggacactgacaacaagcctggatcagggccgggggagctcctgcaatctcctctgtttatgtaactaacatcaaactcgagccactgcctcagccctccagccaccacgctgaaatccacaccgtccccacctttggaaaggacccccagtaggggcagcttgagaacctcctgggtgccgggtgctctccatgctcaggaactgcgacacagtcactaagtgccaaggcattagacttcgcagatgccttcccagaggctgccaggacagcgtgaggcgcccagaggctgcagaattcggcaggagggaggggaggaggatgtgatgcagcgggtgggagagagcacccgtgtgctgtgatttttctctccccagaccatttaaagggaaggagagacaaggaagcatccagggagcgtcctgctgaaggcgggggctccgggctcccctcccagaactccaccgcttttatctttataaagacggggtcttactatgttgcccaggtttgtctcaatcaaactcctggcttcaagcaatcctctcgcttctgcctcccaagtcactgggattatgtgcctaagccacctcgcccagctatgaagggaaatttaaatccagtgggttaaaaaatttttgaaacaccttacagtttacagtacttttatttgacctttattgatttatttgctcctcatagcaatggcattggttagacaaggtaagtattgtcttgcttttacagttgagagaattatatgaagtgcttatctaatgccccctttcttcttcttaaatctctttcgtgtttgtttggacagggctgcagtgcagtggcacaatcacagctcactgtagcctcgacctcctggcctcaaggaatcctcctgccttggcctcccaaagtgctgggacccacagcctatggctgttaaatggtcttaaacccaaagccccctcgcccttgcagttagccccaggcgcggtgtggaggggctgcaccacaagcggagtgcgaggaaggcgcaggacagggaaaggtaggacttcccggctcccgcctgcttcagtgaaggggctgggcggggttcgtctgtgccgagctgtggtaagggccaggcgggctcagcctcagccctcagggatgcgtggtgggggacacgcaggcccttacccctcgaccccgccccccacaaggcacccgcaggggatctggcctctgacctcacagtccatggcctgggcagcgcggcagctccgactcactcctggttcacagtgtcccagtggcgacctggaaagggacacacagagtgggcggccgctcctgggaagccctggtcaggacccctcgggaggacgacgaagctggcctgtgctccagaaatggcggctgagccgaggtcctggcctgagccccgcatcctgagtttctttctccttggcgggagccaagctttgttttcctcattccagatactcacccaggcgctcagtgccctggggccgaccccgcacctgaattcagccctcccatgccgccccaggaagacctcaggcatcagggaaacggggccgtgggctcacaaattattttattatcataaaatgtaaaatgtttatagagagagagaatggatttgacaattaaaaaattaaatcttccggctggacgcagtagctcatgcctgtaatcccagcactttgggaggccgaggcgggtggatcatgaggtcaggagatcgagaccaccctggctaatgcggtgaaaccctgtctctactaaaaatacaaaaaattagccgggcgtggtggcgggcgcctgtagtcccagctactcgggaggctgaggcaggagaatggcatgaacttgggagggagaggttgcagtaagccgagatcacgccactgcactccagcctgggcgacagagcgagactccatctcaaaaagaatgaccagtctggccaacatggtgaaaccccatctctacaaaaatacaaaattagccaggtgtggtgatgcaagccctgtgggcccagctacttggggggctgaagcaggaggatcacttacacccaggaggtggaggctgcagtgagcggagattgcaccactgcactccagcctgggcgagagtgaaaccctgtctcgaaaaaaaaaaaagatctgtgcggcatcagtacagtaagctgtcttaaaaagactgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaagactgaacacaaatttctacagaacactgtgaatagaataatcctgttttaaaaagtatttgcctgtgtgtgtgtgtgtgtgcgtgtgtgtgtgtagacacaatatcaggttgaaccaaatgaaatggccattttgtaggacaaaaccaagcattggcaatttcacatggttcctgaatacataggaaataaaaagcaaacagaggagaaagcctgtgcccaggcagagaggaggtggcaggaggtagcactgacatgcgcatcacccacctccccacctgggggctcacacaggcctggggaccctgcactgttgcaggctgcaccctactctccctctggggagcccaggagaaaccctggctgtgtgtggccgtgcatttcataggaagggaccaagagcaaatgactgagctgcatgtggacagggaggcaccaggatctggctccggggccatctgccggctccacagcagaggaaggggagtctgcacccacaagagacaaagcgcaagacagaccccaccccaggaaacaggccacagaggccacggcacctcccagggccactgcccagtccacagaacagtggaccagaccctagcttctgcctcaaggtctggaatccccgcccctcaccactttgttctccaaggaacaacttcaggggtctctgtggggaaagtgcccactgtcacctctgagctcgggaggcagctcacaaaaaccagcttccttcacactcagatacacgcccatgtcacaagcaaactgcagccaccttggcactgtggtgagtctcccaccagaccctaacgccgtgtctcatgcagtgtttctctgccagggcgacttggatacccaggaaatatctggagctgtctggagacatttatggggggtgtgctcctggcacgtagcgggtagcagtgggggcacggctcatcagctcaaacccacaactcatccagctcaaagtgtcactagtgctcagggccgaagtcccataccagtgtgttcaaatacatagcaaataccactaacccataccagtgtcatatgcatggcagaatacccactaatccaaactggtgtgtcacatacacagcagaataccactgacccataccgatgttgtcacatcatggaggaataccactaacccatgctggtgtgtcacatacacagtgaataccactaaccccagtgttgggcatgtgaatagcttagcattgtcaccactaaagacagggctgtgatgagtaccccaatgggacattttttttttttgagacggagtctcactgtgtcgcccaggctggagtgcagtggcatgatcttggctcactgcatgctccacttcccgggttccagggattcttctgcctcagcctcccgagtagctgggactacaggtgcccgccaccacgcccagctaactttttgtatttttcgtacagacggggtttcaccgtgttagccaggatggtctggatctcctgacctcgtgatccgcccgtcttggcctcccgaagtgctgggattacaggcatgagccaccgcgcccagtcttttttttttttttttttttgagatggagtctcgctctgtcacccaggctggagtgcagtggcgcaatctcggctcactgcaagctccgcctcccgggttcacgccattctcctgcctcagcctcctgagtagctaggactacaggcgcccaccaccacgcctggctaattttttgtatttttagtagagacggggtttcaccgtgttagccaggatggtcttgatctcctgacctcatgatccgcccgcctcagcctcccaaagtgctaggattacaggcgtgaaccaccgcgcccagccccccaatgggacattttctatcaaatccatgatcatatgggataacagaggggcaaggtgttgtggcagtctcgggagaggacagagtgagggcagctcccctgagctgtgccttgaggccacacggcccagaccctgggggccccatcccttgggacatgaggccgcctcccctaggcaacggtcttggagggctttaggagcagggagtggcattcctaggcctggctggtcaactttaggtggagcaccagccctgcatcgggtaacctctggcttcatttgtcacttaagaagaaatccaatgagtcaactgcagctgtgagtgggcctaggagggcgtggatgcagacgccctggaaaccacagaggctcccccgtcaatagcggccctacgcccatcccaactcctaaacaaagttgctagtaagaaggaaactcacgcagccaggagttcatgccctctctcttccaagggccagtgggaagacggccaggcagatgggaaacgggaaataccctgcctcacctcagtgaggctgccctcatgccaggacactcacagccaggttccccaaggccctcgcagtgagcagggtgaggtgccgagccctgcatgtgccattcccccagtctccaggactctgccagatgggggtgacattcccctagtctccaggactctgcaggactggggtgacattcccccagtctccaggactctgccggacaggggtgacattcccccagtctccaggactctgccggacgggggtgacattcccccagtctccaggactctgcaggacaggggtgacattcccccattctccaggactctgccagatgggggtgacattcccccagtctccaggactctgccggatgggggtgacattcccccagtctccaggactctgccgggcgggggtgacattcccccagtctccaggactctgccggatgggggtgacattcccccagtctccaggactttgccagacgggggtgacaaataccatctctgacaacaaggaccccagcaggcaccgccaggcccctccgcaggcctcccctccaatcctcaccacggcctcgccaggaaggcgcttctgccctggtttcggagacacgactgaggctccagggtgcccagggagggcagggggcagcttcgctgctgctgagccagggggcgccaggccctcacgagtatgctcagatgccagctttgcttctgaggcctatgtgcctcccatgcactctggaagccaaatgtcctggaactcattgaaaacaccatgcagttggtcagatagaggcatgggtcacacggggacaagcacagcacacaggtgctcccagaagaagatttttaagggccagatatctgcagggcagtcctctccttggtcaacatcatccctgtcttcctagtcccactcacaggaaacagctgactcactgaatttcttttccagtttttttgtttttgtttttgtttgtgttttttttggagacagagtctcacctgtgtaacccaggctggagtacaatggcatggtcttggctcactgcaacctccgcctcccagattctagcgattctcctgccttagcctcctgagtaactgggactacaggtgtgtgccaccacacccggctaatttttgtatttttagtagagacggactttcactatgttgggcaggctggtcttgaactcctgacttcatgatcgcccaccttggcctcccaaaatgctgggattacaggcgtgagccaccgtgcctggcctgaatttctttttttcttttcttttttttttttttttttttgagtcggagtcttgctctgtcgcccaggctggagtgcggtggcacgatctcagctcactgcaagctccgcctcccaggttcacgccattctcctgcctcagcctcccgagtagatgggactacaggtgcccagcaccatgcccgctaatttaggaacatcgtgctgctctaggaacgtcgatccacccaccaaacttcacagcatgctccgtgcagtgccaaggaaagctccaacccggaaatgtgaacacacatggaccatggcctagattggtgacccagagaaggggcagtgccatttgggtcagggctgaagaatgcccaagaattaatcagaaaaggagaggggtagggaaaggaattcctgacacttcacttttttgtgccttggtgtcttcagaaaaataaagggtttggaggccgggcgtggtggctcatgcctgtaatcccagcactttgggaggctgaggcgggtggatcacgaggtcaagagactgagaccatcctggtcaacatggtgaaaccttgtctctgctaaaaatacaaaaattagccgggtgtggtggcgcgtacctgtaatccagctactcaggaggctaaggcagaagaatcacttgaacctgggaggcgggggttgcagtcagcagagatcgcactactgcactacagcctgggcgacaagagcaaactccgtctcaaaaaaaaaaaaaaaagaaaagaaaaataaagggtttggagaaggtgatttcctttttggttttttgtttgtttgtttgtttttctgagacggagtctcactctgtcgcccaggcaggagtacaatggcacgatctcggctcactgcaacctctgccttctgggttcaagcaagtctcctgcctcagcctcctgagtagctaggattacaggcacacaccaccacacctgactaatttttgtatttttagcagagatggggtttcactatgttagccaggctggtctggaactcctgacctcatgatccaccctccttcggcctcccaaagtgctgggattacaggcgtgagccactgcagccggcctgttgttgttcttacgtgaacacatgtgaaaggttttattaactcattttttaacaggggaaacagcgatgttaaaaccattcaaaggagtccaagaactgtgtgcgcaggcaacggggaaactggaaatgcgttgacaaactgacgcaaaactgggcccaacagccacaaggcactggtcgttttccactgggcaaagttcagtcgcatttctttctgttctctttctttcttttcttttttctctttctttctttctttctttcttctttctttctttctttctttctttctttctttctttctttcttttctttctttctttctttctctctctctttctgtctgtctctctctttctttccttctttccttccttccttctttctttccttcctttcctttctttcttttttttttcttttttgagatggagtctcgctctgttacccaggccggagtgcaatggcacaatctcggctcactgcaacctccacctcctgggttcaagtgattctcctgcttcagccccccaagcagatggggctataggcatgcaccatcatgcccagctaatttttgtatttttagcagagatggggtttcactatgttggccaggcgggtctcaaactcctgaccttgcgatccgcccccctcagcctctcaaagtgctgggattacaggcgtgagccactatgccggccgcaaaggattctttaacacaaaagggcaggactcatgagactgacctgaccattacatggtgcagtgagagttcaatttaactaagcctccttatgcttctttgactaatttagggccatgcagtgtcaaacagcaatgagggcacaaaagcagcttctccctggctatcttcagaaggaatcttagattgcccttgaacaccatcaacaatctgctatttggagggctggaaactaagcctaagaaaccaccaggcttcggccgggcacgctggctcatgcctgtaatcccagcactttgggaggccagggcaggctgatcacctgagcccaggagttcaagaccagcctaggcaatctggtgaaacccagtctctataatatatacaaaaactagccaggcatggtggcgtgtgcctgtagtcccagctactggggaaggattgcttgagcccgggaggtggaggttacagcgagctgagatcacgccactgcactccagcctgggcaacagagcctgaccctgtcccaaaaaaaaaaaaaaaaaaaaaaaatgccaggcgcagtcgctcatgcctgtaatctcagcactttgggaggccgaggcgggcggatcacaaggtcaggagatccagaccatcctggctaacacggtgaaaccccgtctctactaaaaatacaaaaaaattagccgggcgtggtggcgggcgcctgtaatcccagctactcgggaggctgaggcaggagaatggagtgaacccgggaggcggagcttgcagtgagccaagatagcgccactgtactccagcctgcgcgacagagcgagactccgtctcaaaaaaaaaaaaaaaagaaaaaaagaaagcaattccagcaggtttctcctgtagtgcctgtgcgagtgaagcccacccaaaggtgaggcgagggtgtgttctcagagctcccaacagcaagggactcggccgctgtcactcgcgtttgcctgggagaggctccaaggaaagctacccatcgatccgttacgtgcacctatgggttctctacttggtctcaagttggatggaagcagagacaaaacttcaggaagctgccagtcaatcaagccctggccatgtggggctgacagcatagactctagttactgcatggcttcccggatggttgctagtgacagcacccggctccacaagctggcctgtggcctcctggggggtccttgaaggtaacggggtccagtcatgtctgtttgtacattcagtctcatatctcttttattcaggtccctcaaagagcttaagttccccagctgctggcaagtgaccttcctgccacgctgtgagctggggccgagctactcttcccaggaggccgagacctcgcaggcactgactccacggtcgcctcagttcctctagaagtggctggtcagcatccttcacaaatacggcattccagggaaggccctggccgcactaggaacttatccagttatattttagtttgagaaaaggcacagacgccagtccctcaaaaaattaaacctagaactaccatttgacctagaattcagcttttgggtattacgctgaagaactgaaaagtagagcctggaacacacatttgcacacccatgctaacagcaaacaaaaggccaaaatagtccagatgtctaacagatgagtggaaaaataaaacatggggtgacatacaattgacacacgctacaacacagatgaacttgaagacactacgctgggcgaactaggccagtcatgaaaggacaaatacatgtggttctatctccaaggggtgcccagagtagtcaacttcacaaggatcagaaagtacaaaggcacctgccaagggctgggggtggcaagttagcgtttaatggtaccatttctgttttgaaaggtgaaaaagttctggagatggttggtggtaatggttgcacgacaatgagactgtactgaatgccactgaactgtacgcttaaaaatgcttaaaatgggaaatcttatgctatatctattttaccacgataaaaaaatatacacttaaaaaagagccaggtgggccaggtgtggtggctcatgcctgtaatcgcagcactttgggaggacgaggtgggcggatcacaaggtcaagagatcgagaccatcctggccaacatggtgaaaccccgtctctactaaaaatacaaaaattagctgggcgtggtggcgcacacctgtagtcccagctactcaggaggttgaggcaggagaatcacttgaacccgggaggcagaggttgcagtgagccgagatcacgccactacactccagcctggcgacagaaaaagactccgtctcaaaacaaaaaacaaaacaaaaaaaaaaaaacaaaagaaccaggtgtgggctgggtgcggtggctcacacctgtaatcctagcattttgggaggccaaagcaggtggatcacttgaggtcaggtgttcaagaccagcctggccaacatggagaaaaccccatctctactaaaaatacaaaaattagccgggcgtgcacctgtaatcccagctactcgggaggctgaggcaggagaatcgcttaaacccaggaggcggaggttgcagtgagccgagatcatgccactgcactccagcctgggtgacagagtgagaccccgtctcaaaacaaacaaacaaaaaacagagccaggtgtagtggtgtgcacctgtaatctcagctcctcagaaggctgcagtgggaggactgcttgaaagcccaggagctcaaggccagcctgggcaacatagtgaggccccaactctaaaaattattattattattaaagtttaaaattttttaaatttcaaatttcaattttaaaaaggacagattcttactgaacctatgcaaataactatatcaccacaaaaaataaggagacagtgagaatgggggttcactgagaaagcaatatcatttaaaaatgtttcggccgggcgaggtggctcacgcctgtaatcccagcactttgggaggccgaagcgggtggatcacgatgtcaggagatcgagaccatcctggctaaccctaagtctctactaaaaatacaaaaaattagccgggcgtggtggtgggcacctgtagtcccagctactcaggaggctgaggcaggagaatggcgtgaactcgggaggcagagcttgcagtgagccgagattgcgccactgcactccagcctgggcgacagagtgagactccatctcaaaaaaaaaaaaaaaaaaagtttcatatctggccgggcacaatgactcatgcctatactcccagcactttgggaggctgatgagggcagatcacttgaggtcaagcgttcaagaccagcctggccaacatctctactctacatcccagctctactaaaaatacaaaaacttagccaggtgaggtgatgggcaactgtagtcccagctactcgagaggctgaggcagaagaatcgcttgaacccaggaggcgggggttgcagtgaggtgagatcgcgccactgcactccagcctgggtaacagagcaagactctgtctcaaaaaaaaaaaaaaaaaaaaaaaaaagtttcatatccatctaccagagcagagcctactaaatcatcacggattacagacactaagaatgagaaagcatttcctcttacatctagaaaacagaaatgaacacatcagctatattccaagcaaaccaccacaattcagttccctcagcagcccgtcgcactctgcaggactcggagccagcttccagcctcacgaagccctggcccggcgcgctggggtggtctgagagccattgaggtaatgtccatgcagaagcctgggcccagaggctctattagtcactggtgaaagcaccaggcaatcctttcccacatggggaacatcagcatgggaagactcaaagtctcttttcataacgattttctaatgcatctggccagatgcgttattcagatatttctgaatatttcattcagatattttctgaatgaaaatatcctacacagagcaagggagggcactgacaagcacggggcctcccgccaagcccagaacttctgaattatttccatgaataacatttacacatacacaccgaaccaaggagctgtggccagcgtctcttgtgatttgacaaccactcttcccgtgcaggtcttacaagataacgcttaaaacaaacctcattatgtctatggtatttttctttttataaggtgaatgatcaaatctttgtgattttccaggggcactcagagtctcagggacagttttagaggcaatctggacagttgtttaaggcaggctcgcgggtgtctgagagagacttgattatccattaacaaaacaaacctgatgtttcacaagtgatgaacctttgttctttgttttttccccttaaataagcacaaacataataaagtcaacataaagcatcaaaaatgattctgctatacagaacctctgccatccaggtgcattacacagaaaggaaagaataatctttcacttttttttttttttttttttgagatgaagtctcgctctgtcgcccaggctggagtgcagtggcgtgatcttggctcactgcaagctctgcctcctgggttcacgccattctcctgcctcagcctcccgagtagctgggactacaggcgcccgccaccacgcccggctaattttttgtatttttagtggagacggggtttcaccgtgttagccaggatggtctcgatctcctgacatcgtcgtgatccacccgcctcggcctcccaaagtgctgggattacaggcataagccaccgcacccggccataatctttcactttgaaggcaaaggcattaatgagtaaacaaagaaggcaagaccatcaaggccagcaaactttgctaaaattgtgacataattcattgctgcttttcagactcaggtaccatgatgataaaaggcacatacctagttttgcccttcactatgttttttgtcatttttaccatattctggaaaacactggtaaatcgctttaggagagagtgtggaccaggatatcctagggtgcctgaggcccttttcagagaatctgtgaggttgaaaagcttccataacacagtttcttctgtcattctctcatgagggtacagtggactttcccaggggctgagcgaaagagatactgcaacaaccgagaatccaggtatcctctattcagtcagacacccaggagatctgcagaaacactgacgcaatgctgttcttctcaatagaaatgttttgttttataaaatagttacgttggccaggcgaggtggctcacgctcgtaatcccagaactttgggaggccgaggcgggtggatcacctgaggtcaggagtttgagaccagcctgaccaatatggtgaaatcccgtctctactaaaaatacaaaaattagccgggcatgatggcgtgcacctgtaacccagctactcgggaggctgaggcagaagaattgcttgaacccagaaggcagaggttgcagtgagccaagatcaggccactgcactccagcctggtcaacagagcaagactctgtctcaaaattaattaattaattaatttaattaaacaatttcacaaatttcaaatgaatgaacacttttttttttttggagacagggtctcactctgtcaagcaggctagagtgcagtagcacgatcatggcccactacagcctcaaactcctgggctcaagtgatcctcctgcctcagcttcccaaagtgctgggattacaggtaaggaccactgtgactggcctatttttaaaatttctcagttttaattctaacacagaatatagggataaaagcctacttaatcaaacgctttttggttcctcaataatttttatatataaagggatctagagaccaaaaagtttgagaagtgctgctttgaggaaaaaaaacaaaacctgtttgtttgtttgtttttttaagacggagtctcactctgtcacccaggctggagtgcaatggcgtgatcttgcctcattacatcctccgcctcccaggctcaagcgattctcctgcctcagcctcccgagtagctgggactacaggcatgcaccacctcatccggctaatttttgtatttttagtagagatgaggtttcaccatgttagcctggctggtctcaaactcctgaccttaggcgatccacccgcctcagcctcccaaagtgctggcattacaggcgtgagaaacttcgcctggccacctgtattttttctttgaaaaataaaagcatttacatagctgtttgtctccatcatgtgtattaattataacttttttttttttgagacatagtctggctctgtcatccaggctggagtgcagtggcacaatcttggctcactgcaaccttcgtctcctgggttcaagtgattctcctgcctcagcctcccaagtagctgggattacaggtgaccgccaccacacctggctaatttttgtatttttagtagagaccgggttcctccgtgctggtcaagctggtctcgaacttctgacctcaggtgatccgcccgccttggtctcccaaagtgctgggattacaggcgtgaaccaccgtgcctggccttattataacttttaacaaagtaactgacttccattttacagagaaccgcaggctgacagttgagagctgtctccagacacatgtttagcagacgcctgtgggcacacacaccatagccttcacagccactcgcgcccttctatgcttcctcaacatgaaaacatactttttttttttttttgaaaagcaaccatttattagaaccaatacaagagtatgaaaagagggaaaagaggagggtagaagagggggagagaatgaggtctgtatcagatgtcagttatggaaacacataaatgcttactctttttaaacactgacatttacaaggtgaacatatatatagaccacttataatttaaaaaaaaaaaaaatcaaaagcagacatgtttggctgaaataaaaccaggaaacacaaccaaaactcccccataaacctaaaagtccatggagaattcaatttctcatttccattcagaaatctggctacagagtgatttgtttgctacttgggacagtacagcgtgctgaaagaaacccagctactgagtctcttagatcccatcctgtaggaagtggtgggaaagccagcggaccatgggcaagtcaactcctggctacttggcagggcgtcagactgtgctctctccattccccaggactccacagaaccgtctggtactgctagtgctgggtgaacagtgagagcacagtccacaaaacacagagaaccagaatgtgactgcaagcagccaggaccttgtgctttttcatggattacaaatctagggccaaggagagggaaaggagaaagagccctattgggaagaggcgttggctgtgcccctacactgagatggaaagagtaaggctcttgagcccacacctgggcaagtagaaatagtgtccaaacttttctcaaaccagagggaaaaaaggtcaaggttaggttaagactgcagacactaagagatcacagatgctgaatacagtgaatcggatgaagctttaaggatcaatgcccaattctgagtgttacacacatttctaggaaaaataattccaatgtagctttttgttggggggtggaaataaggtggtcacatttattgaatcagctgtccctatgaggaaggagaggcccgggtacagataccacaaaggggtacagtgacccagctgtcctgggatcggttggggagtggtaagcaatgacataaatcaaaaccattgagggttgctttgatcctgagacagtctgagtctgcttcaaacccatggggaatggaactttcatccccaacctgcagagagaaataagcggtagcatctctgcctcacgattccctaatccaatgctcctgcatctgaaatgacctccctctgtgaatgcaagacacagaaaatcccaagtgccttccccaacaacatcctaagtaagtctggactagtaagattccaacattcatgaaaacactgtcaacatctgaactagcagatctgatgaggggtgggggtagagaatttgccgagtcagtaagtagttccagtcttggagacagctcagtgaggaccaaagcctgtgtgtccggctcaagacatcctccacagaggacccaagacatcctccacagaggacccaagacatcctccacagaggaccctgcggtattctattaactttgacttacaatgcctcacaacaacgcccctgtgaggtaggtcagtatgatcacccccatttgacagatggggaactgaggcattgaaagaagtgacttgccaaggtcatgactgcaggccaagatacggcctctttttagagctgaaaaaaacccaggtatacctagtaaccaatgttttactattctgtcttaccgagtaagtatgtcgatatccaaagaatacctactcaactccatttagtatcagtccaaggttttaagttacctaagctttattttggtacagtacactttcagaataatgaacacatttatttgaacacaaacttatatttttcataatcttaaacattatgtaacagtaatattagctgatttgataagtaaacccgtagaagtttaggggaggaagccaagtagaacaaaaggtacacctgtattatagctaatgctgataaactgaagaaaaggggggaaggatagcattaggagatatacctaatgacgagttaatgggtgcagcacaccaacatggcacatgtatatatatgtaacaaacctgcacgttgtgcacatgtaccctaaaacttaaagtataataataaaaagaaactgaagaaaagacatagctttttaaaacccaaattattagtctcatttgccaaagatttacatcaattacgtgaacttagatgattattgttattattattattggagacagggtctggctctgttccgcaggccggactgcagtggtgcagtcacagctcactacagcctcaacctcccgggctcaggcgatcctcccccctcagcctccagagccgggactacaggcacaaccaccatgcccggctaatcttttattttttgtagagtcaaggtcttgccatgttgcccaggctggtatcgagctcctggactcaagacatcctcctgcctcagcctcccaaattgctaggattacaggtgtgagccactgcacctggcctgaacttaagattcttaaaatattccagtttgtttctgtaagaagaatttctttctttctttttttttttttttttgagatggagtctcactttgtcgcccaggctggagtgcagtggcgcgatctcagctcactgcaagctccgcctcccaagctcaagcgattctcctgcctcagcctcccgagtagctggaattacaggcatgcaccactatgccgggctaattttgtatttttagtagagagggggtttctccatgttggcctggctggtctcaaactcccgacctcaggtgatcgacccgcctcggcctcccaaagtgctgggattacaggcgtgagccacttcgcgcccagccttttttgtttgtctgtttgttttttgagacagagtctcactctgttgcccaggctggagtgcaatggtgtgatctctgctcactgcaacctccgcagcctgggttcacgccattctcctgcctcagcctcccaagtagttgggagtataggcgtctgccaccacgcccggctaattgtttgtattttttagtggacacggggtttcactgtgttaaccaggatggtctggatctcctgacctcgtgatctgcctgcctcagcctcccaaagtgctgggattacaggcctgagccaccatgcccggccaagaatttctttttaaatttaaagtctagtgcattaaaattattagaagtacagccaggcgtggtggctcacgcctgtaatcccagcactctgggaggccaaggcaggaggatcacctgagatcaggagttcgagaccagcctggccaacatggtgaaaccccatctctactaaaaatacaaaaattagctgggcatggtggcacacacctgtaatcccagctacttgggaggctgaggcaggagaatctcttgaacccaggaggcagaggttgcagtgagccgagatcgcgccactgcactctagcctgtgtgacagagtgagattccatctcaaaaaaaaaaaattataataaataaagaaataaattattagaagtacgattttcctacgttctggaaatcttagaaatatttacttacataagctaatcacgaaccaatcagaatagagttcctccaattcaagacacttcatgaccttacccaatgactcaaaaaaagttttccacattcacttagtgagaggcaaaggcctttctgaattacaacttcagccccagggcaagagtaaacacagaaactggaaaagtccctggaccaggtgtcaaagaggtatccttcccggtggacacaaaattctgaattgaattgagctcaaaagaggctaaggacacagagaacgaagtctgatcatccagattctccgtatctgaccacagagaactgatctctgtcatccgcctacaaagatgagcaaaacaatatgaccacaaaccaatgctcaatcactgatgccaccaagccatgggtaagcccgaaaccaacagaacacagagtcaggggcaggggaaacagagacacggagagaaaacggagaaacagcgtccgcgaagtgaaaagttccattgctgcttgaatttgcctctggtagccaagaaaaggccagcactgtgggaggccaaggcaggaggatcacttgagcccaggagtttgaggcaaacctgggcaacacagtgagaccctgtctctacaaaaaatacaaaataaaaaatgaaggaaacattgacacctactgtaacatgagttacagcagttaacatgagttgaaaatatgctacatgaaagaagtcagtcacaaaagaccacgtagtgtgtgattccattagtatgaaatgtcctaaatgtgcaactccatagacagaaagattagggctgccagggctgcggagcagccaccagtgtgtctggagcttctctttgggttactgaaatgttctgcctgtaggcggtggtgacggtcgcacaccgtgtatatactaagccactgaactgtgccctttgatgggtgaattttatggcatgtgcagtatgtctcaatcaaacggtttttgaaaaggcagccagcaggaggagacatgaggaggcaagagcctcttcaggtgactggggccccctcccagaggtcggaggctccaccacaggccccagaagtcagtggacccctatgctccaggtctttgtgacccgggagtcctgcctccctcccctgcccaggccctgggcttctgggtggggcatggtggatggcaggggaaggcaggtgtccctcagctactccagaatccctggtgagcctctggtgagcctcctggtccgcccctccctgaactctctgtagactctgtcataaagaacaaggctgggccgcaaggtggctcacgcctgtaatcccagcactttgggaggccgaggcgggtggatcacgaggtcaggagatcgagaccatcctggctaacacggtgaaaccccttctctactaaaaatagaaaaaattagccggcatggtggtgggcacctgtagtcccagctactcgggaagctgaggcaggagaatggcgtgaaactcgggaggcagagcttgcagtgagccgagatcgcgccactgcactctagcctgggcgacagagcgagactccgtctcaaaaaaaaaaaaaaaaaaaattagccgggcgtggtggtgggcgcctgtagtcccagctactcaggaggctgagacaggagaatggcgtgaacctgggaggcggagcttgcagggagcagagatcgtgccactgcactccagcctgggcgacagagtgagactcgtctcaaaaataaataaataaataaataaataaataaataataactaaataaataaagaacaaggctttcaccacatcccaggcagagtccaagtcagggcagagcctcacagagcacagcagggcctgtgccgtgccaacgccatgcccctgcctggcagaaatgccacccagcccctggcagaaacgcctcccctctcctatggaggggctgatgacccaggagcggctggctgctggtgtgagtacacgggtgacccttccacaaaggcccctagctgggctccctgctcagttggccgggtttggggctggatgtctgcaggggtcctcagggatacccagagggagaaacaaggcttttggggaaatggtgacacctggggccaggtttctcacagccaggccccatctctccctgcctggatttcaggggaagtggggcttgggtaaacaggaacggacgtggccatcaggccggaagggtgtgtgggccacagagaagcaccctgaggctgtgctgtcatccagagtgccaccccgcttttccagggcacagcaaggaagtgcctgctggaaggatcctggggacagttgttaaggcaattttatcttctcatagcatgcctgcctcagttccgcagccaggacggtgccttactgactccacacacagaggcagctgggtccaggaggcagccatcccaaacgcagtgacctccagcacccaaagctcagagttcccagctgaacccaggaggcacccaccttcctgtctctaggcagatgccagctggtgcaggagccactcccagtcccaataccaggcctggtcacgtggtgccccgccaggcttgggggtgtgcacttgcccgctggcctccggtgccctcaggcctagcctcattgtcacaggaacggagctcctcggggatggccaccttcctggacttacccccaggagggacacgctgctgcctcccagggcccttcgtgccactggcccctttctttccacccccatatgctacccctgcctactcccttccctggccctgggttgccactcctgtcctgttctcctgctgtccccaccccagccctgaccccagatggctctccctacaaaaacaccagaaccccagagaagctcaatcccccaagtccatctgcattttaagaagccctcacgcactcccagcccagagagggaagctgtaaaggtggacaggtcatgtcgggctttgaacctgcaatgtgatctcaccttccccgtctgtaaaaggggacactccctgccttgtgggatcacatgcagtatcagaaaaagcacctgacatgtgacatccacttacaaagggttttcccttctctttggttttgggggagaatgggagaggcccaagcagaagctcctggaacaccgcccatcccggacccagggttgtagtcacctgaacactcacccagacaagggaaacttcacagaatgaatgtgaggaataaaatgagacattcagttacacaaattaaaccaaacccagatgcagaggtgccccataacagaaatagagcaactactgccagccttggatgaaagctcttggccaagggccgtgacggcggcggggaggttcagcagctgtccccaagcacacaggacatttggcacctccaagcccagcctgtcccaccaggccacggcacactttccttcctctgaagaaagggggtttgttaagccaacgaggagggaagccaaggactgcccccggcgccagcatggctatgagcatagaagcgggctgagccacaggctgggggatcccatgcagaccaggcaaagcccaggcaggatgctctgcagaaagttccctggtgatccggacccggagccagactgagccgcagccccagaagacaggtatctcctcccctggggccacagcagccacagaggccacccacggcttccactaggacagtgtgtctttccagttactctacgtacctaaaagtgaccagccccctttcaggtctggtctatgatccagatggtgatctttcccccactttttttttgagacggagtctcgctctgtcccccaggctggagtgcagtggcgcgatctcggctcactgcaagctccacctcccgggttcacaccattctcctgcctcagcctcccaggtagctgggactatgggcgccccccaccacgcacagctaattttctgtatttttagtagagacggggtttcaacgtcttagtcaggacggtcttgatctcctgacctcatgatccgcccaactcggcctcccaaagtgctgggattacaggcgtgagccaccgcgcccggctggtctttcccctttaagaccccacttcccacccccaccctggccaagctgataggattcaaggagtgcggcggtgcaatcacagctcactatagccttgacctcccgggctcgagcaatcctcccgtctcagcctcccaaagccacttcctccttttcttagttgttggcttcttctacagaaaaggatcctgaaaacaaacacctaaaatgccaaccaagaattcaatctgcaaggcagcagcacctccagaaatagctgctttgtggcctgtttgccatttatgtgaaacttccccattttggaccaacgcaggcagaaagagaaaaggaggaagaggaaggaaaagaggcaggctgtgttggggctggatggggctgtaggaacctgccagcagtggctcttggggaaaaccccactgcgaggtttctgaacccctgccccggaagcttcccctttcccacacacgtcactcgctgccttggaatctgggctgcctccctcccaggggctcacaggggagcgaggccacagaaaggctccttacccccagtggcctaacaggtgtgacatgtggagggggaatctgggcagtgtgcctgatgctcagagctgagaccctgaagtccaactccctcgggtgtgaccttggacaagttacttagcctctccttgcctcagttacaccatctggagaatggggatgctaccctcgtctgaccaccgtgatgtgagccagtcagcacacatcaagtgctccgtgagcgtccggcacacaggtgcttgtctctgtcctgtgcttcagctccatcagtgtcttcttcagacctgtcattggcttggggcaaggatatatgtggccgctgagggcggtccgccaggtatggcagccatggagctgctaattaggccctgtgagtgggaggccctgtggggtgggcaggggcagacgcccagctgctctcggggacactccaggcctgtgctgccctccacagccccagctggagaatggtgaccagatgtcaacgacaggaagcatttccagaggccacagctctgcagggaggtctctcatgggctgacagccagagccagcgctccgggtcccctgaaaaaacgggcacagtcctcggtcacgtcgaggacctgctcagcccctccacttggcaccggagagaggatgactcacggcccttctgcctggaaggcaggctccagtgtcaaatgtccatccgcctccatcaccctcatccatccttgtcagtccaggggcctgggcactgctggggctcctgggcagacagttcccccttgcaaatgagtgggaccctcagctccttcgatcagcatcctcacgtcagccgagcctgtgagcacccctaagcaaggcctctgagctgggcatgcgacaccccttcccacccaggcaccctccccctagaatcccccataccaccctggggccatgccccgcttccctctctggcaagctcctgcacaaccttgagaccacctgacagccaccgtctatcctgcccaacctcctcagaagcactaacagcacctcgccccagccacggcaggtctctgcacccctcgtctcagtcaccactctcacatctcatgaacagagacacgagctgcttcctcatgctccctgtgcccgtcctgggagatccctgcctttaaaccccagccacgaactgctgaccccgcatttcctcttccctccctgggcaagaggggcagaaggggcagggacgcacaccctgggccgcaggcagaggcttggccagggtcgtcctcccggcagtgcctccctggagctctgtctacctcaactcctgatgccagaggatccctctgcgctccccacacccttaagaccccagctcagggaatctggtctcggtcatcactcccaggggactgcagggccccaggacggcacacattcaggcccaggagagctccccccatctcaaagcctcctgtgggtggagatggaatgtggaaaaaccgcatcctctgcagctcccccacagtgagagcgaggactgagggtgtggataaggctccaggaagggggtgcaagcctgagaaggtggaagagctctgggtgggtccatctgctcctcacctgccccaaccctgcctgcaggtgaaggccggtccagccgcagaaggcccagcccccagcccacttacagaatccgcactgtgctcctccagccggcccggcccctcgctgcccaccgagccatcatgaccccagcaccgctgcacattcgtatttgttgaatgaatgaatgaacccttgccagcccagccacttggtggctgagggcttcagagctctcccagggtcccctggggtcattcagccactcaacagtttcccagcagcagcagcgaggatccgcacatcattgccagtgctctaaggagcgggcgagccccagtaagcggccgctctgaccgcgctttgtcagccctgagctccgctcgggaggagccggcaggtgtctgcggtgctggaaagaccacggtgtgggcggggattccgatccgccggcaagggtggcctgcacccggccaggcccgcgggttttctcctctccggggctggcctcggcccctc

SEQ ID NO: 1785 - DNA, 39904 bp, Homo sapiens; identical to SEQ ID NO: 1784

SEQ ID NO: 1786 - DNA, 40357 bp, Homo sapiens; identical to SEQ ID NO: 1782

SEQ ID NO: 1787 - DNA, 40357 bp, Homo sapiens; identical to SEQ ID NO: 1782

SEQ ID NO: 1788 - DNA, 40527 bp, Homo sapiens
cgtagtgttaggaagatttatttccaaacagtggcctccacactgcgcggcagcacttctttttagtatttgtaagcttttgcccactttcaattgagccagccctagcgtggtatgtattgcatgctgaacaatatagagtttgtttttcctttctgatgattttaaactcttaaagaacaggaaagcatctggtaagaagaaatcatgagtccgtcagtgcccttactcatatgcgtctccagtggcctcatgttgtggtcacaggagtttcctgttcacagcaatgtgtgtgatatggacccagcatccactgtcgtgcttttaaactgattcctgggacatagcttaccactggaacagcagaccagtgttgcactgtttctaaagctaagcttttccttatttattttggtactacctaagtgacttggttttgactgtccctaagagagggaaccactttgctgaatttttaaaaagtccaactgctctttcatcttttatgcttagaaacctgttctctccagatgcacttctgaggcatggatgagctgagcgtatggctagaaattggaagtttacagctattaccagggggctaactcccggggcatcgcagtagcttctggcacccgtggcttcatgtctttagcaaagtcttgatgtcatggaaagagaaaaagtgtatgcagttagttacctgattttgtaaacaaacagtggctgacctgggcccttaaatcaccttcacaccttttagaaccacaagtggttctttttgactccaacaaaggaaacgaagttgaaaaagtcaagcccctgtgtactggggccggacttcccatcatttgagtgcagcactttagttcagaatctctgtgccatgtggttttttaaacaggaagattgttggttccttagtattaagatagatagtccctattttgagtggaatttttcatttgtaaggggtatgttccttctctgattcttgctttcctcaaacaggatactgcctgctgtaagaccatcctctatggttgtactttaataaacagtaatttttttttaccaaaaaaattgtattttgtttctacttccttgaaacctgctttccaatttaatttttaagtgggaacctgcacagtggaaataaaggcaccgtgtgtagatttacagatgtgcagattcatgtgtggatgatatgaaggccattcaaatacgtgtaaatggacattttcattcaagtatattaatgtagatattttaaagtgggttataagtttaacattgtctttaaaatagaagtcacagctatcttccagcctgtcttctctaggaacgctgttgacatgccagggctccgtctacactggaagcagctatacagctgtgaccacatcgagctttagccagtcacacttctggaactgtccgttcagtccatcccctagagcaagaaaggagaaaaagccagaatcagctaggctcattcacaaaccaggctccagagctctgtgccacagtagagcaaagctggggtttatgcaaaaacatgttctccagacccctgaagtcctatccgtgcatcctactttttgctacatgggggcaactgcaaaaacaggccgttcaggcggtgaggtgggtattcacatctccaaggcactgacggtgtcaggaggcccctgctgggtcagaggaatcacgattctgcctcagccctcagtctctggtaagctgtccatacagactgctgcacacgtcttgcccaccctttccccctttacatgggtgttggtaaaagctgtccaggaatggtctcaggcttacctccttccaacaattcagctgggtttaatgcctgatttaagatttatattcattctcctgtttttaaaatgcttgtataactgaagaccacagcatataaggaatgttttcttatgagttctcagtagaggattagatgctattttacttaaaaaccaaagcctgaagtaatgcttctgacatgtcataaaatcccaaacattaggccgggcgcagtggctcacgcctgtaatcccagcactttgggaggccgaggtgggcggatcacctgaggttgggagttcgagaccagcctaacatgggagaaacctcatctctactaaaaatacaaaattagccggtcatggtggtgtgtgcctgtaatcccagcttcttggggggctgaggcaggagaatcgcttgaacctgggaggcagaggttgtggtgagctgagatcgtgccattgcactccagcctgggcaacaagagcaaaattctgtctcaaaaaaaaaaaaaaaaaaaattcccaaacattcgctaatatttttaaatttacaaataagacacatccacttaatttccatttgggtctatgaaacagaagcaccagattttgctacatgggggcagctgcaaaaactggcccttcttgggcagcattgtgaacactgtatgtttgtttttagagacaggtcttgtttttgttcaggctggagtgcagtggcacaatcagctcactgcagccttgaactcctgggctcaagcaaagagatccttctgccccagcctcctgaggagctgcctcaacctccatgacggcgtgaactacaggcgtacgccaccatgctcagctaattttttttttttttgagacagtcttaccccatcatccaggctggagtgcagtggcgtgattgcggctcactgcaacctctgccaccagggttcaagcgattctcctgccttagcctcctgagtagctgggattacaggcgcccgccaccacacccagctaattttttttgtatttttagtagaaacggggtttcaccatcttggccaggctggtcttgaactcctgacttcatgatccgcctgccttggcctcccaaagtgctgggattacaggcgtgagccaccgcgcctggccctcagctaattatttttataaattttttagagacagggtctcgccatgttgctcagttttgtctcaaactcctggcctcaagcaatcccactgcttctgcttcccaaatcgctgggattacaggcttgagccaccatgcccagcctttagactgtgacttgtaatacctggttatgggacagatgtgctctggaaaagatttcagacagttcccccccttttttgactactcgttttggttcacattacaccttttttttgagatggagtcttgctctgtcgcccaggctaaagtgcagtggtgcgatctcagttcactgcaacctctgcctccagggttcaagcagttctcctgcctcagcctcctgagtagctgggactacaggtgtgcgccaccatgcccggctaatttttgtattttagtagagacgggctttcaccctgttggccagggtggtctggaactcctgacctcaggtgatccacctgccttggcctcccagagcagtgggatcacaggcatgagccaccgcactggccacattacacttattttttatggcaaggtgagaggtctgaaaagctcattgtgagccctccagccccttccttccactctgtacctgcttgtgccttgaggaccccaccaggagtgtgacgtgagcctttgccacccctctgaatggagcatgtctccaatagtaagctgctaaagctccaaaggactctgggtgctcttcgtcacctttacacacagctttctagctcacaacagcaaaaccaaacccgagcaggacagcctgtaacccttgtgctggcatcagaggcaggggccccgctgggcttctcaaccttccagagaaaagggcatgggcggcaggcagggaaggagctgacctcaagggttcttacatttctggctaagctcctcacgtaggtgcgtaggttctggttaataaaattcactgttgtgtgaaagacatcacggagcaaggacggcgtgtgactggccaccttcttggccagcagcagggccagcaccagcatggtcttctccttctccatgtctctagggtaggcctgcagcagctgctccagggcagtggccaggtccctgttccggtcctgcacagaggggcacacagaacctggtttactaatactcttccctctcaaaggaaagacagtccccagtatgaagaagcacttcaaagtacttattaagtatccagggctgctgggcggaaagaatgagaaacagttgagttctgagaggcaatggaaagggaagactgcaatcactccctgcagggggctcggtaagcaaacgcatgtgtggtgagcccatgtgcccactgttagacggtgatgggatacaagaagcctgggtcatccctgcgcccaaggcacttcgagtccagaactagtgaccacctgcgacgccttaggcccattttattggtgcagacctagctgaatggacaggaggaagggggttcctgggggacactagacagactacaaggctggcaaggaccgtcaggcggtcggcgcacatgcagagttacatgggagtgcgccagccactcctgcgttctaggcagctgctgggacatcacaggctggccccactgaacagaagcatgattggatttctaggaggtgaggacgcctgcattttcagctggtagagtcgaaaaagtggaactttctctcctctcagctcctaccgctacaggcctgcatttggcagttgggaggatgtagttctttccgctaagtgttctggggacacagtgccccggaccaatcttgtatccccaacagtgccaagcagatggtagagctcagaaagttgtgtggattccaaccaaggagctcagcagagcagcaggcaccactcccagggcttacggttctcactggcaccattattaaactccctacaaccaaaggaagcgtctgtttcttctgttggccaaacatgcttcgttcatcttttagaggcttttacccctaaactctttactctgatttaaggttcaggtttcctcgatgtcaaccagctgaaatcttctgcaaggcaatgaaccataccctacgtccagttacttcgtcagagttctggacctgacagtcacgagttgagtggcctcacgggacagtgggctgcctggtgagaggcaggggacaggcccccttggctcacttgcccgcccacgcggtcctcaggccctcactcacctcctccgaccggctggtgttcctgagctgcagggccaggccgttcaccaggcccggagggatgctacggtccatgctgtccccgacctgggcgaggtgcctggcaatattccggatgatgtcttcttgactttcagaatctgtgttcaggcaggggcggcagagacagagcagactcagaaaatgtccctgataccctctcccacaccaccctgccccgggaaaggacaggtccgcgatgggacaaggccagcccccactgggcacgtgctccactccaccagggccacagcgggcgggctgagtaccagcgctgagctgggttctgggcagtgccggagctcagggcctcggctgaggcccaggctcccgcacacaggcaccacgtccccacaggcagggccggtgaagctggggcatcacgaccacgcctgaggtacaagcctggcagcggcttcatggctcacaccacacaacccaacagggttggccttggcctgggcagccgttggggaaggggctctgtgggcagacggcatcccagacccacttttgccctctcaagcctgagagcccccattcctcgcagtcccgtctcaggaaaaccccagttgtcactggcaccggcaaggccctggagaatctcccctgcctttccaaccagagctctcccccttgcccctcagtcctcctcctctggcgcacagcctccgtgctgcccctgcccgagtaccactgtcgcagctccatgaaggccacgctcaactgccacgctccctgccgcctccgtttcttcctcagcacttgctgtgttattgtctgacgcccctgccagaaggtaagctccctaagggctgtgatttttttaatctgttttgtccactgacaaatacccagcacttaatacatggcactcagtaggtgctcaataaacaatggcagggaccaggtgtggtcatgcatgcctgtaatcccagtgctttgggaggctgaggacagaagattgcttaaggccaggagttagaggatgcagtgagccgtgattgcaccagcaacaaagcaaggccctgcctctacaagaaactttttttttttttttgagacggagtcttgctctgtcacccaggctggagtgcagtggcgcgatctcggctcactgcaaccttcgcctcctgggttcaagcaagtctcatgcttcagcctcctgagtagctgggattacaggcgcccgccaccacacccggctaatttttgtattttaagtagagacgggtttcaccatgttggtcaggctggtctcgaactcctgaccttgtgatcctcctgccttggcctcccaaagtgctgggattacaggtgtgagccactgtgccctgcctctacaaaaaacttttaaagggagccaggtgtaccgcacgtacctataatcccagctacacaggaggctgaggtgggaggactccttgaggccaggaattcaaggctgcagtgagctgtgatcataccactacactccagcctgggcaacagagcaagaccccgtttcttaaaaaaagttttaattgcatgaatgaatgaatgggccctgtacctagctcccagtaagtgttcaatagatgccagctattgttatttctcccattaaatcttctattttttctgtgcttgcaacttccctctggcttttttggttttggctgctgctcccaccctcggtcagctgtcaaatctcaccttatgttgcaaatacaagcgttttgcctaccctctgccattgccgccaccctggtgggggtccccttagctctcatctgatgatgacagccccactccctgccgtccagtctactcggccaccttcacagcacagacctcagagcagggcagggttgggagaagtgacgtgctaaggagtgggcacgttcttagaagctgtgctctgggggtttcacggcctccctggagtctgtccatggaacatgcagtaaggctgccacatcacttctcttcaaaacctctcaagtgctcatctctgcttaagtgacaagtcatgacccagcctgaaagtacgtctgacttaacttccacgcttcctaggcaaactcaactactcactgtagcttttttttttcttttttttttcaagacatagtctcactctgttccccaagctggagtgcagtggtacaatctcagctcactgcaacctccgcttcccgggttcaaacaattctctacctcagcctcccaagtagctgggattacaggcacccgccaccccgcctggctaatttttatatattttttttagtagagacggggtttcaccatcttggctagggtggtcttgaactcctgacctcatgatccacctgccttggcctcccaaagtgctgggattacaggcgtgaaccactgcacccagcctcactgtagcatttatagccgctgggcttttgcttaaaagatggccattccctcttcccagtttccaaggaaccaaacatacccaacccccaaggcccagctcaattggagctgcagccccaaagttttcctgattccctgcagagcagagcacccagctcctccagcacctcatcactcccccagcaccgaatctgtgcctcgctcgttcccgaagcttatccaccttgcttcagttacggacacgtcctctctccctctggccaccagccgagtagcaacaggaatctttcctgatccgtctgtgtccagccgagtgaacggactcaccaaagaaaccccggcagccagagcctctaccttgcccctctttccaggctcgccagggactagattcacagtccctgtcacctgcaggctaagtgaactgccatgatcacttttgcaggtgccacttgagtcaaccccggtttctcagtctagaggcaaaggccggcatggagaagagcgagagaaaaacaccagggcagactggggctacagtcacccccacagcagtgctgacagcagagctgtgcctgtccactcctgcccttcctggaccttcccaaagggatctggggtttctcctcagttcagggcgagccagaagatatgctggctggattagaaggcagagacattctcagacacctccccccaccccccacccccacccccaccccggtctagtggggaactccagccacgtcctcaagcacctgatctaagacaggcgggaggcagaaggctgggtcagctgttggtctcccccacagccaccagagggcagtgcaacccttgagcttggaaggcctggaccagggtccggggatccctgcaggctttcagggcagggattctacctgcgtcagaatcctctgggcagtctcccgccctaaaacagcctgatgcaggcagctggagtagggcccaaggcctgcatttggaaaaggtttctcgtgtaattccaatgtgcacactactgaaagccagcgtcgcagggctggatctggaagtgggtgagcctccactcgcccccagcctccactcgggacagcccctgtccatagaagcagccccttggcaaaggggagtggagctggaggctggaggagagtgcagggatcagcaacaggaaaggtgaacagtctggaaaccatggtgacctggagtcagtgccctacagtgggagggcggctgaggcccacctcaagaaggggcctggccccatgtcccagtggtaacatggccacaagctgtgtgatctggagctagtcatttaccctttgctggacctgggtttcctcacctggaaatgaggttccaaatacttctgtgttcttgtataggtaatcacggagcataatgtatgaaaggaaatatgtcaggtatagacagtgcaaaagtcactgtgaaaccagtgggcctcaatcaatgggacagtcagccaggcctgcttggggaggcaggggccgcaccggtagtgccacctgggggctttgcccagacccagcaatgcccagaccaaccaatcagaatctctggaggtgagatgcaggcaccagcatttaaagctccaggtccttgaaatgatacaaggccaagtgtgagaaccccttgggttatataatccagacaagtggtctgcaatctttgtatcagaatcacatttggaaaattggataaaaacaccattctatgttggtccagacaagggactcaagaccagtacatgagattctgtctcaacagaaaggaagaactttctaacagagtcacccaaaaatggtaggcagtgagttcagcagcactggagggaatcaagtagagaccagtcaagtgattaagtgataccagcgtacgtggcagctgaaactgcagaggcagagtgatcccgggggtcccttccagccctgaggctccctgaatgttactggcgacagagaagcccagctttggggaaggaggtggggccggccgcctacctgcctctattcttcccaagcgggagtggctgctgcggttgccatcagtctgcagctcatcgtagccctcccactggggagccagcactggcagctcgtggcccagtgcgtccagctctctgcggaagctgttgtcagaacagctttggaggaagccaaacaccagtaggtttgtgatgcactcatccctgaggctggaaccgttgttgacctgaggggaaaggggagtcaggaagccgggacttcagccaggccagaggcccctcctgcaaagagctccagttgcagctggcccaaagagcctcacaggtcccagagagctgagggaccctgtgggctggagggccctgcaggaggtctcaacaggcagaggcaaggtctgcagccacagctttaagcagcactgcccgtagatggcagggagcgagccccgactctgcagaaagggattcctctgcagaggaatctgctggacctcctgaaacacgcggctggggagcttcccactaggtgagaaggccacaggctgttccggggaggcgagcgagtgtcatgcgggcatcatccgccatcctgtgctggcacgctttcttcaagttcccctgcaggcttcagcaatctgagcccacctttcctggctgtgcttccaacaggcggagcctctttccgctcatctccttcacgggctcaggagggtattgggcagatggaagattttcagtaactactgcggagtggtgaccacagctgggcacctgcctttggccaagcttggtttactttgggtgggtgtgtccttaatccgaatcccacagggagtggtggcactggctcctgctctacccagaggggctgggctcttggccggcagctctccagctccctgggcagcactggcagctgcagcttggccagcatctgtgccgccagagatggcagggactgttcttggggtactgactgtgtttgggggctgtattcttacaggcaaaggtgagccctgcagctgggtgtgcccagaccagagaaagacctaaggtggaagagagaacaaaacacaaagaagggcagggacgctgagatctgcgcagattcacacaaaaagacctcctgggctgccagagaagggtgggagggaagatggaagtgtaggcagaaatttatttctattctctaagtccataatatttttcattagaaaaaccaaaaacttttagaggacagttcttacagggcaaattgtttttttgtttttgtttttgttttgagatggagtctcgctctgtcacccaggctggagtgcagtggtgtgatctcggctcactacaacctccgcttcctgggttcaaatgattctcccgcctcagcttcctgagtagctgggattacaggtgtgcatcaccacgcccggctaatttttgtatttttagtagagacgaggtttcaccatgttggtcaggctggtctcgaactcctgacctcgtgatccgcccgccccccaactccccccaactccttggcctctcaaagtgctgggattacaggtgtgacctactgcacccagcagcaaattgttttaatgctttgctaggtgatgcctgtaatcccggcactctgggaggcagaggcaggaggatcgtttgagcccaggaatttgagaccagcctggcaacaagatccccatctctacaaaaaataaaaattagccaaggtggcatgcacctgcagtcccagctactcatgagactgaggcgggaaggtcacttgagcccagaagtttgaggctgcaatgagccatgatcacaccactgcactccaacctgggtgacaaagtgaaaccctgtctcaaaaaagaaaaaaaaaatgcttaaaataaggagcttggccgggcgcggtggctcacgcctgtaatcccagcactttgggaggccgaggcgggcggatcacgaagtcaggagtttgagaccagcctggccaacatgatgaaaccttgtctctactaaaaatacaaaaattagccgggcctggtggcgggcgtctgtagtcccagctacttgggaggctgaggcaggagaatcgcttgaacccgggaggtggaggttgcaatgagccgagatcgcgccattgcactccagcctgggggacgagagccagactccgtctcaaaacaaacaaacaaacaacaaaaataaataaataaataaataaaaataaggagcttgtgtattgctgcagccataaaaaagaataaaatcatgtcctctgcagcaacacggatggagctagaggccattaccctaagtgaactaactcagaaacagaaaatcaaatactgactgttctcacttataagtgggagctaaacaatgggtgcccatggacacgaagatggagagagcaggcaccgggcactttacagtagggaggcgggggcgggggagcgcagaaagagtccctctccatgcgataccggaagcccagtccccaccagtgcacaatattcccatgtgacaaacatgtacacgtgcccctgaatctaaaataaaataaaataaggtgcttgtgtattgctattcagcctttacttctccaaagttgtttctgaagagaggaaaaactgtatgcaaaattccactgcatcaattcctaacaattcttgtacggagcagccgcatggcacaagacagcttacaaacaggatgtgcttcattcctgcctcaagcgacagtcctggtgacacagttagtgctgggctaagctgtgtcacccaaaaagaaaagcgcaagtcctaaccccaagtacctgtcaatgtgaccttatttgaaaataaggtttttacagatgtaatcaagttaagatgaggtcatattggattagggtgggccctaaatccaatgactggtgtctttgtaagagaaaggagagggagatttaagcagagacacacagagaggacgccatgtgaagacagaggcagccacaggagccaggagagcgccccagaaggaagcagccgggcaacatgggattccagcctttgggcctctagaaccgggaggggatccgcatctgttgtttaaagccactctcctgcttggaaccgcctacagcagccccaagaagctaacgcaggcagccgctgcccaaggacttctttttgacctgcgcttggtaaattggcatccagaatctggacacagagcggtgctgccaccacagcaggtcaggttatcaaactcaagatcccacagaaaataaagactcgaggcggcagggagggagaggaaagaatggcacctgccagaggaggtctaggtgccgcaagtgaccgtgaagccaagcactgggcccactgagtggacagctgtgtggacaggctcctgtctggaccagtgcctcagggacaggctgggccggccctgcaggacaggagtgggctcggaagatggatgccatttaattccaagaatagggcttgtgctgtgccaatatggaatcatgcccttttttgatcttctagatccactttgtttttggagacagagtctcattctgttgcccaggctggagtacaatggtgccatctcagctcactgcaacctctgcctcccaggttcaatggattctcctgcctcagcctcccaagtagctggggttacaggcacgtgccaccacgcctggctaatttttgtatttttagtaaagatggggcttcaccatgttggccaggctggtctggagctcttgacctcaggtgatctgcccaccttggcctcccaaagtgctgggattactggcgtgagccaccatgcccagcctctagatccacttttgataaaagaattgatagttttttatctttttagatcacaggaaaaaaatatgttaagagaaacgatcaagacagtaaatcctgcaagacatgttacaaaaatgatctaatggaggcaaaaataataagatcagttccagtggaaaggaaaagatggtgctggccgggcgcggtggctcacgcctgtaatcccagcactttgggaagccgaggcgggcggatcatgaggtcaagaggtcgagaacatcctgggcaacatggtgaaaccccatctctactaaaaatacaaaaattagccaggtgcggtggctcacgcctgcaatcccagcactatgggaggccgaggcgggcagatcgcgaggtcaggagatcgagaccatcctggctaacacggtgaaaccccgtctttactaaaatataaaaaattagccgggcgtggtggtgggcgcctgtagtcccagctactcgagaggctgaggcaggagaatggcatgaacttgggaggcggagctggcagtgagcggagatcacatcactgcactccagcctgggcgacagagcaaaactgcgtctcaaaaaaataataataataaggccgggcacggtggctcacgcctgtaatcccagcactttgggaggcccagacgggcggatcacgaggtcaggagatcgagaccatcctggctaacacggtgaaaccccgtctttactaagatacaaaaaatgagccgggcgtggtggcgggcgcctgtagtcccagctactcgggaggctgaggcaggagaatggcctgaacccgggaggcggagcctgcagtgagcggagatcgtgccactgcactccagcctgggcgacacagagactcaatctcaaaaaaaaaaataaaaataaaaaatagaagtatctacacagaattaaagttatgatgggaaaaaaggctgaaccctataattgaaaagaaagtttcggagtgtttcgctgtgaccccagctctgtggccctgggcgggctgccgtactgctgcctccgcttcctcactccgaaggcaagaaaggggagtggcgacgtccaccctccctcactgagggggccggggagaggcgggcgggagggcaggcgcctcctccggcgagtcagggcgctgcgcgggtgacggtggtgttctacctgcggaggccgccagagcgcgaagccggaacagcagcggcaggtgggaagggacagtggcacccagagtggtcttttggacactgacaacaagcctggatcagggccgggggagctcctgcaatctcctctgtttatgtaactaacatcaaactcgagccactgcctcagccctccagccaccacgctgaaatccacaccgtccccacctttggaaaggacccccagtaggggcagcttgagaacctcctgggtgccgggtgctctccatgctcaggaactgcgacacagtcactaagtgccaaggcattagacttcgcagatgccttcccagaggctgccaggacagcgtgaggcgcccagaggctgcagaattcggcaggagggaggggaggaggatgtgatgcagcgggtgggagagagcacccgtgtgctgtgatttttctctccccagaccatttaaagggaaggagagacaaggaagcatccagggagcgtcctgctgaaggcgggggctccgggctcccctcccagaactccaccgcttttatctttataaagacggggtcttactatgttgcccaggtttgtctcaatcaaactcctggcttcaagcaatcctctcgcttctgcctcccaagtcactgggattatgtgcctaagccacctcgcccagctatgaagggaaatttaaatccagtgggttaaaaaatttttgaaacaccttacagtttacagtacttttatttgacctttattgatttatttgctcctcatagcaatggcattggttagacaaggtaagtattgtcttgcttttacagttgagagaattatatgaagtgcttatctaatgccccctttcttcttcttaaatctctttcgtgtttgtttggacagggctgcagtgcagtggcacaatcacagctcactgtagcctcgacctcctggcctcaaggaatcctcctgccttggcctcccaaagtgctgggacccacagcctatggctgttaaatggtcttaaacccaaagccccctcgcccttgcagttagccccaggcgcggtgtggaggggctgcaccacaagcggagtgcgaggaaggcgcaggacagggaaaggtaggacttcccggctcccgcctgcttcagtgaaggggctgggcggggttcgtctgtgccgagctgtggtaagggccaggcgggctcagcctcagccctcagggatgcgtggtgggggacacgcaggcccttacccctcgaccccgccccccacaaggcacccgcaggggatctggcctctgacctcacagtccatggcctgggcagcgcggcagctccgactcactcctggttcacagtgtcccagtggcgacctggaaagggacacacagagtgggcggccgctcctgggaagccctggtcaggacccctcgggaggacgacgaagctggcctgtgctccagaaatggcggctgagccgaggtcctggcctgagccccgcatcctgagtttctttctccttggcgggagccaagctttgttttcctcattccagatactcacccaggcgctcagtgccctggggccgaccccgcacctgaattcagccctcccatgccgccccaggaagacctcaggcatcagggaaacggggccgtgggctcacaaattattttattatcataaaatgtaaaatgtttatagagagagagaatggatttgacaattaaaaaattaaatcttccggctggacgcagtagctcatgcctgtaatcccagcactttgggaggccgaggcgggtggatcatgaggtcaggagatcgagaccaccctggctaatgcggtgaaaccctgtctctactaaaaatacaaaaaattagccgggcgtggtggcgggcgcctgtagtcccagctactcgggaggctgaggcaggagaatggcatgaacttgggagggagaggttgcagtaagccgagatcacgccactgcactccagcctgggcgacagagcgagactccatctcaaaaagaatgaccagtctggccaacatggtgaaaccccatctctacaaaaatacaaaattagccaggtgtggtgatgcaagccctgtgggcccagctacttggggggctgaagcaggaggatcacttacacccaggaggtggaggctgcagtgagcggagattgcaccactgcactccagcctgggcgagagtgaaaccctgtctcgaaaaaaaaaaaagatctgtgcggcatcagtacagtaagctgtcttaaaaagactgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaagactgaacacaaatttctacagaacactgtgaatagaataatcctgttttaaaaagtatttgcctgtgtgtgtgtgtgtgtgcgtgtgtgtgtgtagacacaatatcaggttgaaccaaatgaaatggccattttgtaggacaaaaccaagcattggcaatttcacatggttcctgaatacataggaaataaaaagcaaacagaggagaaagcctgtgcccaggcagagaggaggtggcaggaggtagcactgacatgcgcatcacccacctccccacctgggggctcacacaggcctggggaccctgcactgttgcaggctgcaccctactctccctctggggagcccaggagaaaccctggctgtgtgtggccgtgcatttcataggaagggaccaagagcaaatgactgagctgcatgtggacagggaggcaccaggatctggctccggggccatctgccggctccacagcagaggaaggggagtctgcacccacaagagacaaagcgcaagacagaccccaccccaggaaacaggccacagaggccacggcacctcccagggccactgcccagtccacagaacagtggaccagaccctagcttctgcctcaaggtctggaatccccgcccctcaccactttgttctccaaggaacaacttcaggggtctctgtggggaaagtgcccactgtcacctctgagctcgggaggcagctcacaaaaaccagcttccttcacactcagatacacgcccatgtcacaagcaaactgcagccaccttggcactgtggtgagtctcccaccagaccctaacgccgtgtctcatgcagtgtttctctgccagggcgacttggatacccaggaaatatctggagctgtctggagacatttatggggggtgtgctcctggcacgtagcgggtagcagtgggggcacggctcatcagctcaaacccacaactcatccagctcaaagtgtcactagtgctcagggccgaagtcccataccagtgtgttcaaatacatagcaaataccactaacccataccagtgtcatatgcatggcagaatacccactaatccaaactggtgtgtcacatacacagcagaataccactgacccataccgatgttgtcacatcatggaggaataccactaacccatgctggtgtgtcacatacacagtgaataccactaaccccagtgttgggcatgtgaatagcttagcattgtcaccactaaagacagggctgtgatgagtaccccaatgggacattttttttttttgagacggagtctcactgtgtcgcccaggctggagtgcagtggcatgatcttggctcactgcatgctccacttcccgggttccagggattcttctgcctcagcctcccgagtagctgggactacaggtgcccgccaccacgcccagctaactttttgtatttttcgtacagacggggtttcaccgtgttagccaggatggtctggatctcctgacctcgtgatccgcccgtcttggcctcccgaagtgctgggattacaggcatgagccaccgcgcccagtcttttttttttttttttttttgagatggagtctcgctctgtcacccaggctggagtgcagtggcgcaatctcggctcactgcaagctccgcctcccgggttcacgccattctcctgcctcagcctcctgagtagctaggactacaggcgcccaccaccacgcctggctaattttttgtatttttagtagagacggggtttcaccgtgttagccaggatggtcttgatctcctgacctcatgatccgcccgcctcagcctcccaaagtgctaggattacaggcgtgaaccaccgcgcccagccccccaatgggacattttctatcaaatccatgatcatatgggataacagaggggcaaggtgttgtggcagtctcgggagaggacagagtgagggcagctcccctgagctgtgccttgaggccacacggcccagaccctgggggccccatcccttgggacatgaggccgcctcccctaggcaacggtcttggagggctttaggagcagggagtggcattcctaggcctggctggtcaactttaggtggagcaccagccctgcatcgggtaacctctggcttcatttgtcacttaagaagaaatccaatgagtcaactgcagctgtgagtgggcctaggagggcgtggatgcagacgccctggaaaccacagaggctcccccgtcaatagcggccctacgcccatcccaactcctaaacaaagttgctagtaagaaggaaactcacgcagccaggagttcatgccctctctcttccaagggccagtgggaagacggccaggcagatgggaaacgggaaataccctgcctcacctcagtgaggctgccctcatgccaggacactcacagccaggttccccaaggccctcgcagtgagcagggtgaggtgccgagccctgcatgtgccattcccccagtctccaggactctgccagatgggggtgacattcccctagtctccaggactctgcaggactggggtgacattcccccagtctccaggactctgccggacaggggtgacattcccccagtctccaggactctgccggacgggggtgacattcccccagtctccaggactctgcaggacaggggtgacattcccccattctccaggactctgccagatgggggtgacattcccccagtctccaggactctgccggatgggggtgacattcccccagtctccaggactctgccgggcgggggtgacattcccccagtctccaggactctgccggatgggggtgacattcccccagtctccaggactttgccagacgggggtgacaaataccatctctgacaacaaggaccccagcaggcaccgccaggcccctccgcaggcctcccctccaatcctcaccacggcctcgccaggaaggcgcttctgccctggtttcggagacacgactgaggctccagggtgcccagggagggcagggggcagcttcgctgctgctgagccagggggcgccaggccctcacgagtatgctcagatgccagctttgcttctgaggcctatgtgcctcccatgcactctggaagccaaatgtcctggaactcattgaaaacaccatgcagttggtcagatagaggcatgggtcacacggggacaagcacagcacacaggtgctcccagaagaagatttttaagggccagatatctgcagggcagtcctctccttggtcaacatcatccctgtcttcctagtcccactcacaggaaacagctgactcactgaatttcttttccagtttttttgtttttgtttttgtttgtgttttttttggagacagagtctcacctgtgtaacccaggctggagtacaatggcatggtcttggctcactgcaacctccgcctcccagattctagcgattctcctgccttagcctcctgagtaactgggactacaggtgtgtgccaccacacccggctaatttttgtatttttagtagagacggactttcactatgttgggcaggctggtcttgaactcctgacttcatgatcgcccaccttggcctcccaaaatgctgggattacaggcgtgagccaccgtgcctggcctgaatttctttttttcttttcttttttttttttttttttttgagtcggagtcttgctctgtcgcccaggctggagtgcggtggcacgatctcagctcactgcaagctccgcctcccaggttcacgccattctcctgcctcagcctcccgagtagatgggactacaggtgcccagcaccatgcccgctaatttaggaacatcgtgctgctctaggaacgtcgatccacccaccaaacttcacagcatgctccgtgcagtgccaaggaaagctccaacccggaaatgtgaacacacatggaccatggcctagattggtgacccagagaaggggcagtgccatttgggtcagggctgaagaatgcccaagaattaatcagaaaaggagaggggtagggaaaggaattcctgacacttcacttttttgtgccttggtgtcttcagaaaaataaagggtttggaggccgggcgtggtggctcatgcctgtaatcccagcactttgggaggctgaggcgggtggatcacgaggtcaagagactgagaccatcctggtcaacatggtgaaaccttgtctctgctaaaaatacaaaaattagccgggtgtggtggcgcgtacctgtaatccagctactcaggaggctaaggcagaagaatcacttgaacctgggaggcgggggttgcagtcagcagagatcgcactactgcactacagcctgggcgacaagagcaaactccgtctcaaaaaaaaaaaaaaaagaaaagaaaaataaagggtttggagaaggtgatttcctttttggttttttgtttgtttgtttgtttttctgagacggagtctcactctgtcgcccaggcaggagtacaatggcacgatctcggctcactgcaacctctgccttctgggttcaagcaagtctcctgcctcagcctcctgagtagctaggattacaggcacacaccaccacacctgactaatttttgtatttttagcagagatggggtttcactatgttagccaggctggtctggaactcctgacctcatgatccaccctccttcggcctcccaaagtgctgggattacaggcgtgagccactgcagccggcctgttgttgttcttacgtgaacacatgtgaaaggttttattaactcattttttaacaggggaaacagcgatgttaaaaccattcaaaggagtccaagaactgtgtgcgcaggcaacggggaaactggaaatgcgttgacaaactgacgcaaaactgggcccaacagccacaaggcactggtcgttttccactgggcaaagttcagtcgcatttctttctgttctctttctttcttttcttttttctctttctttctttctttctttcttctttctttctttctttctttctttctttctttctttctttcttttctttctttctttctttctctctctctttctgtctgtctctctctttctttccttctttccttccttccttctttctttccttcctttcctttctttcttttttttttcttttttgagatggagtctcgctctgttacccaggccggagtgcaatggcacaatctcggctcactgcaacctccacctcctgggttcaagtgattctcctgcttcagccccccaagcagatggggctataggcatgcaccatcatgcccagctaatttttgtatttttagcagagatggggtttcactatgttggccaggcgggtctcaaactcctgaccttgcgatccgcccccctcagcctctcaaagtgctgggattacaggcgtgagccactatgccggccgcaaaggattctttaacacaaaagggcaggactcatgagactgacctgaccattacatggtgcagtgagagttcaatttaactaagcctccttatgcttctttgactaatttagggccatgcagtgtcaaacagcaatgagggcacaaaagcagcttctccctggctatcttcagaaggaatcttagattgcccttgaacaccatcaacaatctgctatttggagggctggaaactaagcctaagaaaccaccaggcttcggccgggcacgctggctcatgcctgtaatcccagcactttgggaggccagggcaggctgatcacctgagcccaggagttcaagaccagcctaggcaatctggtgaaacccagtctctataatatatacaaaaactagccaggcatggtggcgtgtgcctgtagtcccagctactggggaaggattgcttgagcccgggaggtggaggttacagcgagctgagatcacgccactgcactccagcctgggcaacagagcctgaccctgtcccaaaaaaaaaaaaaaaaaaaaaaaatgccaggcgcagtcgctcatgcctgtaatctcagcactttgggaggccgaggcgggcggatcacaaggtcaggagatccagaccatcctggctaacacggtgaaaccccgtctctactaaaaatacaaaaaaattagccgggcgtggtggcgggcgcctgtaatcccagctactcgggaggctgaggcaggagaatggagtgaacccgggaggcggagcttgcagtgagccaagatagcgccactgtactccagcctgcgcgacagagcgagactccgtctcaaaaaaaaaaaaaaaagaaaaaaagaaagcaattccagcaggtttctcctgtagtgcctgtgcgagtgaagcccacccaaaggtgaggcgagggtgtgttctcagagctcccaacagcaagggactcggccgctgtcactcgcgtttgcctgggagaggctccaaggaaagctacccatcgatccgttacgtgcacctatgggttctctacttggtctcaagttggatggaagcagagacaaaacttcaggaagctgccagtcaatcaagccctggccatgtggggctgacagcatagactctagttactgcatggcttcccggatggttgctagtgacagcacccggctccacaagctggcctgtggcctcctggggggtccttgaaggtaacggggtccagtcatgtctgtttgtacattcagtctcatatctcttttattcaggtccctcaaagagcttaagttccccagctgctggcaagtgaccttcctgccacgctgtgagctggggccgagctactcttcccaggaggccgagacctcgcaggcactgactccacggtcgcctcagttcctctagaagtggctggtcagcatccttcacaaatacggcattccagggaaggccctggccgcactaggaacttatccagttatattttagtttgagaaaaggcacagacgccagtccctcaaaaaattaaacctagaactaccatttgacctagaattcagcttttgggtattacgctgaagaactgaaaagtagagcctggaacacacatttgcacacccatgctaacagcaaacaaaaggccaaaatagtccagatgtctaacagatgagtggaaaaataaaacatggggtgacatacaattgacacacgctacaacacagatgaacttgaagacactacgctgggcgaactaggccagtcatgaaaggacaaatacatgtggttctatctccaaggggtgcccagagtagtcaacttcacaaggatcagaaagtacaaaggcacctgccaagggctgggggtggcaagttagcgtttaatggtaccatttctgttttgaaaggtgaaaaagttctggagatggttggtggtaatggttgcacgacaatgagactgtactgaatgccactgaactgtacgcttaaaaatgcttaaaatgggaaatcttatgctatatctattttaccacgataaaaaaatatacacttaaaaaagagccaggtgggccaggtgtggtggctcatgcctgtaatcgcagcactttgggaggacgaggtgggcggatcacaaggtcaagagatcgagaccatcctggccaacatggtgaaaccccgtctctactaaaaatacaaaaattagctgggcgtggtggcgcacacctgtagtcccagctactcaggaggttgaggcaggagaatcacttgaacccgggaggcagaggttgcagtgagccgagatcacgccactacactccagcctggcgacagaaaaagactccgtctcaaaacaaaaaacaaaacaaaaaaaaaaaaacaaaagaaccaggtgtgggctgggtgcggtggctcacacctgtaatcctagcattttgggaggccaaagcaggtggatcacttgaggtcaggtgttcaagaccagcctggccaacatggagaaaaccccatctctactaaaaatacaaaaattagccgggcgtgcacctgtaatcccagctactcgggaggctgaggcaggagaatcgcttaaacccaggaggcggaggttgcagtgagccgagatcatgccactgcactccagcctgggtgacagagtgagaccccgtctcaaaacaaacaaacaaaaaacagagccaggtgtagtggtgtgcacctgtaatctcagctcctcagaaggctgcagtgggaggactgcttgaaagcccaggagctcaaggccagcctgggcaacatagtgaggccccaactctaaaaattattattattattaaagtttaaaattttttaaatttcaaatttcaattttaaaaaggacagattcttactgaacctatgcaaataactatatcaccacaaaaaataaggagacagtgagaatgggggttcactgagaaagcaatatcatttaaaaatgtttcggccgggcgaggtggctcacgcctgtaatcccagcactttgggaggccgaagcgggtggatcacgatgtcaggagatcgagaccatcctggctaaccctaagtctctactaaaaatacaaaaaattagccgggcgtggtggtgggcacctgtagtcccagctactcaggaggctgaggcaggagaatggcgtgaactcgggaggcagagcttgcagtgagccgagattgcgccactgcactccagcctgggcgacagagtgagactccatctcaaaaaaaaaaaaaaaaaaagtttcatatctggccgggcacaatgactcatgcctatactcccagcactttgggaggctgatgagggcagatcacttgaggtcaagcgttcaagaccagcctggccaacatctctactctacatcccagctctactaaaaatacaaaaacttagccaggtgaggtgatgggcaactgtagtcccagctactcgagaggctgaggcagaagaatcgcttgaacccaggaggcgggggttgcagtgaggtgagatcgcgccactgcactccagcctgggtaacagagcaagactctgtctcaaaaaaaaaaaaaaaaaaaaaaaaaagtttcatatccatctaccagagcagagcctactaaatcatcacggattacagacactaagaatgagaaagcatttcctcttacatctagaaaacagaaatgaacacatcagctatattccaagcaaaccaccacaattcagttccctcagcagcccgtcgcactctgcaggactcggagccagcttccagcctcacgaagccctggcccggcgcgctggggtggtctgagagccattgaggtaatgtccatgcagaagcctgggcccagaggctctattagtcactggtgaaagcaccaggcaatcctttcccacatggggaacatcagcatgggaagactcaaagtctcttttcataacgattttctaatgcatctggccagatgcgttattcagatatttctgaatatttcattcagatattttctgaatgaaaatatcctacacagagcaagggagggcactgacaagcacggggcctcccgccaagcccagaacttctgaattatttccatgaataacatttacacatacacaccgaaccaaggagctgtggccagcgtctcttgtgatttgacaaccactcttcccgtgcaggtcttacaagataacgcttaaaacaaacctcattatgtctatggtatttttctttttataaggtgaatgatcaaatctttgtgattttccaggggcactcagagtctcagggacagttttagaggcaatctggacagttgtttaaggcaggctcgcgggtgtctgagagagacttgattatccattaacaaaacaaacctgatgtttcacaagtgatgaacctttgttctttgttttttccccttaaataagcacaaacataataaagtcaacataaagcatcaaaaatgattctgctatacagaacctctgccatccaggtgcattacacagaaaggaaagaataatctttcacttttttttttttttttttttgagatgaagtctcgctctgtcgcccaggctggagtgcagtggcgtgatcttggctcactgcaagctctgcctcctgggttcacgccattctcctgcctcagcctcccgagtagctgggactacaggcgcccgccaccacgcccggctaattttttgtatttttagtggagacggggtttcaccgtgttagccaggatggtctcgatctcctgacatcgtcgtgatccacccgcctcggcctcccaaagtgctgggattacaggcataagccaccgcacccggccataatctttcactttgaaggcaaaggcattaatgagtaaacaaagaaggcaagaccatcaaggccagcaaactttgctaaaattgtgacataattcattgctgcttttcagactcaggtaccatgatgataaaaggcacatacctagttttgcccttcactatgttttttgtcatttttaccatattctggaaaacactggtaaatcgctttaggagagagtgtggaccaggatatcctagggtgcctgaggcccttttcagagaatctgtgaggttgaaaagcttccataacacagtttcttctgtcattctctcatgagggtacagtggactttcccaggggctgagcgaaagagatactgcaacaaccgagaatccaggtatcctctattcagtcagacacccaggagatctgcagaaacactgacgcaatgctgttcttctcaatagaaatgttttgttttataaaatagttacgttggccaggcgaggtggctcacgctcgtaatcccagaactttgggaggccgaggcgggtggatcacctgaggtcaggagtttgagaccagcctgaccaatatggtgaaatcccgtctctactaaaaatacaaaaattagccgggcatgatggcgtgcacctgtaacccagctactcgggaggctgaggcagaagaattgcttgaacccagaaggcagaggttgcagtgagccaagatcaggccactgcactccagcctggtcaacagagcaagactctgtctcaaaattaattaattaattaatttaattaaacaatttcacaaatttcaaatgaatgaacacttttttttttttggagacagggtctcactctgtcaagcaggctagagtgcagtagcacgatcatggcccactacagcctcaaactcctgggctcaagtgatcctcctgcctcagcttcccaaagtgctgggattacaggtaaggaccactgtgactggcctatttttaaaatttctcagttttaattctaacacagaatatagggataaaagcctacttaatcaaacgctttttggttcctcaataatttttatatataaagggatctagagaccaaaaagtttgagaagtgctgctttgaggaaaaaaaacaaaacctgtttgtttgtttgtttttttaagacggagtctcactctgtcacccaggctggagtgcaatggcgtgatcttgcctcattacatcctccgcctcccaggctcaagcgattctcctgcctcagcctcccgagtagctgggactacaggcatgcaccacctcatccggctaatttttgtatttttagtagagatgaggtttcaccatgttagcctggctggtctcaaactcctgaccttaggcgatccacccgcctcagcctcccaaagtgctggcattacaggcgtgagaaacttcgcctggccacctgtattttttctttgaaaaataaaagcatttacatagctgtttgtctccatcatgtgtattaattataacttttttttttttgagacatagtctggctctgtcatccaggctggagtgcagtggcacaatcttggctcactgcaaccttcgtctcctgggttcaagtgattctcctgcctcagcctcccaagtagctgggattacaggtgaccgccaccacacctggctaatttttgtatttttagtagagaccgggttcctccgtgctggtcaagctggtctcgaacttctgacctcaggtgatccgcccgccttggtctcccaaagtgctgggattacaggcgtgaaccaccgtgcctggccttattataacttttaacaaagtaactgacttccattttacagagaaccgcaggctgacagttgagagctgtctccagacacatgtttagcagacgcctgtgggcacacacaccatagccttcacagccactcgcgcccttctatgcttcctcaacatgaaaacatactttttttttttttttgaaaagcaaccatttattagaaccaatacaagagtatgaaaagagggaaaagaggagggtagaagagggggagagaatgaggtctgtatcagatgtcagttatggaaacacataaatgcttactctttttaaacactgacatttacaaggtgaacatatatatagaccacttataatttaaaaaaaaaaaaaatcaaaagcagacatgtttggctgaaataaaaccaggaaacacaaccaaaactcccccataaacctaaaagtccatggagaattcaatttctcatttccattcagaaatctggctacagagtgatttgtttgctacttgggacagtacagcgtgctgaaagaaacccagctactgagtctcttagatcccatcctgtaggaagtggtgggaaagccagcggaccatgggcaagtcaactcctggctacttggcagggcgtcagactgtgctctctccattccccaggactccacagaaccgtctggtactgctagtgctgggtgaacagtgagagcacagtccacaaaacacagagaaccagaatgtgactgcaagcagccaggaccttgtgctttttcatggattacaaatctagggccaaggagagggaaaggagaaagagccctattgggaagaggcgttggctgtgcccctacactgagatggaaagagtaaggctcttgagcccacacctgggcaagtagaaatagtgtccaaacttttctcaaaccagagggaaaaaaggtcaaggttaggttaagactgcagacactaagagatcacagatgctgaatacagtgaatcggatgaagctttaaggatcaatgcccaattctgagtgttacacacatttctaggaaaaataattccaatgtagctttttgttggggggtggaaataaggtggtcacatttattgaatcagctgtccctatgaggaaggagaggcccgggtacagataccacaaaggggtacagtgacccagctgtcctgggatcggttggggagtggtaagcaatgacataaatcaaaaccattgagggttgctttgatcctgagacagtctgagtctgcttcaaacccatggggaatggaactttcatccccaacctgcagagagaaataagcggtagcatctctgcctcacgattccctaatccaatgctcctgcatctgaaatgacctccctctgtgaatgcaagacacagaaaatcccaagtgccttccccaacaacatcctaagtaagtctggactagtaagattccaacattcatgaaaacactgtcaacatctgaactagcagatctgatgaggggtgggggtagagaatttgccgagtcagtaagtagttccagtcttggagacagctcagtgaggaccaaagcctgtgtgtccggctcaagacatcctccacagaggacccaagacatcctccacagaggacccaagacatcctccacagaggaccctgcggtattctattaactttgacttacaatgcctcacaacaacgcccctgtgaggtaggtcagtatgatcacccccatttgacagatggggaactgaggcattgaaagaagtgacttgccaaggtcatgactgcaggccaagatacggcctctttttagagctgaaaaaaacccaggtatacctagtaaccaatgttttactattctgtcttaccgagtaagtatgtcgatatccaaagaatacctactcaactccatttagtatcagtccaaggttttaagttacctaagctttattttggtacagtacactttcagaataatgaacacatttatttgaacacaaacttatatttttcataatcttaaacattatgtaacagtaatattagctgatttgataagtaaacccgtagaagtttaggggaggaagccaagtagaacaaaaggtacacctgtattatagctaatgctgataaactgaagaaaaggggggaaggatagcattaggagatatacctaatgacgagttaatgggtgcagcacaccaacatggcacatgtatatatatgtaacaaacctgcacgttgtgcacatgtaccctaaaacttaaagtataataataaaaagaaactgaagaaaagacatagctttttaaaacccaaattattagtctcatttgccaaagatttacatcaattacgtgaacttagatgattattgttattattattattggagacagggtctggctctgttccgcaggccggactgcagtggtgcagtcacagctcactacagcctcaacctcccgggctcaggcgatcctcccccctcagcctccagagccgggactacaggcacaaccaccatgcccggctaatcttttattttttgtagagtcaaggtcttgccatgttgcccaggctggtatcgagctcctggactcaagacatcctcctgcctcagcctcccaaattgctaggattacaggtgtgagccactgcacctggcctgaacttaagattcttaaaatattccagtttgtttctgtaagaagaatttctttctttctttttttttttttttttgagatggagtctcactttgtcgcccaggctggagtgcagtggcgcgatctcagctcactgcaagctccgcctcccaagctcaagcgattctcctgcctcagcctcccgagtagctggaattacaggcatgcaccactatgccgggctaattttgtatttttagtagagagggggtttctccatgttggcctggctggtctcaaactcccgacctcaggtgatcgacccgcctcggcctcccaaagtgctgggattacaggcgtgagccacttcgcgcccagccttttttgtttgtctgtttgttttttgagacagagtctcactctgttgcccaggctggagtgcaatggtgtgatctctgctcactgcaacctccgcagcctgggttcacgccattctcctgcctcagcctcccaagtagttgggagtataggcgtctgccaccacgcccggctaattgtttgtattttttagtggacacggggtttcactgtgttaaccaggatggtctggatctcctgacctcgtgatctgcctgcctcagcctcccaaagtgctgggattacaggcctgagccaccatgcccggccaagaatttctttttaaatttaaagtctagtgcattaaaattattagaagtacagccaggcgtggtggctcacgcctgtaatcccagcactctgggaggccaaggcaggaggatcacctgagatcaggagttcgagaccagcctggccaacatggtgaaaccccatctctactaaaaatacaaaaattagctgggcatggtggcacacacctgtaatcccagctacttgggaggctgaggcaggagaatctcttgaacccaggaggcagaggttgcagtgagccgagatcgcgccactgcactctagcctgtgtgacagagtgagattccatctcaaaaaaaaaaaattataataaataaagaaataaattattagaagtacgattttcctacgttctggaaatcttagaaatatttacttacataagctaatcacgaaccaatcagaatagagttcctccaattcaagacacttcatgaccttacccaatgactcaaaaaaagttttccacattcacttagtgagaggcaaaggcctttctgaattacaacttcagccccagggcaagagtaaacacagaaactggaaaagtccctggaccaggtgtcaaagaggtatccttcccggtggacacaaaattctgaattgaattgagctcaaaagaggctaaggacacagagaacgaagtctgatcatccagattctccgtatctgaccacagagaactgatctctgtcatccgcctacaaagatgagcaaaacaatatgaccacaaaccaatgctcaatcactgatgccaccaagccatgggtaagcccgaaaccaacagaacacagagtcaggggcaggggaaacagagacacggagagaaaacggagaaacagcgtccgcgaagtgaaaagttccattgctgcttgaatttgcctctggtagccaagaaaaggccagcactgtgggaggccaaggcaggaggatcacttgagcccaggagtttgaggcaaacctgggcaacacagtgagaccctgtctctacaaaaaatacaaaataaaaaatgaaggaaacattgacacctactgtaacatgagttacagcagttaacatgagttgaaaatatgctacatgaaagaagtcagtcacaaaagaccacgtagtgtgtgattccattagtatgaaatgtcctaaatgtgcaactccatagacagaaagattagggctgccagggctgcggagcagccaccagtgtgtctggagcttctctttgggttactgaaatgttctgcctgtaggcggtggtgacggtcgcacaccgtgtatatactaagccactgaactgtgccctttgatgggtgaattttatggcatgtgcagtatgtctcaatcaaacggtttttgaaaaggcagccagcaggaggagacatgaggaggcaagagcctcttcaggtgactggggccccctcccagaggtcggaggctccaccacaggccccagaagtcagtggacccctatgctccaggtctttgtgacccgggagtcctgcctccctcccctgcccaggccctgggcttctgggtggggcatggtggatggcaggggaaggcaggtgtccctcagctactccagaatccctggtgagcctctggtgagcctcctggtccgcccctccctgaactctctgtagactctgtcataaagaacaaggctgggccgcaaggtggctcacgcctgtaatcccagcactttgggaggccgaggcgggtggatcacgaggtcaggagatcgagaccatcctggctaacacggtgaaaccccttctctactaaaaatagaaaaaattagccggcatggtggtgggcacctgtagtcccagctactcgggaagctgaggcaggagaatggcgtgaaactcgggaggcagagcttgcagtgagccgagatcgcgccactgcactctagcctgggcgacagagcgagactccgtctcaaaaaaaaaaaaaaaaaaaattagccgggcgtggtggtgggcgcctgtagtcccagctactcaggaggctgagacaggagaatggcgtgaacctgggaggcggagcttgcagggagcagagatcgtgccactgcactccagcctgggcgacagagtgagactcgtctcaaaaataaataaataaataaataaataaataaataataactaaataaataaagaacaaggctttcaccacatcccaggcagagtccaagtcagggcagagcctcacagagcacagcagggcctgtgccgtgccaacgccatgcccctgcctggcagaaatgccacccagcccctggcagaaacgcctcccctctcctatggaggggctgatgacccaggagcggctggctgctggtgtgagtacacgggtgacccttccacaaaggcccctagctgggctccctgctcagttggccgggtttggggctggatgtctgcaggggtcctcagggatacccagagggagaaacaaggcttttggggaaatggtgacacctggggccaggtttctcacagccaggccccatctctccctgcctggatttcaggggaagtggggcttgggtaaacaggaacggacgtggccatcaggccggaagggtgtgtgggccacagagaagcaccctgaggctgtgctgtcatccagagtgccaccccgcttttccagggcacagcaaggaagtgcctgctggaaggatcctggggacagttgttaaggcaattttatcttctcatagcatgcctgcctcagttccgcagccaggacggtgccttactgactccacacacagaggcagctgggtccaggaggcagccatcccaaacgcagtgacctccagcacccaaagctcagagttcccagctgaacccaggaggcacccaccttcctgtctctaggcagatgccagctggtgcaggagccactcccagtcccaataccaggcctggtcacgtggtgccccgccaggcttgggggtgtgcacttgcccgctggcctccggtgccctcaggcctagcctcattgtcacaggaacggagctcctcggggatggccaccttcctggacttacccccaggagggacacgctgctgcctcccagggcccttcgtgccactggcccctttctttccacccccatatgctacccctgcctactcccttccctggccctgggttgccactcctgtcctgttctcctgctgtccccaccccagccctgaccccagatggctctccctacaaaaacaccagaaccccagagaagctcaatcccccaagtccatctgcattttaagaagccctcacgcactcccagcccagagagggaagctgtaaaggtggacaggtcatgtcgggctttgaacctgcaatgtgatctcaccttccccgtctgtaaaaggggacactccctgccttgtgggatcacatgcagtatcagaaaaagcacctgacatgtgacatccacttacaaagggttttcccttctctttggttttgggggagaatgggagaggcccaagcagaagctcctggaacaccgcccatcccggacccagggttgtagtcacctgaacactcacccagacaagggaaacttcacagaatgaatgtgaggaataaaatgagacattcagttacacaaattaaaccaaacccagatgcagaggtgccccataacagaaatagagcaactactgccagccttggatgaaagctcttggccaagggccgtgacggcggcggggaggttcagcagctgtccccaagcacacaggacatttggcacctccaagcccagcctgtcccaccaggccacggcacactttccttcctctgaagaaagggggtttgttaagccaacgaggagggaagccaaggactgcccccggcgccagcatggctatgagcatagaagcgggctgagccacaggctgggggatcccatgcagaccaggcaaagcccaggcaggatgctctgcagaaagttccctggtgatccggacccggagccagactgagccgcagccccagaagacaggtatctcctcccctggggccacagcagccacagaggccacccacggcttccactaggacagtgtgtctttccagttactctacgtacctaaaagtgaccagccccctttcaggtctggtctatgatccagatggtgatctttcccccactttttttttgagacggagtctcgctctgtcccccaggctggagtgcagtggcgcgatctcggctcactgcaagctccacctcccgggttcacaccattctcctgcctcagcctcccaggtagctgggactatgggcgccccccaccacgcacagctaattttctgtatttttagtagagacggggtttcaacgtcttagtcaggacggtcttgatctcctgacctcatgatccgcccaactcggcctcccaaagtgctgggattacaggcgtgagccaccgcgcccggctggtctttcccctttaagaccccacttcccacccccaccctggccaagctgataggattcaaggagtgcggcggtgcaatcacagctcactatagccttgacctcccgggctcgagcaatcctcccgtctcagcctcccaaagccacttcctccttttcttagttgttggcttcttctacagaaaaggatcctgaaaacaaacacctaaaatgccaaccaagaattcaatctgcaaggcagcagcacctccagaaatagctgctttgtggcctgtttgccatttatgtgaaacttccccattttggaccaacgcaggcagaaagagaaaaggaggaagaggaaggaaaagaggcaggctgtgttggggctggatggggctgtaggaacctgccagcagtggctcttggggaaaaccccactgcgaggtttctgaacccctgccccggaagcttcccctttcccacacacgtcactcgctgccttggaatctgggctgcctccctcccaggggctcacaggggagcgaggccacagaaaggctccttacccccagtggcctaacaggtgtgacatgtggagggggaatctgggcagtgtgcctgatgctcagagctgagaccctgaagtccaactccctcgggtgtgaccttggacaagttacttagcctctccttgcctcagttacaccatctggagaatggggatgctaccctcgtctgaccaccgtgatgtgagccagtcagcacacatcaagtgctccgtgagcgtccggcacacaggtgcttgtctctgtcctgtgcttcagctccatcagtgtcttcttcagacctgtcattggcttggggcaaggatatatgtggccgctgagggcggtccgccaggtatggcagccatggagctgctaattaggccctgtgagtgggaggccctgtggggtgggcaggggcagacgcccagctgctctcggggacactccaggcctgtgctgccctccacagccccagctggagaatggtgaccagatgtcaacgacaggaagcatttccagaggccacagctctgcagggaggtctctcatgggctgacagccagagccagcgctccgggtcccctgaaaaaacgggcacagtcctcggtcacgtcgaggacctgctcagcccctccacttggcaccggagagaggatgactcacggcccttctgcctggaaggcaggctccagtgtcaaatgtccatccgcctccatcaccctcatccatccttgtcagtccaggggcctgggcactgctggggctcctgggcagacagttcccccttgcaaatgagtgggaccctcagctccttcgatcagcatcctcacgtcagccgagcctgtgagcacccctaagcaaggcctctgagctgggcatgcgacaccccttcccacccaggcaccctccccctagaatcccccataccaccctggggccatgccccgcttccctctctggcaagctcctgcacaaccttgagaccacctgacagccaccgtctatcctgcccaacctcctcagaagcactaacagcacctcgccccagccacggcaggtctctgcacccctcgtctcagtcaccactctcacatctcatgaacagagacacgagctgcttcctcatgctccctgtgcccgtcctgggagatccctgcctttaaaccccagccacgaactgctgaccccgcatttcctcttccctccctgggcaagaggggcagaaggggcagggacgcacaccctgggccgcaggcagaggcttggccagggtcgtcctcccggcagtgcctccctggagctctgtctacctcaactcctgatgccagaggatccctctgcgctccccacacccttaagaccccagctcagggaatctggtctcggtcatcactcccaggggactgcagggccccaggacggcacacattcaggcccaggagagctccccccatctcaaagcctcctgtgggtggagatggaatgtggaaaaaccgcatcctctgcagctcccccacagtgagagcgaggactgagggtgtggataaggctccaggaagggggtgcaagcctgagaaggtggaagagctctgggtgggtccatctgctcctcacctgccccaaccctgcctgcaggtgaaggccggtccagccgcagaaggcccagcccccagcccacttacagaatccgcactgtgctcctccagccggcccggcccctcgctgcccaccgagccatcatgaccccagcaccgctgcacattcgtatttgttgaatgaatgaatgaacccttgccagcccagccacttggtggctgagggcttcagagctctcccagggtcccctggggtcattcagccactcaacagtttcccagcagcagcagcgaggatccgcacatcattgccagtgctctaaggagcgggcgagccccagtaagcggccgctctgaccgcgctttgtcagccctgagctccgctcgggaggagccggcaggtgtctgcggtgctggaaagaccacggtgtgggcggggattccgatccgccggcaagggtggcctgcacccggccaggcccgcgggttttctcctctccggggctggcctcggcccctccccctccccgcgccccgcacccctcccctgaatccccaggccacgtggagaggacacaacaaagccttccccgcctccgaggcggacccgaccctcagcaccgacctgccggccgcgccgaggagggcgcccgggcggaggggaggcgggagagacccggccctcaggtcgctgctgaggcctggggctctgaccccccgcctcccctcctctggctcccaccgcggtcgggcccagggcgggcggcgggccctgagctccacgccggggcaggcggcaggcaggggtcacgggctggggctcggcgcgtaccccgggaggggcgcgggtgcactcaccaccctccagccgcgggggcgcgggcgcgtccgggccgaggcagcgtctcccaggcgcgcggacacggtcgactacccgcttcctccttatggcgccccgcgcgcttcctccttcggccccccacgcccgggcccgccccggcccgccccggcccgcccccggcggcttgcggggacccggggagcccgcgccggcgcggggctgtggagcggggcggggagccggcagcgcagtgagaaccaggctttccacccttaccccttacgcgactgtttcagacagtg

SEQ ID NO: 1789 - DNA, 152410 bp, Homo sapiens
aagaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagta

SEQ ID NO: 1790 - DNA, 57178 bp, Homo sapiens
atgtgtttatgtgtttgtgtatctctttttatttcttccttagaaataaaaagtgtcaagggaatgaatcggaggcatactttaggaagttaatgttagaagggaagccaagatttttttgtccaactgtctcattgtagataagaaaatagagactcagggagggaaaggggctggcctaaggtcagaaacaagtgcatggcagatgcagatttgaacccaggcatccaaattcctggtccagtactctagcgcggcctggatggagatgggtggtgaaatggatgggaagatttgtcagtttgccccagcacatttactatccttcccaccaccccgcccagcacattcaactggcccctgccaccaaccccctcattcaaagtacagacactactcattttacagacagaggttcaggatgtttttggatctgacatagcccaaaccagggcagaggctgtagcaaggggaggaagctgggaaagcctgagggtcagaggggagtggaggtggacaggatctatggctacggtttttcagccgctcagccgtgctgggccctcgatggcccgtgggagtgggagcgtttcctaagctccactgaagataagagcccaacccaacccctccccccacccctgccccttccttagtctctggagctggaacaatcaggcttggccatggcggctggtgctgataaccatttcttggcagaagtgcccgccaaagctgtggccctagtcctcaccaccacagagagccagcaaggccttcaggaagtctccggaggtgtcaccctggcagaggcagagagcagagtgagtgaaaacagtccttccagtctcaatgccccctcctcccggctgcccatctgtctggacatctccctcggcttctctccatgaccaacataggatcccatgccacatgtaggctactgggatctcccagacacataaatgtgaccacgtcccttttgtttatccccaggaagatatgcaagctcccggcctggcttcaaggccctttgggatctgacctgtgcagagctctgcagcttcacctgttcctttcccccaggagcatctcagtcctctctccacctgtcactcccctgtccaacatgcccctgtgcacccccaatcccatttgccagcagggccctctcctctgagaagcactctggccactctcttgcgtcaggaggcacagtgaactctggcctcccttggttcccctggcactctgctgataccctcccccatggcccttggcatatcgtgttaggtgatttcttatttgaacaaacaacattgagtgctaactgccaagccattgctgggaatgggtacaaacaccatcacgctcaccacacatcacagtggtctggtatacgttcagactggggaggccaaacttcctgacccatggtatggtatggatctcccttctgagggactcctatcattgttatgagacatggttttcgggattttgtttgtccttgtattttttgatgtatgattttaaaacataatatagtatcaaaatgtgccaacaatttacttacattcctactaagtctgtaagagactgcctctgagatgcccatagtctcgttagccaagtagaaccaagcatcagactttaagatcttggctgatctcaaagagcaaaaatataagctccatatgtcaaaaaagtcagacgcagccaggtgtggtggctcacacctgtaatcccagcactttgggaggccaaggcaggtggatcacttgaggtcaggagctagcaaccagcctggccaacacagtgaaaccctgtctgtactaaaaatacaaaaattagccaggcatagtgatgcatgcctgcagtcccagctactcgggaggctgaggcaggagaattgcttaaacccaggaggtggacgttgcagtgagatgagatggcactgctgcactccagcctgggcgacagagcaagactccgtctcaaaaacaaacaaacaaacaaaaagtcagacacaaagggtcacatattaggtgattccatttatatgaaatattcagaaaaggcaaatctacagagacacaaagtagcttggtggttgcctatggctggggatggaactagataaacaggtatgagagagcttagtgggatgatagaagtgtttggaaaccagctgcattatgggaatggttgtacaactcagtaaatttactaaaaactgttgaattgtacccttaaaacaggtgaattttatgatatgtaagtttttcgtttgtttgtttgtctgtttttgagatggagtcttgctctgttgcccaggctggagtgcagtggcgtgatctcagctcactgcaacctctacctcctgggttcaagcgattctcttgcctcagcctcctgagtagctgggattacaggcatgagccaacacacccagctaatttttgtatttttagtagagacagggtttcaccatgttggccaggctggtcttgaactcctgacctcaagtgatccacctgccttggccttccaacgtgctgtgattacaggtgtgagccaccatgcctgcccatgatatgtaagttatacttccataacattgctttaaaaaaagcaaaaaatgggctcttgttttatttggaaatctttaattataaacctttgattcttttggaattgatttcggtataaacaatgcaatacagaccccctttcatttcaatatcctggctgttctaagcggtaacccactggaaaaaagtccatgggaataaagacttctaatcttatattagggatctgacactcacccgcttcctgctaacctctagcccctccccttacctcaatggcttggtggagagacttgtcatatttctcaatgaattccctccggatgttgagcaggtcaatctcactgcgggataccatgatcctggtcagagtcttctcatctgtgccagcaccctggtggagccaggcaggagggagacacaggcggaaggagagatagagcccagtcaggcaagaaacagtggtatcccatctgcctttctcccttgttccttccaaaaacagggcggatgttccacctctgtcttctgcaaacagtcctgaccaaaatccctctgtgcccaggactggccagactgacacgcaaaaaagatgtgtgtgggttgaatagtgtccccatgtccacctggaaactcagaacatgatgtaatttggaaataaggtatttgcacatgtaattagttaagatgaaggcatactgaattagattgaagcctaaaccaataaccaatatctttagaagagggagggcacagacatacacacagaaaagtggctaggtgaggacagaggcagagaccggagtgatgcattcacagccaggaaacaccaaggacttctggcaaccaccagaagctaggagaggcaggggagtgcttctcccccagagcctccaggaggacccaacccaggcgacaccttgattttgggcttttggcctccagaactatgagaataaatttcttttgtcacccaatttctggaatgtgttacaccagccctaggaaactaccaccgggcccaaggagcaggcacagggcatggaatgtgtgggcagccagagctgcctctgcccccagggagcgacaagcaccagcctaggagtcagagctaggttcgagtcccagctctgcctcttaggagctatgtaaatgtgggcaacgttttaccctacctaggcctgagtttcctcctctatcaaatgaggatgctaccacaatttcacaggactgccatgagggtcagctgtggtcagagagatgaagcccttggcacaggcttgacacatcgtgagtgctcaatgaatggctgtcacatttggagactgtagggtgagggtctcaggttccttcctaccctcccacctgcccaggctatctgcagttgagactccagtggctgagagggtggccagtgtggcttgggctctcccagaagggcaggactagactcagaggggagcgcttgtgacctttgatgactatttgtcctaggagaccctgtgtccccggatagattgtgagctctgagagggcagagactgtgtcctacccagccctgtgtgcctccagagcacatttctcaaccttggcatttggggctggataattctttgttgcgcaagcttatcctttgcactgaggttgtttaacagcatccctgttctgtccccaccagatgctggtagcaacaatctccaagttgtgatgaccaaaaatgtgtctggatattgccaaatatcctccggggcgggggaaggcgggggaaatcacccccaactgggaaataccatcctagagccagacaagggcagatgctaataaatgtcaaatgggaagaaacagctgccaggaatcctgatctgggggatggtgcacatctgtgtgtttgtgtgtgtatgtaagtcagtgcttgaagggaaaggaacgccagcatgttttcttaccttcatggatttgtaaagtttgtcggcaaagaagagaggcttgttcttgacactttgaactggtaggaagagcagagagatgcggggaacgtggtcagaggctgtgaacccagactctggaccggcctcccccatctccccacctcgtctatccctgcatgggtctgcagatcattgtcaaccccagggtcatgctcagacgacacctttgctccccttccccatgcttcctcctctggcccatccttaggcctggctctcaattggttgcaactctcttccttctaaggtgcttacagctaaccaaggtcaggagaggattcaaaggtaattaactcctcatgaacccaaggcacggggcctcaaatttttaaatgcattggaatcacccaaaaagcttgtttaaaactcagggtttaggctccaccctaaagattcagattttggaaagattttgagcagtggttctcaaagtgtggtttccggaccaacaacattagcatcacttgaaaacttggaagaaaggcagattctcatgcctcagattccagattccagagatgctgaatctgaaactctagaggtgagtgaccagcttgtcctagtttgcctgggacactccaggttttattaggttggtgccaaagtaattacaatttttgccatcactttcaatggcaaaactgcaatgacttttgcaccaacctaacagcactgaaagccttgcgcaaatcaggatggttggccaccctactctggtgcagcctaatgcttgagagttactgatttagagaaatattgctccaaagaatgactgtccgttggtaaaatttaagggaccatgcaaatccctggggctgagtgtttccccagggcctgaacaatcttgcaggattggcagcccctgctccctaccctggctgcagataatgcctgcctggtttcaccaaccccgccctttctcaaagcctagggttctctagcccttcacagctgcttgactgcaaggctccagagcccacgcacaggtgtctcagacagcttaaaaaggaggaaccagacaccagtactatagctggaatgactctggatataatgagaacagacggcaagaggctggagttgcgtaccccagtggcagagtcaagcaagactcctctgcaacaggctcaggaaccctgtggaaaagatcacatcacacacctcccatctccagctccttacatatctccctactacctcccaaacaaatcccaagctccttggcttgaatgtcaaagctcctggcctcctttgcaacctcatggcccttgctcccccattcccagaacaaactgcaaattcctgtgtctctctgtccttcctggatagatgcatttcctatctgcccttcactacattatctctctaaatcaaatcccatccttcaaggctgtacttgatgtccatgcccccagtcatgacatcacctccaggaagccttccctgacttcagacctagggctttatcagtctggctaagaagcacgctgggcagaaacttctctcctctgtaaccaaccccacaagtcttcctaaaaactgagcctgtccatctgtcacatgggaccccgatgcctgccattggatggaggagtgtgaaatggtgtgttgtggtgtgtgtttgcacgtgtatacctgttcaaggtgggaggagaaagggaagagggaaatacacgaggagggtaggaatctgaaagtgtctccaaaggctaattattctggtgttaagaacatgagctttggaggtaggcagcctgtggtttgagtcctggttctactgctataagcctctctgaactcagtgtcctcttttgtaaaataagctggttaagagcacctgatgagaatgtaactaaacctgcgtgcaactaactttgcgcagggcttggtgggaaacaacaatacaaatacaaactaacccttgtccagtgagtattacatgccaagaggcaccgttccaagtgctttacatataattaactaatttcagcctcacaaaatccaccctatgggctgggcactgttgttatctccactttacaaaggaggaaattgagacacagaggttttgtgacctgcccaaggacatatagtgagtaagtggcagagcagggattcaacctggattccatgcttttattcgtcgggctatcccgcctcctagatattgctcctgggtggtaaaggcccatcacgtgctaaacaacacccctaccaccacctctacttcacccaaatctaacacacctttcccccacattttagtgtctctgaaatcaagatgtgttttataattgaaggcaattatgtgaaaatcttccacggatacctcttggtaagattttttaaaagtgcattgatgcaatgtgttttatagtaaatgaaacaagataccactaatgatgaatattaatgagaataacttcagccctaacccatatccactcatccatatttatacacggtggaattaagatccaaaagggaaaaaccttttcaaagtcaagagctcaaattatataagcgtaaccaaaaagccaggtactgagaggagacgagggtctgtgtgtgtgtcatctgcatctagcgtgtatgtgtcttgtatgtgtgtgcatgtgtgctgcgtatatgtggtgtgcatgggtcatgtgtgcatagtgtgtgagtggtgtgtgtgtaggtgtagtgtcttgtgggggtgtagcatgtatgtgtatatataatgtgttctgtgtgtgatgtgtgtatgtgtggtgtgcacctgtcacatgcatatgtaacgtgttttatgtatgagtgtgtgtcacatgtgagaatgtgtgtgtgtatagtatgtgtcttgtatatgttaggtgtgtgtgtcaagtgtgtgtgtggtgtgtgtgtgtatacaccctagttgtgcaggacagcgtgccccctcccctgcctgccccagtcttcctggttcttccctagcaacagttattttctcaccctctcctgcagcctcgcacagacctcatgacattcctgcacaatcacacatttggcagcacccctggaggcgaactgtgacagtgtttactttccagtagtagcttcggaggctgccaaggttctattcttccagagaatctgttcaagttcccagtgcccccagcccttcccttagtccctgccagttaccaatggccacaaatgcatccctgacatccccagacatctccttcttgatggtgtgctccacgtcatagttggtcatcttgatgaactcctggaagactggccacaagagaagccccagaggtgggggtgagcttcagtgcaggaggcggaggacccctcctcagccccacccagtgcctcccacaggctgtgcctgagaaagtggaagggcagcaaatatggccacagcccaggcctaaatgcattgggcaagatcatcccgatagagaagctctgacatcaaggctgccgtgggctcagagccaaatctgtcccacgccagtccccgtgcctggccaatggtcttagaacctcggccaagttctgggaacccaggctggggtagtaaaaggagcacgggtcctagtcatggttctgccccagctcactgagggaccttgggtgatccctctccttcctgggcctcctcttcctcctgtgtccgcttgggatgaagacacaatgataacactcaggaaacactcactgagtcaggcattgcgccagtgctttatgtgtgttatgttttttgtatcttcacaacaatcatctcgggtagagctaaaaccctgattcctacgtaagggagctcaggcgcagagattcggtgacttgcctgaggtcacatggctgttaagtgggggattcaaatcaaggccgtccagtgcccaagtccattcttttagccactatgttaaagcaccttaaatactgagaagtgccagacattaaatgtagacatttaatgtagtgccagacattaaaatgtaaatgtctcagtgcaggacacttcatgattaccgagtgccagggccactgcatacaggtgtgccctgagcatgcggcagcctgtggttcaaagatgtctatgtgggtcttgtgccaccaccacctctcgctgccttgctcctggcaggcatcgccagtgaatcatgacgcgggaccccagaatccttaacacagcactctaggcagctactaccaatcagagttggcctttgaggtgaaatccagttgctatacctaatcccgggcatcccacctgcttccctaaggaggagaaagaaggtgaggtataagtggtagagccaggactagaacccagggctccagagtcgccgtcacccatgacacgctactgctgggttaaggaggaggtgggtgggcaacgggctcctcttgccacagagagctgagaggctctcatcagattctgggatcttcctgctgagctgggaagggaggaggtcaggcctcacctctccggaggtgcggatagctccgggtacacaggatcgtcatgaaacgtgtctccaaggaagttttgtctccactaggtgtgtctgctatttcctgcagagccccagttggagcaaggatttgggaggggagacatgagaaagccttggttattattcactttcatgtctttgcctgggctgagggcagtcagaagctgggctcacccagccatccaagggggccgagactggtcccctcttccttcctcaagcacaatggcttctatactcccctctccagttcacaaggaccctgtgaactgacaaagatggccttagcactgggtacttccatcctagcctcaggaccgtggggctggggctcctaggaggacccacatagactctgagcatagcaactgggagttccccttccatccctcaacctttctgcaagcccctctgggaagggtgtatggggtcatatgcagagaagatggcctggccagtgtttccccaagcggggtcaagggcaaacacacccgatcacactgcacattagtgtttccatgattgtcttctagctagctactagttctatttatactgatagtaaattccccttaactcattttgggtttaagagtgagtcgatttaaagatcagtattaatagctggtggttacacagcacaaatcgtgccagagatgattagctgaagtttgggaaacacttgcctggcctatcttttaccaagcagggcccggaaggggagagagagaagccgcacagcaagctcccaaatcactgctcgatactgccccgctcggcccagtaaaggcggactttactcagaggccgttaaaacccaaatgaagaacaggacactcaccaagatctcagcagccacctgagagcagggaggggagagaggagggagagaagggaggcaagagtcagaggaggttggggaggctggtgctggggccctggggtgcagggtgaggggcctggctgggagtgggagaggtcccaagagacctgagagaacccgggatgcgaaaggaaggggggtagggacaagataaaaataccttcctatgaccttttgggctggagctcagaatgcggataggcctggcaataactaaaaacgtgttcacttgaagggtaagagaaagacacagaaatggggaactctgcccttcgcaccccaaaacccagaggagattccaggcctgtttctttgtctgaaagtggaaataatccctgccacttccttacagaaccactgagatgtaaatgtgagcagtgcaaagttctctgcaccctttagcatattcagagttccaaggcaagagacatgtaattttagccttcatgttacagacaggaaagactggccagctgaggccttaaggggagctgacctgcctggaggcacacagcaaacagtgatgggaaagtcattttacaagggttacttttaatcactgcactatgcagagcacaaaattctgtggttaggacactattttgttaggcaaatagctgtgacttggagagcctgggaacaaaatacccaggctcatgtacctaggctgcgtattgctttcgccgttcccccagaaactctgctgactttattctattggatagactgaactctttataaacttcacaatagcctatactctggaaaccttcctcttcttttcattgcataattggcaatgtccgttaaaagttaaaaggcatatgccatttgatcaagcaattatattgctaggaatttgccctacaggtatactggcaaaagccttccacgatagaatacaagactgttcactgcagcattctttttaatttttggagacagggtcttgctctgttgcccaggctggagtacattggcacaatctcggctcactgcaaccttgacctcctgggctcaagcgattctcctgcctcagcctcctgagtagctgggactacaggtgtgtgccaccacatccagctaatttttttattttttgtagagaaggggtctcactttgttgtccagtctagcctcaagcaatcctcctgccttggcctcccaaagagtgcagtggtgcgatctcagctcactgcaacctccacctcccaggttcaagcgattctcctgcctcagcctcctgagtagctgggattacatgtgcatgccaccagcccagttaatttttttttttttgtatttttagtagagatggggtattgccatggtggccaggctggtctcgaactcctgaccttaggtaatccacccgcctcagcctcccaaagtgctgggattataggcactgcacctggtcagcatttttcatactagagaaaaactgtaaaccatcctgagattgacttgttaaacaggctatgacttatccaatcaatggaaacaatccatgcagtttttacaaaggataagattatctacaatgctgataaggagagtttccatttaaattaagtaaagaagtaaagtatagcatatttttgtgtaatatagtgtttcttttatctagattcaaaaaaaaatagacactcactttctcatacttcctgggaagtacttaagaaactgtcgagacacctttgaggagagggactatgagggaaagctttcgcattttttttattcttcctgaaaatttcttaaagatgcaaagatattatttcattttaaatttaaatgttaaataagagttatcaaggctactaggattatgggctgcttctggtttttaaaatatttttctgtattaaaaacaacctatgccaggcacagtagctcacacctgtaatcccaggacattgggaagccaaggtgggaggatcacttgagcctatgagtttgagaccagccgggataacgtggagaaaccctactctaccaaaaaattagctgagcatggtggcgcacgccgttattcccagctacttggggggctgaggtgggaggattgcttgggcctagaaggtggaggttgcagtgagccaagattgtgccactgcactccaacctgggtctcaaccctatctcaaacatcacaaaacaaaaacctagttgaaccctgaggacatcatactaggtaaagaaagccagtcataaaagcataaatactgtataatttcacttacatgaagtccccagtcaaattcacagacatagaaagaatggtggttgccaggggctgggggaagggagaatggggagtgactgttgagtgggtccagagttttggttttgcatgacgaaaacagttttggaggtggctggtggtgacagctgcccaacaatgtgaatgtacttaatgccactgaactgtatactttaaaatgattggccaggcatgatggctcacgcctgtaatctcagcactttgggaggctgaggcaggttgatcacctgaggtcaggagtttgagaccagtctggccaacatggtgaaaccctgtctctactaaaaatacaaaaaattagccgggtgtggtggcaggtgcctgtaatcccagctactcaggagggtgaggcaggagaatcacttgaatccgggaggtggaggttgtagtgagccaaattgcaacactgcactccagcctgggcaacaagaggaaaactccatctcaaaataaataaatatataaaatgattaatatggtaaagttgatatgtattttatcaaaaatttgtaaaaacttatgctaaataaaacggtatcatttttaaaaagagagagagagggacatgtttaaaaaatttaacagaaaagaatccaaagtcccaattgttctcacttacgcgggtcagagtaccctagacatactcggtttttcaaagcatctttaagataataatatctgtaatgtaaaaaaaaagtggtgggacactaaattaatattcaccacaaaagcttgttcttattagcctagctacttcatgcaaaaattaatctggacagttcctcaaatggttaaacttagagttctcatatgacccagcaattctatctaagagaaatgaaaacatatgtgcacacaaaaacttgtacacaaatgtttagagcagcattagtcataatagccaaaaggtggaaataacccaaatgtccatcagctgatgaatggataatagactattatttggcaatgaaaagggagtaccaacatgctacaacacggatgacccgtgaaaacactgttaagtgtttaacatagtgtttaggttagtgttttcttaagtgaagaagccagtccaaaaggccacgtattaatatcactgtattgacatgaggtgtttggaagaggcacatctggagagacagaaagtagattagtggttgcttagggctggggggttagtaggatatgaggagtcacagctaatgtgtatggagtttcttttgggggtgaaaaaatgttctaaaattgattgtggtgatggttgcattaagtctgtgaagatactaaaaaccaccaaattgtacactttaaatgggtcaatagtggggtaaatgaattctatttcaagaaagctgttatatttttaaaagcctgggccaggcatggtggctcacgcctgtaatcctagcactttgggaggctgaggcgggcggatcacttgaggtcaggagttcataaccagcctggccaacatgatgaaatcctgtctctactaaaaatacaaaaaaattagctgggcatggtgttgggagcttgtaatcccagctacttgggagtctgaggcaggagaattgcttgaacccaggaggcagacgttgcagtgagccaagattgcgccaccgcactccagcctgggcaacagagcgagactccgtcttaaaaaaaaaaaaaaaaaaaaaaaaaaaaaaaagtctgagtattgattatctaaaaatgaccacaatccttcatttcatggtaggtctataataattatttataatttattgctctaattggacaacagagtgaaaggggaagcaattaacaatcactgtggggccacagttggaaattggacatatgttcaactggttaataacagtcccagacttctaagagcttgagggtgttctagacatccagagtgagagaccgccagggaggcagtgtaaaacaggcaaatacaaactgccaagtactcatgtgcgttatctaagggggagcttgactcggccctatcaaatgcccttaatttttatatacattttgctcccacatttccatttcatctctggaaattcattctaatgaataattcatgaatgtgataaaagagtttgctactaggaagaaggctggttaaataacatggtagattcagatatggaacagtatatagccattaaatgatatcgttgatttaaaaatgcaacaatattcacatagtattaatttttaactgtcagaaataaagaatccacttttatatatacatagagaagcaactagaataatgtatgccacaatactgacaatgcttattactattaggttatggagtcttttttggcttctccttattttctagtttctataaaagaatgtactgctagttataagaaaatgagcttgggtctagcatcctaaatctggagaagcagccgagttgggcagggatctcgctcaagggtcccttagctatttccacccgggttctctctctccacttctctccttttgcgaagcagctgtcagcaaggcccaccactgccccctgctagcggcaattggaagcacagcctcattggcaaaccaggcaccaggcagaagcattccctggaagatcaattcagggttggaggatggatttggggtgagagctgagatttttaaaaaactctcagcagcacacgaggctgttcacagtaatacttaataaacgtctgttgaatgagtgaatgaaatgtggcctcagcaagccaccctagtgtctggctgggttctcagcctaacccccatccatgtgcccacaatgtagctgaaatgccatacatttaaatgtaaccctgcagcttttgacaaccatattccaaagcaagggttggacaactggacaacaacagctatttgatgtggaagctgcaggggaccttaactctactgggtcttggaagatattactgtaaatggaattaagcatagactctggcatcaggcaagcctgagttcaaataaaaccaccaccacttagaaattctttcattgaagaggttaaggagcttcattttcttctagtaaaaagggagaacataaaaacgtatagaataatcttggcatcgttctcaatatatagtatgcattctaaaaattataattacaattctgtaactgtcaggttccagctaaagatttttctagctcagatgctgttgtagcaaaccacacttctgttatgggacctgggaacagaaaagttggttccctgactctcaatccatcagtgctcttttcaactcaccaactataaaagaagggggctggatgtctataaaagtctgtggtgtctgtgccccacatccctggacacagcttttgggggcgggaaaatgaggcagtcagaagagatggagacatggacctgggtcaggctactgggtgctgggatcaaggtgcaggtcagtgggggacaatgcactggcctcagtagggactgcccagccatagaaccctcagggaaaatgaatttggggttgtccaacctccagaagaagccatttccagacctcaagctcactaggctaaggagcagggctgaggcagagcagccaagagactcctagagaacccttttccctgctattcattcaacaaatatttattgagcactgatcatgtgttactttggatatatcagtgaacaaaatgaagattccagcccttgaggaacttactttctaggctcgtcccaggacactccctccaatctcggtcccattttacagataataaaccgaggcctttagcactcaggccctcttctcagcaagttcccagaccagctctctaggggtcaattctactggggccactgatttgctgtgtgactttcagaagtcatttgccctttctggacctccattttcccactgtaacatgagggctttgacctgggtgatctgcaggtccctgccagctctgagggtcctgctattcacctaggaaatgccagtaataccagcaccacacttctaaacctcatttctacagtctaagtatcaaccaatcaaaccaaccacgcccctgccaggagccttcactcacagacagggcccggcgtagacacgcataagctggacctacatctcagggacacccggcagaggtgactggggtgggctgggggtcttacctgggcatcttcccgtgcctggtccaggttttctcctccctcctcacgatgcccctgcagcaggagcagcaagaaagttcagtccccaaacatcgacccatctccatctctgtaccaccacacaccctgctcattttcacctctctgaatgctcttcctcatcagctacacagggacgaaaatcctgcctctataaggtaggctgttgtggtcattaactgagaatgtgtgcaagacacttagcaccaatgcctgacacacagcaagctctcggtaactgtcaatgagggtctgccattttggttatgggaattcaagagatggtgacagaagctcccaggtaacaacacaggagagggtcacccatatggctttgtcctgtgagctgggggcccaacaagccaggacaagggccaccagggaggactgtctggagaaggtggtaccacgccaactttgacaagggaacaacaggggtaggcggtggaactctaaggaggcaagtggggagacaccccctctccatcaggagtgcacttctaactcccctgtgccctccactcagtaaaccttcccttcctcccaggcctcccgatgggcaagccgacctggggcccatgaattcactcaccgtggccagagaaatgaggatcctcctgaagtggccagatgtgtctgagctcagagcatcctccagggacttgtgatagtctgaggcagagaaagggggtgtgggtagctgctggccaagaaggatttggttgcggggagggaggtccaggaaactcaggcttgagccagggcagtattggcagggggaggtggggatgaaagggtttgtaactggctcatgggggcatccagccatcctcctgctgattttgtaagacaatgggcattcccatcaacccatcatctcccctccatcccctcagctctgtcccagttgaggtcccattgcatctcgcctttaatatttaacagcctcttaagtcacctccctgttgtcattctctcttctaccttccctcctgcatggcagttgctaaacccaaaagcagagctctgactatgtcactcctgtactcaaaaattctgccattttaaagctgcttataagataaaaaatgtaaactttttttttttttttcaagacagggtctcactctgtcacccaggctggagtgcagttggcatgatcaaggctcactacagcctcgacctccctgggctcaggtgatcctcccacctcagtctcctgagtagctgggactataggcacatgccaccacacttagctaatttttttgttttttgttttttttgagatggagtctcattctgtctcccaggttggagtgcagtggcgtgatatcggctcactgcaacctctgcttcccaggttcaagtgatcctcctgcctcagcctcctaagtagctggggctacaggcgcatgccaccacgcctggctaatttttgcatttttagtagagacggggtctcaccatgttagccaagttggtcttgaacttctgacctcaagggatccaccatctcggcctcccaaagtgctgggattacaggggtgaaccaccgcacccagccaatttttatattttttgtagagacggggttttgccatgtcgcccaggctggtctcgaagtcctgggctcaagcaatccgcctgcctgagactcccaaagtgctgggattacaggtgtgagccactgcacctagccgatttaaacatttttgactggtactcaagattcttcagaatgaaaatatggggccactcgcttaaaaatgaagaatttctggacagtgacagcatagcttgcaaccaagtgtggggcccttctggctgtggggccctgtagaactgcatggactacacacccctagagtcgccctccctctctccagcaggccagaatgttctctgttcccacttccagccaagcccttttctacctccaggcctttgtcctaccaggacacctgtcttttccccagacacagggatgggcacacccaagaggcttatcaaatcctcaaggactgagggaaaggagacaggccagagtcctgggcagagctgtgggctggggttggaagttggggggcctggctgttctcccagcatctgggcccaggcctcccaaactcaccctccttataggcctcattgatggcccggatttcagcattggtccgagtggccaggatttcaataagagccttttcatctgtgccggctccctggaatgtcaaggcaaagatgatctcagccatagttctgacctcctgtgcagaggtccatggggcccggacggctaaagctcaggccaagcattcctggattttctcctcacctccagacatggccctcaggcccaagaccttggcacaaccaaggctgactatgccagcctctcaagatccccagaacctcccatgtgaactgctttgccttccagccccccaaacagaaaaggtatataggcgtgtgtgtataacaccacatatacacatgaacatctgaatagaaatttctacttgtaagtattggaagagaacagaaggacacgcacatgcctcacagtgttaactagcagtttggtctctgtgtgagtgaaggatcacagatgattgctattttcttcttttttactctatttcttcaagtctccacagtgaacatgtattattttgttagaagaaaaaaagttttgtgcttaagataaaatgctaaattttttttcttttgagacagagtcttgctctgtcgcccaggctggagtgcagtggcatgattacggctcactgcaacctccgcctcccagactcaggtgattctcctacttcagcctcccaagtagctggggccacagaagcatgccaccatgcttggctaatttttgtattttttgtagagacagggcttcaccatattgtccaggctggtctggaactcctggactcaagcccaaagttttaggaatacagacgtgagccatcatggctggcttacatttgtttactcttggatttgaggagtgatttatgaactgaggcgttacatgccctggactaaggcaggctggggacctgtcatgcaaagatctgcacacagggaagcagggaaactatcagggaggagaggaggcaggcaagattgactgattgattgactgaatgagtcaatgactaattcactcattcaggtacttgttaagacacctattatgtgctagccactgtgcaaggtgctggggctacaactacaaaaaaaaaaaaaaaaaagtccgggcgtggtggctcacacctgtaatcccagcactttaggaagctgaagagggcagatcacttgaggtcaggagttcaagaccacgctggcaaacatggtgaaaccccttctctactagaaagacaaaaaaattagctggtcgtggtggcgtgcgcctgtaatcccagctactcaggaggctgaggcaggagaatcgcttgaacctgggaggtggaggttgcagtgaaccgagatcacaccactgcactccagcctgggcgaaagagcgagactccgtctcaaaaaaaaaaagagaaaggcaagaggcaagacatgttctctgtcctcaaagaggttactgcctagtgctctaatggtcctgccttctcagatcctaggagattcatcctgattgagatcttcaatcatttctttgttagaagcaggtgtgtggtgaggcaatcaagaaagtcctgagactgggtctagccctcgtctccccctaactcactgactctctgagcctctctgtttcccacttggaaactttgaaaatggaaaggattcagttgggttacctcatcgatctcttctatttctgaaccctgtgtctttagatcgtttgctttttggcttaggtattttaagaaacaatcatctcaatctgcttagcctaggcaatgtttttataaagtcctctagctccccattgctgccctcctcttaatgcgcaaggggccaaaagcactactggttttatgcggttgtcaagacaggctctagagtcagaaagactggtctgaacctcagctttgctacttcatagctctatgaccatgaccaagcaacttaacctccaagtctcagtttcctcatctgtaaaatggggacaaaataagagccctgccttgtggcttgaggaggcaactaattgaactaatgtacctaacctgggagagttaccatatgctctttataaacagtagccattagtacaattggtaccttgggaagcaaagcagttctagcaacttctgggccaggacataatgctttcttgtttaatgtagggtcaggtcttcggagttaacaatgcccttcatacctgtgaccttgattgacctgtcctagtttgaagggcagaggtgaccatttccatttcccagatgaaggcacagaggattgggaagtgtaaggaatggcccagtcacactgtgagtgagtggcaggtctaggctggagtacagactccaactgctggtgctttcgttcgagacccaccccacttcctccagcggctccatgagacccttctgacaccagtgggcatgtgacttaagctgaatcaacttggagtaaatgccaagcctgttgttggagctcctaggaagaaggaactctttctgctggagccgctagctggcgggatggacatatgccaccatgaggagaaaggctgcctgagagtgaagccagaagggaggacagcagagccaagacaggggtgagccaagggtccacagaacatcatttgagtctctggactcagagctagtcctgtagttttcagttataggagccaacatctccttttgtgtttatgccagtttgaactgagtatgggaggagttctaccaagaagttacagctaatccacctgggcttatgaggatcacctgtatccctattggcacccgcagacactagaccccctggtgccacactgtacctccatggccttcttcaactgcttggcatcgtaatgggccggtggcatcatgagccccagaatcagccttgccaggtctccagagatctcagacttcaggtcagtcattaagtcctgcaaagggcagagccacagtcatgccaacatcagcacttgcccacacatgactcaggatgggagagatggaaagagaaaacaggggttccacatgagggatcatggaagcttgtgtctgtctttgctgatgttgtacttattatttagatgaagccaaagagggtagggaaaaaacaaccaggaggaagacccactctccttgacacaggagacaggaacgggaaggcagcagagctgaaggacactgtttccactcagggggaaatgcatcaacctaagccagatgccaccaatgtgcaataatccctgacactcagttggggccttgaagccagctctgtctgtgcagaggaattgcaagatgcccaaagcacactgaaaacaactcatagccctgatcttggccccatgctgtgcctctgagtccactgagcaactcacacaagtgttgcccatcacaaggaactgggggcatggaaagatatgtctgcccaaacccagtgctggagacactctgagatcatatgaccacacagggtccctctgccatgaagaccctggtgcccaactgtgcagaaccgatggggacaggctgagctcaatcaggcaaggtgcatgcatgttgcacagagagcccaggaggaggtccttacccggccaaagtgagacttgaaggtctgccggatctgctgccgctggacattgctgcggtgcgtgatgatatcgatgattgtgtcttcgtcagtccctgagtcaccaaagccacatgcctcagaagaaggcctgtggctctcggctttccccatgcaccgcccactgatggcccctcatcgatctttgtcagggtagaagcctggctaagcggccatgtgctcctgagtccctgcagtccgcttgcctatggctcaggccactgatttctgctggactcctccctccctttccttttgacacgctgaggaaaaaggacagctgggaggtagagagcactgggttgggagtcagtgcctctgagttctagttctggctctggcaatggctgcccaccctgggcaagtccccttcccttgatgggacttggtttccacatctgtaacatgaagaggctggagtagtcaccaagggatccttccaaccctgacagtccaagtcctgttagcaactctatgtcctttctcttcagctctctggaagctggaccctgagtccctctaaccacagcaggttgactctggaaggcattagaatatcacttcctgcttctcagattaatgccatcaaccacagacccagcacaggggtctttcatggcatttttacctctagcatcctacagtcccaggcgagcttggcaggtatcatcattcccatgagacacatggaaaggaggctcaggagggtgatggacttaacctaaagcctcctgggagttgctgtcagacagatggggcagaaaggcaaagaaagccaaaccctagatggcctgtcccaggctggactttctgagcacaggcccagctgatctgaacctgtgggtgcagtactcttcccactggtgccaaatataggtctgaaagacctgcccagcagggcacactcccaccacagaatgagggagggctcttgggttccagggtccacagccctgattttacacatagggaaattcagacccagagtggcggagaggctcacccagagtcacacggtgagtcagcagcagagccagggcaccatgccaattttgtgacctggtactttcttcagtgccaggatactgcttccaggaggctgggggacaccttggtccctggaaagggcttctgccaagttccttatgaaccctctcctgcccctcctctctatactctgggagctaggagggtggaaacttgagatcaagccttcctcatcctgcagactctaatttgaaacctcactccatcccctgccagcccacggccaaacccaccacacctgctgccctggagaccaaccctgctcccttcccatcccccataccgagtcccttcatggctttccgcagcgctttggcatctgcgtcagggttgaagtcattggctgggcgcacagttcccttcagctgtgagaagcagaaagagactcagcaggtgtctgaaggcccccctggggaccaggctgaaagacagcatgcgagggtgggaagctcaccccatgagcccaaaccaagcggcgtgggtggggaaagaggcagaggtgaagccacagcagacagaccctgcacgagagctgagagagagagagagagagagagagaaagagacagaaagatatagagagagggagagagggactcagggctgggagcagggcaagtcctgatcaagagaaattggctaggctcccgcctgccacgggatctgcctcggttctagtgccccttggctgcttattccaccggggcatccccaattcttctgaatcctaccctgcccccgaggccccctctgcctcttaaagagtcattccccctgaaaaggcagcagaaaagttctgaaataccagaacagagtttcccaaatttcagtcactcctaaaggactttcactattccaaattagcacacacactatgccatctcttaatggttttatgtaattcaacttcttttctgtctacttaaatgcatcaatttttgaagtgcatttaaaattactcccaaaaggcaaggaattgtatccgttttatcctgttacatatcccaggtgcctacaacagtgtctgacataataggcacactcaaaaaataattgttaagtggattaatgaggcttggcacaatggctcatgcctgtaatctcagcactttgggaggccaaggcaggaggatcgcttgagcccattggttcaagatgagcccaggcaacatggtgaaaccctgtctctacacaaattagccaggtgtggtggtgtccacctgaggtcccagctacttgggaagctaagtggaaggatcacctgagcctggggaggtggcagtgagccatgatcatgccactgtactccagcctggataacagagtgagaccctgtctcaaaaaaaaaaaaaaaaaaaggaatggatgaaattaattttatataactaccatgaattaggaagttgataccatgtatcataaactgacaatttaccacaaaaatcaacataataaaaacaaaagaggtgatataccatgaaatttaacatgatgcctctacttgccagaagctctgaaacttaaagcgagctctctcagctttctctttgtgaaaaaggaaaatcagcaagtgttgcagagacggcggcaccaaaccaagacttcctctttgacgtaatcagaaacgctgatgaaattggaaaggagtgcctttctcattcactctgtggagttcagcgttattcaaccctgccaaactaaattcacttctcacatcacctacaatcatctgcaaagatctcttgccttatcatttggggaacactgtcctagaacatcagagctcaagagccctaagagatcaccgagattgccatgttaacccctcactttaaagatggagacatagaggcccagagggagggggcaccttccaaaggttacatagcgaataagtaacagagagctccaaggtcccatgcttttttgtgtggaccaagtgttgcagtctctggaatggtttgcctaaagtactttagtgaaacctttcattcctgtcctttgtggacccccagtctgaggatgctcaggaggacaacctgaaatcctccagtgcacccagggatgcccatctgttctcagctttcatgtctctgaggccaactgtttcgactccagacgggacaggcccctccatggaaccagccaggtctccatttcagcaagccctgttagtaagtgggccagaaccctttccagcgtgtcagaagctaatgcagaaaccaggtgcgcccctccaccagttcaccactccaagggagaaaaggaagcttcagatgtgagaatcaacgtgtcgggttggccgccagggggcagctgggtgccaaccagagcagcaggaaggtgcaagcagagaagctgtggtcaagaggtcaagcaggaggaggggaaggtctgacctctactcgggccactgcactaagttcccacatctgataggccacctgcgctgcctccgggaagaactggccagcagcactggaatggaggggtttagggagaggacaggaaggaatgtcatcatgggcaacactcacaccaacacacacacacacacacacacacacaccccaacacatacacacacgtgcacacaccacacacacattaagctttctttctctccagcctatgcctcctccattcgccagagtcctccctccatttctgagaaccttccatctcttgagaccccctgcaatgctgccttttttattttttatttttatttgagacggagttttgctcttgtcacccaggctggggtgcagtggctcgatctcagctcactgcaacctctgcctcccaggttcaagcgattctcctgcctcagtctcccaagtagctaggattacaggcacccgccatcacgcctggctaattcttgtatttttagtagagatggggtttcgccatgttggccaggctggtcttgaactcctgacctcaggtgatccgcccgcctcagcctcccaaagtgctgggattacaggcgctgagccactgtgtccggccaatgctggcttttaagggcagccttcctggctgcagagtccaagcaggataggatttttccaatccttcagcctcccctttcttccttagaatttgaatggcttctatccaactctcccctctcaaagaggccattgagcaagctatggccatgccagccctgcatctcctcctgcaaagtgcctggatgcatcaggagctcagtaatatctgctgaactgcatcaacccctatggtccttaccaaaggttcacaggaaattcttgcatcccttctgtaattggatctttataagatccagagaaaggaaatcagagcgcagcctgttccctttctcaaacacaaatctggtcaagtaatgtcccaatttaacattctgggaagaggcccccaggccctcccacttctctgccttatttctctctctagtactccataaatgcatgacttcggacatatgaatgaatcaggccactccttctcactcctcggcttttctataggtgatttcctccacccaaacactgtccccagaccctcttcacctggctcttccccttcctccttgggtctcaccgtgtatctccaaagagtctccccttggtctgggctagggcatctctgtgtgcttttatatatgctttctatgtggcacagccagttctccccagcacaggactgctcccttctggaaactggtctatacccttctgcgctgtggccttcatcaggggcttcctcacagggtctgcacccagaaggcacttaacacaaatatgctgcataaatgagtaggcagagcaggaatgtgtccttttcccatttaacaggtgatgaaaccgagaaatggctatgaaatagcagggattggatgctcatattctggttcctagtccacaaccccagactgactttccaagttcacaagagcagacatctccatatacaggagaccacgctcacgttcagacccccacactctcagacacacagacccacaagcacagcagctaccagcaaaagccgcctttcacttgtgcgacgctcctggctcaggggaatccccagctcatccaatccacccatcaggatgcgagccaggagagtccccgcctggcaccccaaggccatgccctccagccaggggccaagaagccacttactcatcatctcccccagacagcttcagcagagtcttcttgtactcgccagaggtgtcattctgaagagaaagaaagaaaggttacctctcacccagccctgggctcctctcagacaaggaggtgaaggttctgcacagcctgaaagaggggaaggctgaatgaacacttattcatagcagccctggccctcctgtgctggttaatattgaataactggttctcagcgggcaggttggaggaagccctaatttatagcatttgcctatttctgtggtgtaaatacttctagcaatggacaatttcaagttaccaatatgactttgctaccaatatgcggagttgagaagagatgctcgctgccctttcaagccagtgccccagcacagcactgccaccagacagtccccagcccagtccttccacatgaaatatgcatggaaatggggttccatgagcaaaaatattgggaaatgcaaaaaaatcaaacaaatatatattacacagatgcacatatccgtatagatgcatattccatatccctcttggggcttcataatggacttcaaaatgtgaaaggctgtgagaagttctgaggtaaagaaactggcttatttatctttgcttattgtggtttgttacaaacttattttcccatagaacattttgcacataacacctaaaaaaattaccctttggaaacatactttggagaatacaacttggatctctttctctgtcaccccataaagttttatttcagtcatccaaaaaaaaaaaaaaaaagggaaaacccctagctttacatatgtctcctgataaagcctcaggggccggatgtcccagagtcatcaccaatcacccggcccaggccaaaggttcccctttaaccctcatttgtgttcttcagtgtttcccagccttcttccaggagactgaactatcactgcccttggggcagagtcctcgcacttaattcagcttgcgtgtccttcatgacccagcccctgcctccttctgtagccttaccactcacaaacacccctaacacttgcttttctgttgaatatccttaaattccttgaatgagccacaaggcaggagctcctggaatgtccaagagactcccacttcctaggacatttccttttcctgggaatagtccccaagccctctgtcttggcaaaaagctctttgctcccttctctgcccccatgagctctgctgaccttgatcatgctgtagagggacttctcatacttggtccggaagatctcccgaatgtcgagcatgtccaactcactacgggagaccatgatgcggatcagggtgttgtcccgagtccccaggccctgcaagacaagtgggtttggggaacatggacttgagaggaggctagagtgctgatagctcccagcttagttgaaaatcctattttcataataaaaagttaaaatttagagcaaaagaagcagacattgccattcccattgaagctctctctatgctcctcttactgttttgtttgtttgtttgtttgtttgtttgtttctgagacagtgtctcactcttgtccaggctggagtgcagtggtacgatctcagctcactacaacctctgccttccagactcaagcaattctcctgcctcagcttcctgagcagctgggagtacaggtacccaccactacgcctggctaatttttgtatttttagtagagatggggttttgccatgttggccaggctggtcttgaactggcctcaagggctgccttggcctcccaaaatgctacgattacacacatgagccaccatgcccggccctctcactgttataaacctcttctctcttcatgtataatttccacacttgattttccttataattttaccatagctttgtaactctaagcaatacacttagatttacacattttggaactctgcaaatataccactgtgcatttaggtttttgctgtactattcctgatggtcactgggttgtttctagctttttcctaatataagcaatactgttataagttttttttttctttttcttttttttttgaagaggcagggtctcactctgttgtccaggctagagtacagtggcgtgatcacatagcactgcgttcactgaagcctcaaacccaggggccctgtgctcaagaaatcctcctgcctcagcctcccgagtagttaggactacaggtatgtgccacagtccctggctagttctatttgttatttttgtagagacaagggtcttactatgttgcccaggctggtcttgaactttgggcctcaagtgatcctcccactttggcctcccagagtgctgggatcataggtgtgagccactgcatgcactcagccttgtgatgggcattcttaatgaattcatgcatacaggcaaacatctctctagggctgagctgcccaacctcattatggcacactggtgggcagagaatggccgacagtctactttgtcctttcggaatggccaaccagggccagaaaggcccaagctcctgtgtctcgggcctcaggcctctggcagcaaataactgcattcatttcctccagtgcatcacaaaaataccagtttctttgtgcgtcatatgtgtaaaagcctgggaagctttctcagaaacacacccagagtggaactgtcacagggtgagcatcatgagtcttagcaggcaaggccaaagtggtcttgcctacatacgctgtataaaaacattctggttaatacttcttcaaagtccgagccgccaacccatttggctggagggatcaggtgcaggctgccaccctaagttcatctgttgactcatgacgtcaggcaggtatgcaggtggcaggacatgtgaccagcagcattcctggctctacagctcacctgcgacagagcaccttcaccagggtcagtcctgtggccatccctgaagggctctctttggccactggatcccaaggacttgtcaaagactcccaatagtcctctccccaaaccccattcacatcagccccaccacgcaccttcatagccttgaagagcctttcagcaaaatattccggggtgctccggatacacttcactgtgaagagggaggaagaggtagagttattctggctgcctcagaagggggatgggatggcctgactccctctttgtttctattccttgagggccacctagctcaatacaggaagaaccaccgttcctgatagctcacagccccagatcaccccagaccaacccacttttaccgcacacccagggaataaacaggaaataatcttgttgaaataatccttttgaagtccatcacaaagaccgcctttatctttctagtccttttggttttaacagggaattgagctggggtgggggtagggtctggggcgaaggaggaaaaggtgttttttagacctgctacaccagaaaggtactggcagctgaatcattgtgaatcccactgaatcaccgtgagtcccactggctgactacttcaaacagggagggcaggggatggctctgggagggacgataaaggagctgcaggtttcccccaagaaatacaaacacacaacatatccctgactcagacatgctaactgctggaatgccagaattggaagggcttctggggaggcaattaaggcagtccatccttcctgcccccacaccctgcaccccacttaacagatgaggaaactgaggtccagcaagcagaagtgacttgctccaagcccatgtgggagaagccctggtttgaatcttggctccaccactgactagccagttcctcacatcctcacgttctcagtacccccaactcattacaaaactacccctcaggaaatgatcagcctggtgagactcagtttcctcatctgtgaaatagagatcatggcagtggccactgctgggtcttttttaaagattacacactcagcacagtgcctggcatgcactagatgctcaacaaaagtcaactattatgatcatcattatcctcaacccaagttcagagctctttgtccccctgccagtggtggagaagggagctggaggaagtcagtacctgaggctcaaacccccttcccgtccccagcctcagccatgctgccctggagaaacctttagaattcacggcccacatggttttctccttcccaattctataccatgtaattcccctttccattctcagccccttgttcctaggccagtgttccagaatcccctaaagcccccaggaatgcaacgtcaggacatacctacggccagcattagcttctcaaagtccccagacagctcccctcggatgctggcttcaatcggcttccctgtggtcttcagatactcatcgaacactgcgtcagacagagagacagggaggtttgagagtgcctctgtacccccgagaagaaatgaggacttcaagagcaggggggcacagtggccaggacgactgtccaccatgaagctagggctggtgctatgatggaggcgactgggaggtcacgcacatcaccagcgctgtgcagatgagcttcatagctggtgagagactgtgtctcatcccctaacatggagacaggactggcactgagatggaaggccaagcatcctgttaatgactttgctgagggactatacaaactgctgtctgatattaggttggtgcaaaagtaattgcggtttttgccattcctttaaaaacggcaaaaaccgcagttacttttgcaccaacctaataaactcaggactaaagtttgggttgggaatgaagtaggtatcatgttccattagtggtaaagaaaagaaaagagataaagaaaggcattattggcatcaacccaagggagcagcttcaggtcttctctggagcttacccaaccgaagatgctgcttgctgcgatttcccaagatgtaaatgaactgggcttcatctgttccccatttcagttcccctgcctcgtataggtcctgaaggggaagaggtggcacttgactgaaagaggaaacctcaggagacaggacacactgaccaagccactcagaactgctgcctgatccctgaacacacgagtaattggtagcctgaagacctttgcaaataaaacagtcatgcatcatttaatgatggggatacattctgagaactgccattgttaggcgactttgccattgtgtgatcatagagcactcgcacacacctagatggcatagcctactacacacccagactccgtggtatagcctattgctcctaggcggcacacctacctgttcagcgtgttatcttaccgaatactgtaggcaactgcaacacaatggcaagaatttgtgtatccaaacataaataatcatagaaaaggcacagtgaaaatatggggttataatcttataggactagcatcacatatctggtccataatcttatgggactagcatcatatatgtggtccatcattaaccaaaacaccattatgtggtacatgactatacctatatgcctttcttcctttctttctggagaaactcctactcaaccttcaaggcccagattaagtattccatttttttctcaaagtacttcccgatgcccccaggcacagttctatttccctcctttcctccctctcctaggctcccatagctttctacttctttatcactttgatctactgtatatgataatgatttcttcacctgtctatctccacactattgcatgagctcctcaacaacagggactatgtcatagcattctctgtatcagcccctgtagtgctgctggcatgtactgggtactcaaaacacctgcaatgtacagtatattgatagagaaggtgtttgtgtgattaatgtatgcctgtctctcccggtaccacttgattttgttcattagtgatttctaaatgcttggcagagtgcctagcacatgctaggtattttacttcaataatatctaaaaactgaatgaataaagaaagctccaaagtacacctcaccaatataccaatattacatatgggatatacctttgaaagataacttatatcttttcttcaacaaagcaccggtatacatgacagctgtggctgggttatttctggtatttgatgcaaatgacttcacctccagcccttcccagggccccaacctctcccctcccaaggctcttctgctgtgcctcagggactttcagtggtgcttgtttacctggacatcctgttgtaccaggtcctcgctcactacgtcatcctcctccctggttccctgggcagaaagacaaagaacatgtgtttcaaacactgcaaagtcaggagggaggcctggatgccagtggtggagacagggaaagcaggaaaaccctggtggcccagatgtgtccagaagcagtgactgctattgcatgaagaccacagtatctattttgtgagccaatcaaaagggaccctccctctggcctttcccttcctcgtcagggctgggtccacacaggagagtcccaagaacaaccaaggttcttccaggtgtccccagcccagaggtaggcagagccttgccctgaggacctctctgaggacagggccccaggttctcgagggtccctgccacagatcctgcatggcccatgacactcctccagcaacgattccacaggggcaaaggatctgaacatttgcattctattaggagctcttataccttaacttaaagaattcaccaataaggatttgggactcaggtcccaagatctgagctcacaagctacaaagtcaccaaatcctaatggtgcttctgttgttctgcccatgccctttgcctcatctgatagaggaagcttacacataggaggatgcacaaagggaagaggggcgagcagtactcaactccttcttacgtgggcagaggtctgcaggtggcctggagaggtctatggccatcccctcttccccctggattgtgcattccaggatctcaaacccccagggttctctttgggactgagcagaagacagagctggcaagcttacaatgtgtgccgcgctgctgcttggtgtcaaaccttgaggatacaaaacgcttgactccaagatacagggataggacactcctctccagaacaagcagctttgaaaatggggcacaggtcacactgtcccactcctgaggtttctcctgatcattccccagctggttaatatgggattgttatggcaatgagaggaacagagttgggaggagctggtataaaagggaaatgggggaacgaggaaacatagtggtggcttaatttatatataaagtttcataaccatttggtccttggagctgagcttgagacatctcaatgcctgttcccatcgtgcctgtggtcacagagatacctacagagccaggtagataacattcacggtgaaacgggcaggacgcatatgctctccagcccactgcagtcgtgcagaatgcaggtctgctgctaccgcaactttcaatacattaaaataatccagaaatctggtttttgagcaaaatctcacaatttttaaatgttagcaactaactcaaacttgttttgctttctttcttaaaacacattttatgggaaaacaaacaaaaaatccaacttggcaggttgaattcagccacagacaccaatttgtagcctcctaatagtctctttgtgatatactttgggcgggcggtgaggaggcaataaggctcggatgtgggagactccacacagtagccacaggaatgctggggtccagaaatgctgcatgtgcagctgcagaagcaatggcaggaaggaggcccagagaggagcgggaggagcgagtgtggagagaggaagaaaatcacagcagaagacactcctgggcacgagaggactgtgtgccaaagagaaagaggattagccaaatacacctgcctgtgcaaaccaggggaagctgaccagaccctggacattcagatctacacccagatgagccagacaaaagctatcccaagctccagaggaaaaaaataggctgtgaaccaacctggagcaggaccacaagcatcttctggaagtggccagaggtgtcgccgatgatgtcagcctccaggtcccgctcgtaggctgcagaaaggaacgcaagctctagtctcatccccagagacctcagggatctaggataaagggccctgctgcccccaaaatgatcagatatttttaagaattccaaaacccagtctacacgtccatcatggcaagacccagggtatattttcacagctcttcgtactgaccatgatatgatgaaatggaatctgttcattctctctagcccacctataccatgacggcccacctggacagtggctacagctttccgatggttctctcctcctctattctcaattcctttccaacccacggcaacaaggatggctgtcttaaaacccatatctgatcatcatactccccaacttctcattagactcagaataaaacaccatctctctcttggcctgcaggccctgtgtgatcctgccctgtcctctacctgtctagccttgtaccggctaccaggctcatttctatttcagggcctttgcacttgccgtgacctctgttggaaggatcttctctccattctttatacgattggttcctcatttcctcccaagacctcactggtaaaagtttgattcttgttaccttatttcctgtacaacacttagctaaaatccatcatcactgtgtttatctgttcacctgtttattgtgtgtctccttcattatctcattatctcattggcctaagagagagggacccctttggttttatcccgagaacctagcacatcacccagcacagagcaagtacttattgggtagataaatgggtggacaaatggatcagaggaaaggaggagagaaggtagatggctagaatcttagtgtccccactgttgcaatcatcctcattttgtatctgaagatcctaagcggcccctcctgcccatctcaccatctttgtatgctgccaccagctggtgcatctgctcattggtccgggaagccaagatctcaatgaggcacttctcatcagtgccaatgccctgggggtagaaaaagagcgcatgaattaagggcagggatgggaggtcactggacacaggttgggatcagggagtggccagagctatgacaccccaggactcaggaggttcctacccagctcttaggcactgattgggaactcctgccttgagactcataagacatggtcatatgatttggatgtgtttccccaccaaatctcatgtcgaatcgtagacctgaatgttggaagtggggcctggtgggaggtggttggatcatgggggcggtttctcatgaatagttagcaccatctccttgctactgttctcacgatcgtaagttcttgtgagatctggttgtttaaaagtatgtagcacttccccacctcccgccttgctcctgctcccaccatgtgagatgcctgctccctctttgccttctgccaagactggaagcttcttgaggcctccccggaagcagaagccacaatgcttcctgttcagcctgcagaaccatgagccaattcaacctcttttctttataaattacccaatctcaggtgtttctttatagcgatgtgagaatggactaaaacacaaaggttctagttctgcctcctccagctttgtgaattctcttcagaaactatctttttgggcctcagttttctcatctgtaaaatgtagatgatattagttgctctgccaaactcacagggagattgagaagataataatctcacattgctaagtgcatcagtttataaaatgaattcatgcttaatagctcatagaagacaaagatcatagcactttatagactgtaaagtgctagatacacttaaagggctttgcctctctttttcctagggggcaattctctacctctacctcaaccgggctgaactactcttcataccctaaacacagatccacaacttctcctgccatttttacaccctgcaatgaccttgacactgctatccaccaaatcctctctgggctttggggcttaacttgatcctattatcctttaagatgccctctcaaacaacccttggcccagggtcatgttgattacctttagtgtgcccttggcctcaggagtgttggacacaatttgtctccatgtccctataacctgtatccttggactacaagctcctggtaagggggtctgcatcatgttgacatctgtctgcatctctctgtgtgcggatcgggatgctcctctgggataaatttagatgtgtctttgaagcaggacacatgtgctgggtgggtatggggctcaccagttgcttttggaagagcccagaatcttcccattaaccacatccccaccccaacaccacatacacccccacttcttaccgagatggcatctttaatttctttggcatcacaataggcaggtggcctcatcaggcccacaatcaaccgttcaaacttgcccgtcaattcatactttaaatcagcaatgaggtcctggcaggtggggaagaagaggagatagaagaggaaagaggaagagtagttacaacggtaagaattacacttaatgagcacttactctggcaggtgctgggctaagtaatctcattaaatcatcacccttggaggtatgtactgttaccaaccctaagagacaggctcagaaacaacagaggtcttactccatgtcatgctgctagcaaacggctatgcagggtcaggtccacagccctgtgccacttccccaccactgtctgtttcctcgtttactgtgtatctctctcactatctggcagtccacagagttgacacctcacccatcttattcactagtgcagccctaacacctagcacgagcccagcatacagcaggtgctgtgggtgtattaaaggctgaaagacgcccagctgatgagaagaaaaagagcagggtaaggtgtcagcccacaggctaacctggagtgccatatccaggaaataacctgaacgagcacacaggtgaatgaaatcattcttccacccgcaccccatgggccctccggttgctgtggttaccttgccgtagagggacttgtagctctggcagacctcctgcctctgcctgttgctccgtgaggtgattatgtccagtatggcctccttgtcactgcctggaataggggagagcaatcatcatcctacccaccctgcctccaggaagcccaccagggccacttccttccctggacacaggcctagtagctccctgcaggcctcagcatgagccttccactcatcaggtgctggtgtcagggcagagggtcatggggatttattaagtcacgactgaaagtggacacagcacacacaatatctgtgctcagaaggcccctgatccagctcctcactgcacaaatcaggaaattaaggcccagagaggggcaagaacttgtccaaggtctcacaatgaacctggcttagaaaacccaggtatcctaacacccagtacagggttctttccaccacaagacaaagaagaacataagcaccaccttcggattgtggctgcctctgggcaaaggcagcgggcggcattatcaggagggggatctaccaaggaaacttcaactatgctaatgaagcactagttcttaaatttggtggtaaatctatgggtgaaatttctattattctttatactttttttctgaaacattttattataacatcatgaaaattaataaaaagaggagaccaaaaaaatgaataagtgcacttcaccatttcacagaccctaccaccaccaccagaagggctctgggctgtgtctacttttgggggatacccctcaagctcccatgaagcctggcacccaccaaagcccttcatggcagtgtacagagcctcggcatcctggttggggtcaaagcctgggaagtcatggatggagccccggtacttggcaccctgtggagaaaaaagtagagggtgagctgccaaccccggactgagaccaagctcccagccccaacctcaggtcagatgcctaccctggtccaggctgagctgctttccctgcaaaatccagtgctggccacatacaccctggggagcggtgtggatgactttcccataccacctgctgcaacccgcccaaaggacagtgccatttccccaagggaggggggcttggccaaggcctgcagccctgcaccaccttccaaagcatccaggagagggtaaaaaagcctggctgagtataggagatgaaaatgatccctgcaagaatagcaagagtcaaatatatatatatatatatatatatatattttaagagatggggtctcactctattgccctggctagttttgaatgcctggcctcaagcagtcctcccacattggcctcccaaagtgctgggattacaggcatgaaccagtgcacccagccagcccctcatatttttatggcattttatgtttacactttcacctctgtgaatgtcattagtgtagccatttgtagacgctcttaagattatttctatcacagaagccaagcccaaagaagagccacttgtgggaggtcacacagaactcagaccttttccctctgctctccagccccgctctgctctccagctccaggaaccttgcaggtgccagctactgagggtggggtcctgggcacagggggcccagagacactctcatttcaatgccaagacaaggcactgcccctctgggcccagtaaactgcgctgtgaactggcatctgaggacaagctggcttggtctttgaggggaaggagagaagcggcagagagccaggggatcttagacatcgaacctgaacctgaatgcacaatgggactggttcacagagaagtcagatgtgggtcagttacatggcactgaaaagtggggggtctgggagagcagctgagagctggcagagtggaggatgccagagcctgtcaccgagcacacagcacagtgacaaggcacttcatttgtgctaggccctacactaatggctgaggaattggggagaaaggggacccaattcctgtctttcacgagctcctggcccagtggcagagacagacaagcacatcaattactataaagcttgtagtaaatacattaagacaaaaataaggtaatgtgggaaaacagcagaggctgatccagctgcgggaaatcaggaaagaatccaaaaaagagggaatggagggtgggccacacagatcttgccttcaaggagtcagaggtggagcagagtgagtcctggaccgcctccccctctccccgtctccgtgcctcccaacgtctgcactgcaggaccccggccaggcctctggatgctctctggtctctgtctgcagaggctggctcctctgaggtatgcatgcgtcggcgtggagttactatttaaagttctgaccagaaaggaacacagctctcttcctgccacctgggaatcccctgcaacctgatcacgcccctgggcagagacttaaagagtaacacatgccgaatacccagagcagggcgccttgcaaggagctcagtgagcgcaggatgggggctttactgccagcgctccccttggccttacttcagacctcacggccggagcttgagaaattcctgctgccttctccaccccggtgggcagtttgatccagaaacctctgagagcagataccagatccatctgcccactgcacagagattgaccaaatactcaagtatttgccacatgaataaaatgaacaagaacacgaaacaactggggtcctccaggaatttcacttctaaatccttttctctttctttctggacacctccagtccagcgatatcaaaaaagcacagcaggcaatattagctactaggatggatggagaaacaagaggtgcctgggcacagtggctcatgcctgtaatcccagcactttgggaggctagacgggagaccacttgaggtagggagtcagagaccagcctggccaatgtaatgaaaccctgtttcagctaaaaatacaaaaattagccaggcatggtggcaggcacctgtaatctcagctactcaggaggctgggtcaggagaatcacttgaacctgggaggcagaggttgtagtgagctcagatcgcatcactgcattccagcctgggcgacagaatgagactgactctgtctcaaaaaaaaaaaaaggaaacaagaaggttcagaggctcaaaattatttctttgcaacgatccttaaagaccttttagttcagcttcccactcagttattgagtccatggagaatggagactgtcgtgaataagacaaatcattctgcctaagaagaaccgtggagccccagctctagcacaggcttggcatacaggctggaagtaactgtgactgggctaaatgaatggatggagacacccatgacggcccaagctctgagatggaggacgccgaaggggaagacagtgaagggagacctccctggcactggatccctagcaatgctgtctccaatgtcaggacctcctgggaccagtgtggaaatattaagctttgaaagatgccaccaggggcaggtcctccagggtctgtccgggccctctgcaggctagcctgttgccatgattcatggctgtttttccttccacctgtctgaccaacctgtcctaatccacagcagcaccagtctccaatccacttcagtcataggatgtccctcccacggctcacttggaataagagagggaaaggactttgagaaccacaagctgagaactaaatgaggaaggtaggtctattaccacttgtgtcccagaagacccagaacagagagggcaggtgacatgtcaagaccacacagcaagtcagaggcccagctgggaagggaatccaaggctctttctaacagaccatctctcccttcccctcagattccatctgggtgggagctggagataagaagggacaaccaccacatagcccactgcttcctcctggtcaaccatgccagcctgcccctctccttgaatactgaagcatttgagttattgccctgtgctgtttgcctctatgccatttcgaccctatattcaaggctataaaaaggcagcaatgctgtccaatccacagcatcctaagtgcttctcacattcagatactcacaattccagggcagctagggctaccctaccattcattcattcaatcaagcaagcaagcaacatttactgagagtctactaagtagatgcttaggaccagggaccactaagaactcagaatctggtagagatacatgacagcttcaactacaagacagtgtggcagatacgatgctaagggcagcatgggacccaggaaatatttcctttcgaagttccgggagggcagggactgtgtctctcttgctcactgacgcatttctagcaccaagtacagggcctggagcaatcaagcactcactgaatatgtttcataaatggatggatgaatgactgcgaatatattccaagcagatcagagaaggctttctggaggtgacgtctaagctgagtcctgagggatgagcaacaggctggccccaaggagtagagtagggaggggaaggcgaagaggaagaaggcatcacacagaggagacacatgacaaagacctggagggaagcaaggggcattcgggaaagccagcccagagtctgcagggctcagagcagatgctggctgtcactaagatcatccactagaagcggggaaggcaaagagatgaggctggagaagatgatggggataaacaattcagactcttgtaagggcagctctagccctgctgggctggcctgggcacaacacctaagtcaggacctgggtaagggcaagactctaacatcctagtgtggttttccttacccattaaactcagctgaccactcacaaccctgtccctagtatctggcattctttactacgttgagccatgtaacttgccttgtatgtagattaaaaacagtcaaatagcagcagatttcatatggttcatgtgacaggtatttcatacaaatacctgtctggttgatatgtgggatctagaaactattttaacttgtctgctggggcaggggtgtgtgggcggtgacaagtacttaagatagagtctgattcttcagagctcacagttagatgcccaaagtcgctaaagtcatgggattgtaagctgccgggaagggatgcggagaagagggaagcatgtccccaggatgaagggcggaggatgaggcagcacgcagaccccaatttcctattgctgctcctccccctccactgttctccccctcatacaatgtgggtggtcacagcagtgtctggagaaggggctgaagtgccatgctgggggaagggtgcttaatgacctacacaagccttgatccaaacgctcacttagagacaagcttcttgagcagcaagctcgggctcctgcacagttctttgcacgggactaataagaccttccaagtgatgacctactagattagttgtcctgggaccccacaggatcatagccactagaagcaaaggtggggggcttagcactagtcacatttggagatacagagacagcccctcaaatcatccaggcccaggcttcccaccgtgtcattctcacaccaacttcatgaattctgcatctctaagcgccacctgtgcaaccacacaggcttctcctcacccaccccaccctgactgcctgtcacacctccggcagacaggttcccggctgcgggaacccaggatcaaggcaggggacagcagagaagggactttccaccctgaaatattcagcaggtcctggtgccagctggtgagcagccgggccctggggctctgtggggctgggccccacccaggctgctgctggagcaggagtcctagtggcctcttgggagcagagatgatgtccccagagagacaggtacatggccaggactccagctgagagctgccttggccggtgctgacctaggtctcacctccacagctcctagaagtcccaggcacaagcacctgcctatcctgccctgtcctcaaggtgtttttatgttcattattgcattcaaacccagaacgtccctgtgaaatggaggccacagcgccatgcctcctgggtcttccatggcaccatcctacttcttcatgtctttgggcctcaagttctcctcttccaaaaggagagatagggagaacagcacaataaccacagtggaaggaactggggggtgtctaggccagagaagacggagcagtttgctgtgtgcatgcacacgtgtgtatacatgcatgcatgtgtgcgtgtgttggagttttggaggacaccagattcaagctaataattgaaagccgagctaataactggaaggaacaactgcagctcaacggcagggaggcttttttcacatttctctgttattgtcttctgcaaccctcacctctcccccaaaccactgcaccccaagcataccaaattacttttactcccctgagcacgctgcatttgctctccttctagcctctgtcccagttgtccctgcctagaccactctgagcccccttgttcctcccctgagtagctctccctaggcagcctcccctctctcctcaacctaggtggggtgccctcctgcatgccccagagctcctttactgccccaccagaacactgtgcatggagggtgccaactcatcccataggaggagggttccctaaggccctgccaccctgggactcacttgcaggaggtctactgaaccctagtccatggcaacaagaaaccacagatcagccaggcagaaggcatggcccaggagcactggaccaaggtccaaagatctgcaccctaggtcctggcctctctgatcttccagggcctggcctgtccacttggatcatctagaatcctgcagttcaaatgcctttcaggaagtagctctagtatgactacacataggaaatggggaacagtgaaagttccaccttggatttttgcccataatcagtaacattttctcctcctggtcagagaggccacttgtacacacagtatactcctcagtggctgtgaggaaggccacagctaggacttctctgagggtactgatcctataacatcctgtgctcttcagaaactgtgaatatcctataagcccaggttcactgggggcagtcatgatgtcaaggatggatggagttttattattactgaattcaaccattccgtaaggggaacatgaggcccaaagacctcacagacagcttctgtctgtgcattctgtggccagtagttctgggttggagtaagggacaacggggcccagtcccatgattttcttcaagatccccaagtttcttctccctgccaatcccatcgtcacactgactgcatggctttctccaacgccagccaacagacagcaccctcaggcaaaccccaacagagtagagtggggttttttgttttttgagacttgctctgtagcccaggctggagtgcagtggcatgatctcagctcatcacagcctcaatctcctgggatcaggtgagtttcccaccttagcctcctaagcagctgggactacaagtacatgccacctttgtattttttctagagacagggttctgccatattgtccaggctggtgtcgaaatcctgcgctcaagtgatctgctcacttcagcctcccaaagtgctgggattataggtgagagtcaccgtgcccagcctcaacagagcacagtcgaggtcagaatcctacctctgaccatggccagaacctagtctcagccacatgggagtaaaagttctcaggtgcctccaattctattgcccggcagaacagtcagacatgagagactgaggttagagtctcccaagccaaggaaattcaatcccaaatgggtgtgacagagaacatttctatatccagagcagagaagtcaacaaggatgtctttctacctgtcaagtatccatttcccttcgtcaggccaaacagttcaggtgggaccaactccacctccttgctccaagaaagaacaggttactcaggcacagccaatgagaaccagacctgggccttcccctggaatcactgggcatgagttatgttgttttctccctgggctgccaagacagcagaatggaagcctggagctgctgatgactaccatgccaatgcaaggaagaacctacccaagaatgaagccaccggaagaagcccagctcacacaggcagaatcttgacactatcatttggaaacccctggattcaaccagacctgaagccctgggcctctctgtcagataagccaatacacatccttttctgcttaggatattgtgggttatattacattatggtgacctgcatctgaagagccatgacttgtaacaggagcaagcaaagcctaagaacctttcctccttttttcaagctgaaggtaccaggggtctctgtagcaggcctagtggctccaggaggatcccaggcccagagaaggctgagtaccaccttcaggaaagagaggccccttacctgtgctggtttggccatggtctccggttcgcagcagaatccactgtagagaagaaagacagcatgtgagattccccccaactctaaccatcccctttctttcccttacatttcctccctctgctgttttccagctgcccccagcccttcaggttaaatcagacccaatgacccagctcaaggccaatcacatttttttcagaagacaatggacagactagatggtgtccagacattcacagcagtatgggaaagggacgcggatccccaagggagggcgggcatggcactgacccaccactgaccccttgactcctccacactaggcagggtacctgtctcagcaccgtctcagttactactctcagaaatccttccacacatcagattctccttttttatagagaggaaactgaggctggagcatcgcaataaatgagccaagatcacacagcttagaactgaattcaacaatttctagatcccagagtctatactatctgcaccatgcatgcccccttttcaagtcaacaaggatggcttcagaacccagagcttgaccgcctgcagataggactcaaagtgcttccaaccacctgctgcaatatctgaaggactgtcattcctgaacaagtgagtatgcactcatttagcgcctatcctagtcaggcattgctctgggcactgtgcatgcagaaatatgagcaattttttaaattctgtttctctagagcttatgctgtaatgggaatgaataacaaatgcactcatcaggctgagataagaactacagagaaaagacaaggcttggtcaggaaagtgacaaggggtgtagtcccaggtggaggggtcagaggatctcacgagtgtgactggggcacaccgcggggtggtgcaagtgaggaaccaccacgagctcagtgtggctggtgtggtagcagggagtggtgtggtaggatgtaggatctgagaccggtgcctgaggccactgtaaagactggatttttcaggctggtcgtggtagctcatgcctataattctggcactttgggaagctgaggtgggaggataatttgagcccaggagttcgagaccagcctaggtaacatagtgagacccgatctctattaaaaaaaaataaaaaaaaaatagctggacatggtggcacatgcctatagtcccagctacttgggaggctgaggcgagaggattgcttgaactcaggaggtggaggctgcagtgagccaaggttgcaccactgcactccagcctgggtgacagggcaagccctgtctcaaaaaaaaaaaaaaaaaaaaaaagacaggaacacacaggaaaacaggacacatatctcattgaaaatggataaggaatgcgggtggaggatatcaggagacagggtctacagtgaaggaacaaagatatgatacgtaaaaataaatgcaaaaagagatgtaactgatttgggaagtataagagaagcaggtagggagctggctaatgagcactcaggagggcaacagatgaaagtttaacaatcttcttaagagaaggagaagagaaacaaaggaccactactttccactttaagcaggtctgggcaatttgatctcttttttttgagatggagtctcgctctgttacccaggctggagtgcagtggcgcaatctcagctccctgcaacctccacctcccgggttcaagcgattctcctgcctcagcctcctgagtagctgggattacaggtgcacggcaccacacctggctaattttcgtatttttagtagagatgggtttcaccatgttggccaggctggtctcgaactcctgcccttgtgatctgccctcctcagtctctcaaagtgctgggattataggcgtgagccaccaagcctggcctgatctcttttaacaatgtctatgtattgctttttaaaagtgaacataacagaggccaggagcagtggctcatgcctgtaatcccagcactttgggaggccaagcggcaaggaccacctggggccagaagtttgagaccagcctggccaacatgcgaaaccccgtctctacgaaaaaatacaaaaattagccaggtgtgatggtgtgtgcctgtagtcccagctagtcaggaggccgaggcaggtgaatcgcttgagctgggaggcagaggttgcagtgagcagagatggcaccactgcactccaggctaggcaacagagtgagactctgactcaaaaaaaaaaaaaaaagtaaacataacaaagtcaatcagatttacccagtaagacctaaaaggaacagaactaggagagtagaaatcatggagacatttcagctcaatgccttccagttctccacatattccctgttcccccaagacttagggaaaatcttagccatgtgaccgtgggcttattgctcatttttgagttcaaggtgatctcaagcacaaaactgaagctttcccttttctgctttgtagggttgttggaggataagacctaagttatgtcaaaggcagcacataagaggccaggcacaagacctgttcttagtaaatggtgatatttactgtgctggtgggaagttgaggacagggcctctgtcgtgtttgcctctgtgtcttcactggctgattatgagttccccaagctgcagtcagctgaggacagtcatcatatggggttgggagtggaaggcagaggacggatctgcctgcaaatgcagctcagctcagctcagcttcaggaaaccttgctgtttccctggcaaccaggggccccttggtacaactgtgcagctctcaccaggaaatggaaactgtaccccctttccagtgtgtggtggggggaggagggggcccacatctaccccgggatgaggctggaggccagctctcggtttcctctgacctgggggatagtagggggagacagtgaaggaagcccaaggctagcagagaaccagggactgaatgagacccaggaagttagttgacacagacagagggagggctgaggcctgtcacctgcatctccagccttgaagcactttcctctgggcttgttgctggcaatttcagctgctggctgcagcccaggcccatctggaggagctcccctttccaaggagagatggcttcaaggaggggcctcttactgtttgggaaaatattctcagctctgagagcagtttctgtgtgccttgtgtgagtgcacagttcatatgtaaaaagcaagctccttccagaactagatgttcagactgcagttctgagggccagtccccctgctgattccacagccccgcctctgagggttctgggaagctcctgagctaatcataaacacaccatttaccctggctttaagatggcttctgatccctcccagagcaacctagaccatactgctcaaattggctgaatattttacatctagtgtttctgaatcccacaagggcccttaataatccatgactccaagtccctcattttctagacggggtaaaggcatctcagaaagagaaagtgacttgccagggcccaggaagcagccaacatctctgcctagcagccctcgatcataacaagtccccacacaactgtgggtcttggctgcaatgggacaccaggaagagtccaaagaataagaccctggttctggttcccagtctgcccccatgtaacctcaggcaagccagatccctctctcagccttagtttcttcatctctaaagtgggacaatacatcactccctctttggtaggatctatagttagaggcttttagagacttcaactcaggattttcacagcagaatatcagtcctaggagggtcatctcccaggccacaggattcctccccatctccacccgccaatatgcaacattcatcaccttggttgaaagagctgttcaagactagtaaacagggtcattccagacctgtgcctctttcctcccaggaaccctgattctctcagatctagatgagatatactgtgacgacttatcatgactgatcattcgtgaaacccacacaggagcagaatgaatggcctgggtggctttgtgctgctgtggccaccccttgcctcatccttttgcctgcaatcaatcacgttttcctccttccccttcgagagttccaggctgactctagaaggaacggctcaccactgcccaaccacagagatgtggataggggaagggttttatccaagtcatgtgaaggcatgggccttcaggcacagatgttgcccagcagtttgtgatgtaagtaagttacttaaactgaatctcaatttccacatccgcaaaatgcagatagaaatacctataggtactgagaaataaatgaagtaacggggggaaaacacttagcacagtgcgtggcacacagtaaaggctcaataaatggtggcttttattataataagcccaaacatttacaatggaggcaatgtggcattagaatcaatgcaggatttgtggtcgatgcccaagttcaaatcctgaccatgcaaattccgagctcagtaacttgggcaagttatggaatttctctgcctcagtttcttcatcctgaaatgaccctcttgtaaggtttttgtgaagattcaatgaaataaggcaggtaaaacacttagcatggccaggtacagattaaatgtttaacaaacggtgacttctgttgccacaatcatcattattacagcagtagtctccaaaaaggggtaatgggtatgacaatccactggggtgcaggacaagagtatcaccactttccaaatgttttaatcttgcccttttatgtcccatttttatttgttatacatgtataaagttaaagaaaatattaggggtgcaggctgatagaggtgcacagtcaaaatctggattcaatggaatggaggcaggggcatgccaggaagaatagtaacaccagggtaagaaaaagcatttctgtcatcgaaaggtagcttgggctgtggaggaacagagtacacttttgagggaaaggagatgttgagcgtaagggggtgaaaccaggtgtggtgggagggtgatttgagaaaaaagaaataatatggaaaatcatgcaaaaaaacccacccagacctctgcctcaggggagtgcctgaggggctacagcctgagccacagcactcctctgctcacaagtctccaatggtgccccttaatactgggcctctaagctcagcagtcgaggccattggttctccttactgacttctttgccatcaccactttcctctttgccctgtcttccctgctaaaccaggaacgccttccaccaacatttttaatccagctttccagaatctataccagtgcttttcaattctagcttcactaacagaacctggggaatttttcaaaactaccaaagatttaaggtcagcccttagagattctgactcaactgctggggtgaggcctggcctttggtaatttctaaaaactttcctaggtgattttaatggcagccaaggaggctgagaaccactgttatctgctggattcaaatgccgccttttctaacaagccagaaggtattcccccgctagggtgctctgaaaccaccttgatttgactggctttggtcaaccactgtggatttatcatttctccattagataagggctgccagcctccaaggtattatgggaaagaatctgtacttcaaaggaaaaccctccaggttgtctgactcgagactttcattgtctttgagtgattttacaggtcagtaagttgcaaataattgatggtaacacaaagtaattctaatacatactccttgccctattttgtaaaggtccaattgatttcccaccccctcaggtaaaaaaagagttttgtctctaattgcacatttctttcaatacaaatgtgtcttttgagctggttataacatcggcctggtgtggtcattgattaataagtagaacagcacatgatcatttttgtatctgcatgagtcataattttacactttttagaaaattactgcatatgcctctttcctgcaccccctcccatagggcgtggctcctatggatggttgggggtaaaatgcactaagtggctttcatgctttctttagtgacctcagcaaatggaaccatctactattggttttcaaactgtgctttactcctctttctatagccaggagataaactagagaggttaagtcacttacccaacatcagaagaaaatcagtcatcaagcaggggcgtgtttttccataaacatttatttgagcacctcctacaaaccaggcccactggtagaagttgggggttgaacagaaaatgagacagacaaggctcctggccccacaaagctggtgataaggtgatgtcatatggcagtttgcagtatatatatatatatatatatatatatatatatatattgatcccatacacaacccataaccaaagaaaaattgagtatttaccatgataaacagaaatatacctttaaaatatgacattaaaagtacatttaataaggagtccaatagtttcttcctgtacccccaaaagatcatcttcagtgcgtcctggggtatatccatcccacttagaaggcccctggcctataaaatctagatccttccctctttgccctttcttgctggcttctcccccggtctgcaggaagacacccaggacccgctccataaccctccaggagccttgattctgatgaagctggggtaaatgccttccctggctctgtgcgtgggcacaccccccagcttgacgactggggtttcttagggagcagtgtcttttcctctcctgacccagaaccattgatcctaggactggacaaggcctcaggagatcatctctctgcctcaggattggaactagtctagcctaggtttgaaccccagcttgggtcacttttgtgagaggcagcaaagtagtgtctcacagtatagatgctggagccagactgcctgagattgaagcctgagggtgatatttagtagctgtgtggtgttgtgcaagtattgagcctctctgtgcctgtttcatattaaaaaaaaaaaaaagggataaaaatagcacctccctcataggagttatgatgaggataaaaaaaattaagacaagtctagagcttagaagaggacctggcacacaggaagcactatattttataagcatttgtcattattatttcttccttaaactgttaagggctggagtttccatgtctgcaaaataggcattaataacagcgtctaacatagcaaggcttcagccggggcctggcaaatttaagggttcgagaggtaatagtggttaccattttattgctattatttaaggaccaccaggacatggatttttcagaagaggaacttgaggctcaggtcgcctgccttctcaagcaccacacccttttgagataacacagcacttttatatctgccatcttacagcctcatgaaggtatcgatctcattctcattttgcagataggcaggacatccaaggaacctatagacagtcactcccccatagccagtctctgtgggggcttctcaactccaggaggaaagggagtgaggctggattccaaggcaagtttataggcataaagacacccctccgacttcctcccctctattggcaggagaaggggtgcatgcatgctcaggaatcacggtagagaccacatcctgtgctttgtcgccacccaggaagtatatcggagaggctgggtggggtgaggctggtgattccactgggcctccccagaaaatcctagaatggtagagcaaaagccattcagacccaacccattttattaataccagtggggtgtcctgggtatatgtcctatccctgtagagaggaaggggctaagccccagaggggtagtaggtgtgcccagggcgcctagctgattagtggcagggcaggggctgggtccgaggctggatcctggtggcccagggctccctctggatgctgcagtgcggatgtgccagtcactggcagctatccagcactgcagtctcccccacttcatcccaggagtcagtctcaagaggccaggccttgggcttccctggcccctcctctgcacactcacatctacattttgccccagcaacagctgtggcccttatccagaaactgcaagtattttctgtatctcagcagatgctgccttaggaacaaagggtagataaggcaaagaaagatggatgagtgattgtcacagctgcagagggggatgaaagcctctgcctcctgccctccccagtcccatccaactcccagaatcctaaatcttagaacagttgaatcctagaatgtctgcactggcagtggcagccagttcagcagactttgctccagatggggcacaaagccttagagaaagggcttgctcaagaagtcccagcacatccggactgtaaccgggctttcctctgaccccaggccagtgccctcggcgtggctcagggcctgcctgctaggaggtcagggtccacaggggctgaaactggggcggtcattcacttcaccatgaagggctacgcaggtcaggatatgccatctgggtcagtggaagcaatcccaagcatgttttgggcaagggggaaggaataatggagggaaaagggcggactcttggggggaaaccagagtcctttcacaaacccgggagccatatgtccaaatttggaattgtcagagaagacccactagaatctagggaaaggaaggaggaggcaggaagccgtggccagattagttgtcccaaaggacctcctgccctttccccttgtagggcctacaagggttgtgccaggcttcccaaatctataatcaagactcccaaacctgcaatcattccatacagctgacaaataaatcagttttcaaagccattgtttcctttgaaagagactgggtttctcaactatggacttggagaaggaaatccaggctcagagagggaaagccaccgcccaaagtcacactgcaacaggggctgggattccgattcagggtattttgctcccatgctggtatatggggaattatttgaagcccccaaactttgggaaggcctagaccgcttaggggatgcagaaagaagggtagtgcccctgcctcaccataggaggcctcggagccccgttgggagactgcattcatagacaagcagtggcccaaaggggatggggtccaatgaggccctgaggtatgtacgaccggacgttcagctctctgcacgcaggcagccctcccccgacaccacacacaagccattttataagcagctggagggtccaacgctcttgctctcagtcttgggcctcagccacacccttctctgcgggtcctttgactggcgtccagctgaccccaaccccggaccttcaaagtctcttgagcccccccaaattaaggccggcaggaccagcccctggctcagctccggcgcccaggaccctcaaccagaccctctgcagcaacgggactccctcccctccccctagccagggcgccctccgcccgcgcctctccgccccgaccccagatttgctccgctgcgctccccagacacacccagtctgcgacactctcgggttaccgcgccctcccgtccctgctcctggcggggggtacccatcagccgatgactgggcgcttatttcttgtgtccctgcagcccccgggaaggggttcccagagcgactcccctctccagcctcagcccactcaccgcgcagcggaggcctcgggtcgcagacggacgcacgggcgcagggactcgaggacgcagcgctcgctggatcggagcccgttagcccagcagcaaccgcagcgcggggcggaccgggaggacagccgtgggctccgagccggacacgtggcgcgcagaggccaatccggcgcgcccgcctccctcctccaccccacccctct

SEQ ID NO: 1791 - DNA, 70640 bp, Homo sapiens
tactttctagctgaacactcagcttcatccactccaggacagctgagcgtctgggtgagtaatttttccgaagaaatgtactatagctagattcacctccatagggtaattttcctgggcttttgcagatctgaaacatatggaggatttggctaaaaagcatcccttttcttctaccttctctatgcctctcttctgaaaatgcccagtactcagatctaaaagaaccacccacctgccctatagctgccttccagattctgcctaagaaggcacaaacatctataataaaagagacagtttcatcttttggccctaagcgttgttcccttaaggcaaagaaggacttacccccaccgccttgctgtgggtctgtcactcatgccttccccagccagagtgcagctctcattgcctgccccgcagctccctgtgtgctgggagtcagattacggccacttgtctgattgggtttttggagtgttaggggtggaaagattctgcaccatgtggcaatcgctaagttatatttgaacttgaagtagcttttctgtacctgatcactgtagacacagggcatttcaggaatgcaaaaacatttacttaatttttttttttttgagacagtaatttttgaaaatgaggatttccttaaatctttatttgaattctttctaccatgaagaattgttcagaatttgtcttgtttggttatatgttgtagttgaaattgggcaattattagaaaatgaatttgtataatccagcagttaacatgaatttagatagagacttcagtgcatttagtttttagccaatgaattctgtttgaagtttttgatctgagaagaagcattataagaacaatatataactgcagctccatttatagcacaggcagcactgatttggacaataaaaataaggaaacataggaaatacaggaaaaaagactgctctagggtgctcacctgactgttacattaataatctggggataagaagtagcaaacttaaaaaatatcaaagttggatggggacgaaattatggggaactgtaggtaaatttaacctctggaaacttagggacaggactgattttataatttactggtcccagtgcaaaatgaatgcaggacaccttggtaaaacactatttaaatttcaagattgcgacagcagagcataaataaaggctgggtgctcctaaaggcaggaccttgtgcagctgcgcaggctgcatgcttatgaagacgtccctgccgaaggagtttggtgaactctagaagggtctaaccattagctacctgcatcaccatctcattattattttttctttaaacagatcttaggtgcatgggattggaataatcagaattcctgatttatgacactctgtcatcactcgtgcatgtatggccctcttattttctaatagttaattataatggcttttaaataatgtaatgaacatctatgaacccaccactcaacccaacatctagaacaatgataataactcacattacctacggatgcctcccttttcccactttatatttcagattggattatttttttccagaatgaagtatgacaagaaagaaatacatgagagaagaaagactgttatacttttaaatcccagttacagtttttttgttttgttttcatttgcgtacttgagacatgggaatgggtgaagagctctcattagaaagaggaattcaaaatttgagtgtgactttcagaggagcactttattactgtttcaagcattctcagctaaccaagattgaatttagattcttaagaatatggttgcacacttattattgtacatcagtggtttctacctttaatatgctccctgaaagtcagaataaattctgatgagaggggcagggagaatttatatgaagccacagagaacacttaaaacatttcatattgattcttaaagctgtttaccatttggattttagaatgagatttttaaaaggtgcaaaatgtttgttacaaattggaaaactgtgagtttctaggcagatgtgctaaatgtcattactctgaccctaagacatttgagtcagaagtattttgagggctgtgaagctaaggcacaatgtagccatgtttaggggcttccttgtgaatgagtacggtgggcagatcctcaggaatctacagagtggggctctttagggctaccggtctggtcggtgggtggacattttctaggtccactctttacaggttgtcctaggcttattagcattctctgcacagcctcggcagttgcagttaccattttacaaagtgccagcaaaacttggttaccacggtttctcagcctctttccctgttttctggctggctgatgctttccagggcagttcctaagggatgactgttcccatcaaggaaggggtcaccctcattggctccaacccctacacttattagtactctcagcagagtagcttaaaattgaccagggattaactcttcacctgccagaggtagtttttcttattaagtattgctaattaacctttttgtacttgagctgctactactgatcttcctgtgatactgtcagctctatgcaataatcagctacttatctggcttttctttggactaggggcagaaatttcccacacgattgtctgtggctttgtatgcagaatgcgataatgaaggaaagcagctataatgtgcttgtagtggtggtggaccaccaggaggtgggaagctctggtgaacatgagtaataccttctacattgaaatgttttgatgtggacctggatccaagtgagagttggaatctaactgccccccaccccccacaccactggtatgtttaaaagggcgcaattcattaaaaaattgaataacaatttattatattttcttgactttctcattgtatagtgttacgaacttttgggggaggatagttacatggcatattgatttaaaattggtctttatgccagaccaccttgtgaatctttagttcaatagccttgcgaagttgtgggtcagtaacacatgaggaaccagagagaagcgtaagtgaaaatgacaagtacttagcaaacactagctaattgacacgctttttttgttgttgtttctgaatttttaatctactatgccatactattttccttgggtgctgttgtatatctttgggatttgtggactccttctcccatccttgccctcagaacttttaatatttcttcatgtgttcagagattgaaaactgaaacaaaagcactaaacatgccagcaatgcctcagtaccagacgggaagtgtctccaggctggtaggggcagattcaatcgcaactcataaatcttactttgcttttcatgaatctcagcatcatgaattcccccagagcacttatatatcagtatgttcattaaaaacaaacaaataaacagaacaacaacagcagcagcagccgcaaccacaaccatcacgacgaagggcttaatggggctttgttcctttttcaaggaagctttaccttatggttataattcaggatggcttccagaaatagagttcaccaccgaaagagtgaaataaaaataatgatcaaatacagcaaggaatcagagtgtttaacttagcttcctgctccttagtgaggtaaattggagaaaacctatctttccaatggttgttgaacctttcacaaacaccataaatctctctctgtgccccacgccccacagatccaggtttttatgtttggtgtagcaggcacatttttcttgattcagatccaggcggactgctttggtggggtagttgtactctgctgacatttaaggcaggaattccctgggaaaataatcaagagattattttggagctgctggaaaagctccaaagggtttagggttcccctcactaggcaaataaggagagagaacgagagggagggaaagagaaaacagaaggactttattgagtgactgtatttcatctgaagctggtacaaaaaaccagaaatgtggttggatgactggatacttttcttacaccttatctcttacccagctaatatgacagctcagagtctggttgggcatttaaaaaaacagctcagacgtccatagtagacaatcagttctccgggaagcaaaggacttcgggatttaatgggttggacaaaatgtttgaaatggttaacagtctaagtgtagcctgtactagtaattgttttagaatttaaattaaatttgaatatattaaaagctaagccaacattttggtgaccactctcactcagcaacctctgtcatctacacagtgatcattacagaagggctcagagtacccatatttttagcagactgacaaagatgtttccagcttcaaggacagaaaaggtgtttaaaattctgtacacatggggtatgactggcagagtaggccaaaaaactaggtggttaaaaaaaatgctttcagaataatgctagaaacagaacactttttaaagaagcagaagtggccataatctgtgaccacaaaaagaaatgactgatctcaacagtcaagttatttaggaatggccttcgatgacctttctaataattcagatgctttctttttttccttcctaagtgatcatacatccttctctttaacctctgtgctttttttttttttttttcacattcatacaatcaggaaagcacatctgaaattcacagggacttagaagtgtcaagtcttggcattactggttttacctttcctgggtgttcttatctcttgcctcactttggcctgtatttttgctgcagggagtatgctgcgaccacaccttgtcaggccccaccttggagccaacttaggtgattcttttatcctcaatccctttcccttctctcactgccacaggattttctgattcttcttcaaacactcctcagtatttatctccttcatgaaatctgctcttcgcaaacttgcttggttctagtcacttaaaaaacccataacaaccggaagcctatgtgatactctacagttataactaggtaatatattgactcattcactggtgttttgatgctaccttatctctcttttaaaatataagctgtagttatgggaatatatgtcctgtgaaatttcttactgtgttggtgttgatgatgatgatgataaagtgatggtaatgattttgttgataataccattgtgtagtggaaggagaagggtaagatttggcagtcttggctcgatcatttaccttctgttggctgtagacccttgacctctttgagctctgttttcatcatctgaaatggaatagatgattatctgttctgtgtttttgcaaatttatgggaaatctatgatgccctctgtgatggtttggcctgtttgacccttctaaatctcatgttgaaatttgatccccagtgttggagatggggcctggtgggaggtgtttgtgtcattggggtggatccctaatgaatggcttggtgccattcttgcaggagtaactgaattctcacttagttcccatgagaactggttgttgaaaaaaacctggcatctcttcctccctctcttgcttcctcctctcacatgccagctctgcttccccctccgccatgagtggaatcttcctgaagccctcaccagaagcagatgctggtgccatactccttatacagcctgcagagctgtgagccaaatagacctcttttctttttgaattgcccagactcagttacttctttataataatacaaaaattgaccaaggtgtccttctcacctcattctggtttgagtccaacttttatatgcttccataatagtttgggctcccgaattccattgtagagttgtgtctagcatgctggaatcacttgtttacttttatctccatcactggcctgtgatggcaacgggagtagggaacactctcttagtcatcttactaattagtcacattgtaaagattaaaaagaattgtggagtaaacaagtgaatatggctcaaataaggcagtatcagcaggaatgctttgcaaacagtgttaataaatgtgagtaaggatgatgctgaggctcatgattttaaaaaaggcattcaagccgggtgtggcagctcatacttcgaatgccagtgctttgggaggttgaggcaggagtatcacttcaggccaagagttcaagacagcctgggcaacatagagagacccgtctttacagacaattttttaaaaattaggcatgatagtatgcacctgtggtcccagccactggggggctgaggtgggaggatcgcttgagcccaagagtttggagctgcagtgagctatgattgcaccactgcattccaatctgggtgacagagtgagacactgctgctaaaaaataaataagtaaataaaaaaggcatttgcttatgagttaagaaacttatccatgtcaaaccttgaaaaaaatcatgcattcttaatcttattatccaaattacagaatgaaataataaatcttttctagcataggtaaggatccatgttaatggatgcatattgcttttaaaataagaagttaggtaactgtagagtataaacattaacgataaaatttcataaacttcaaatgtatatagataattccatggctacattttagagtttaaggcagaagtaatacattttgaaactttactttgttttatggattaataaaaaatatcttgcaaattttattaaaaaataagaagctgattagtatatcatctcctcattggcttattaactctttgtggttgataataaatgacattactgagtactgctgcgaataacaccgtggagaatcagtaacttggtgaaattatggtttctaaagtaaaggtgctcctcagtgtcaccctgcaatcctatatgggttcagagtcatctgtctttctcattctccagtcagaaccctagctgagacagaaaatgactctggcttccctaagcaaaggaaagtttattgaaagtatattgaggctcaaagaattgtggggaggatggagaaccagtttgcaagtggcaacaccccaggtagctctggaagctggaggcaggacctgcacatcagctgctgggatggatggccttccagccttcctccttttctggcattgctgccttcagaagcaaaattgcagaagtgagcatttgatactgggtcagggagagagatgacttccatagagggagagagtcatcaggcattatcctcctcccaaggccacactcagtgggtgaggggtaataatgatggcagctcttttgtacgatctcatttaatccttaacacaaccctttgaaggagacactattgctgtccctgtttacagataaggagactgaggcagagagagatgacagactctgcttgaaggtcacactgccagtgtacagtgaagctggattcgaactgtggcaatcagactccagagttctagttttttatcactttagcatgctgcctcttcaagaggactctgggaggcaactcagcaggaggcttgatacaggcagctgaaaaatagcaaatgcccctttgcaccattcttccacctgtctccctttaccccagttctgcatagaacacatgcctcattcttcactgggaaagtagaggccttccacccaagcactctgtccactgctctctttcacctacacacatggcctctaacatttctgtagccaaaagaaaattttgtattttttctcttcaaatcaaatgccatctccgttcatccagctaccccacgtcagaaagtggagagtcattcctgacttcttctctcaacccacactcccaatcaatcacaggattctgtcactctcacctcgtaaatatctcttgcattcttctcctctttttaccccattgtcaccttcttaggtcaaaccttaatgatttacatttggattattagcctcctagagagtctccctcccatagccctgtacccctctaacccatcattgcctcaggaataaacctcatttatttatttatttattttaatatttttattttgacacagagtctcactctgtcacccaggctggagtgcagtggcgcgacctcggctcaatgcaacctccacttcctggtttcaagcgactctcctgcctcagcctcctgagtagctgggattacaggcatgcaccacaatgcccagctattttttgtgtgtgtgtgtgtatttttagtagagatagagtttcgccatgttggccaggctgatcttaaactcctggcctcaagcgatccgcctgccccagcctcccaaactgctggagagtaagctttctaacacacaacctgaaactgattttgcaaccctctggcttaaaatccttcaaaggtgctgcttgtgttccaggtagatctcaaactgctgacccttgccatttaatcattggctgcaggttctccccacacttggctcccaccatcctgacacccacttttctttctagttacacaggactgtgttggtcagctcaggctgccgtaacaatgtaccatagactggggggcttgaacaacagacatttattttctcacaggagactggatatcaagggtaatttggtgactttggtttttcctggggcctcccttgcttgcaggggatgccttcttgccatgccctcacatgtccttttctctgtgtgtgcacatccctggtatctctctgtatgtcctgatgagttctttttgacatctgaacttggaggaggacataatgcagtgcatagcagggacctgtccaacagaagtcctagggcttcttacacattctttcttcccttccctgactaggtaacttatatctcatcctttaaaattcaatttaagtttcactttttctgtaaaacctttcctgttcctctaattttatttagatgtcatttctctttatttctcccacaacacccttccaaaatagcttcatacctccctatttccaagcatataaatatcagatccccttcatgttgctccccaaaagacatgagttgccccagtaagcaggtataagaatcaaaggcctttttcaccagtaatggatgactcactaggaattgtacacagggctgctttagttataattaagggttgtgttataattacactgctccataatttatggttgtactttggtcttccttgaaaatagagtaagtttgtagaaaaattggctaatttcagaatcatttgataaaatcttttaccaaacacagaatcctatactgtttaactggttagagtaaaaaaataaatttttatttcaaatgggagagacttcttgagaaacaatttaataaaccagtaaagtactgacataatgaactatgatttgtattgatatctgagagtgattggtacaatagaacattgtaacaaagtctgaatggtttcatagacatactcagtatatacttaatatttttgttgtaatcatttttttttgtgcacagtctttgtaactgaccaaaggggcatatgaaaatcacctgataagctttcaagagcaatgtgattcttatttctttttattgctaataattccattttaaagatgaagaattgttgtgtggaataaatgaaagaactctatagtgccttcgtagtttcaacactttaccctttgaaagcatattacactggagatctcacagaataagtataaaacctcatattacccttttcatactgcacaacattttgagtagagaaagtgctgccccaagtgccttgtggctcgtgagatgttagggaggccaaaagaaattgctagaaccagaactcatgagtgcctcaaggcctcagcctcagttgagatcattaggtttaactacagctgaatatgggaatatagttcctcagacactcctaagtattatgtcatcccagaaacctttaattttggtgaaagaagaacaagtgcttccatagttgataagattaaagttctaatggttagttgtctgtcaaaattacatagtagtagaacacatgaactattccccgagttagggttctgaagatttagctctaaccattgtaatttgttcactccaacaaggaagctgaactttgatcttcttggttgcatcacatcctcactacataatacatggagtcaacagtccatattgtatcttttaaaagagaaagtgaaaacagatccatttaaccattttcccagtaaaattgtttgctctctgaagctaaagatggcaaggtggtcactttcagtgagcacctcaatcttgaaatcttgatcgaggtgtgtgtactgtgtacaattcctagtgtgttgtccatctagtagagttagatttcaaaatcaacagcagaagtagaactgaataactgaacatttataaaattagaagataaagagtggactaagcaactaagaaagtattttaggacactttaaaacacctagaaataaattagtttaaacattcagtttgttacctatggcaaaacactaaaattcttgaaatgttgggagtggacaggcaggtgtttgagatatcattctttctatttctgtatggttgaaatattaaataaataagaaattaaatacatatcgtaaatgctggttgatattattatgctcagtgttcctgcccagctgcttccgcagggtaatgctctctgaagatttatccatgattcaggaatactccccccaacctgggggctctgatgctgctccgtcttccctttgcttggctctgataggtaccctagagccactcccctggctgctcaaactcctggtatcccctgcactttcttcttatgtttagccagtgatttcaactcctacatcacaatgaaaagaaaccttcaaagggaaatccttcaaattcctgccaccaaatctaaaaatgtctccacatctgtgtcatcccctccttctgtttcttactggagaaatatccctcccttatctcagatgaatttctccacttctgttatgggttccgccctctcctacctcctctagtaccattctctaatccagcagtcctcaaattgaactatatatgttgacatcatactaggaactgaagcagaaaaattttaaaaatatgttataattttcttaaaatatcaagaataaacccaatatatgttaactaaattgaatttttatttatttatttgtttatgtttttgagacagggtcttgctccatccaggctggagtaccggggtgctgtcacagctcactgtagtctcgaacgcctggactcgagtgatcctcctacctcagccttctaagtagctgggactacaggcatgcaccaccatgctaagctaatttgcaaacactttttgttgagacggggggtcttgctatgttgccaggctggtgttgaatttctggtgttgttcaggctggtttcaagtgatgttcttgccccagcctcccaaagtgctgggactataggtgtgagtcaccttattttataagtcacatttatttcataaataaaaataaatttaattttcaaaacaaaaacaattagtgaaaagagagcattgttttatattttttcaaatccctttaagtctgatttagtagaaatcacctggatttctgtatacaatctattgtgaaatagttatttagttgaagtatgagaagagagtcctaccccatacacatatgtagttggaaaagggaggacttttttttaacaatctgttcagataattgtggatatttttctttaatactataccaaaacttaacaagtggtactttcttaaatctagttgcaatgtggaatctgaaagtatattaatgattttttaatatcttgttactttaaaatccattaatctatttacactttgaactaattttttactaaggcatgatttttaacattattcatggtgttttgaaaaatattggttcactgaggtgtgcagaccatccaaatgttggcatattttattttataacataaaaataccacattcattaatatgaccaatgacatcagagcatttaagcattgagagctgtcaaactcatgaggctgatacaaattttccaaaattataatttttgcttaaaagctcaaatattaatattggaaacaaattccatcagtttttcttgaggtgacaggctcattttgcttactttaagaaaatatcttccaaacattcaatttgaatagccatggtttgttagccattctttgaagtaaaaatagtatttcatgaaaaaaggggttagttcagctcacaactatatagacccaaaaaaaaagccatcacacttggtctacaggagaagtgctttatatgcactttccattttgccacattgaatgctaaaaagatatggactgtgaatcaagatataataagattaaaatttgtgtgtgtcaccaagaactttcttaagtgaaactggtgttgatcttactgtgtgtggtggtgaagaggataatgaccgccatgatggtgtgatggctctaccttgattcatgccatggggccagcagttttatccattgctatggtttgaatgtgtccccccaaattcatgtgctggaaacttaatccccagtgcaacagtgtggagaagtggagcctttaaggggtgattaggtcataagggcagaaaatgaattaatgccaatatcgagggagtgggtgagttattgtgggagtggattcctgataaaaggatgagtttgactccgttcctcttgctctgtcttgtgtttttttactcttcagtcttcctccatgggatgatataacaaaagggcccttggcagatgcaagccccttgatcttggacttcccagactccagaactgcaagaaaaaaaatctctcttctttataaattacccagtctcagatgttctattatagcagcacaaaatggactaatacacccaccattgcttttgcactgataatacaaaagtcacatggtgaaaaaggcaaatgctatcttattattattattatgaatacagttttgatctctcagcctccctgaaaaggtttttgggacccctagaggtatgtaggccaccctttgagacccactgatctaattgattgtctcctttttttgtatcttaattctctaattcatattgtgtctgtatcttttaagcatgctgatatgtctcccaacttagaaaaaaactttaaaggtaactccaagttactcaccaaagaccattaaatctattttccctttacagccaaatgtctttaaagaatcatctccacttattgtctctgcttttcccgtcttccatgctttcacacccattccaatctcatttattcccttatctgtttctgtaaactgctctttttaggttccaagggcctttcctgtcatgtgactccaggagacatgctccagtccttaccttccttgacccttctgcagcatctgacccctctgaccactttgttcatcacaatctgtgccatgaattctgctaagtgctttaaatgaaatagctcatttaatcctcacggtaacctggtgatatagctaggattgttattccatcttataatttagaaaactgagaaaactgcccgaggtcatacaggtcacaagtagaagtatagagtctcaaggtcagctctccatgaccccagatccagaggccttaaccacaatatacccctttttggaaacactcacttccctttcccacagtaccactctccaggtttattttccttcctctctaggtctttgtatgtgaaaaaaaatacacttgttccacgttcttgctttgcttatagcaaaagtcctgggaaaggttacttaactggccatggctaagtaatgggcacacccagcccctgcctttgccatactgaggaatgggttgtttgtatcctttagctctggaaggtacccctaagcctgtacccaagggacttgctcaagccaaagaataattggatgttacttcattcagaattgataaatggtcactaggatttattcttctctttcttcttttttttttcactgactcctactcatattttaagactcaacttagatactgctctttcccagaagcctttcctgacttccaaatctggattagctgtgccccttggtgccctgagcttcctcccttgtggtattgtcttatggtgcattgaagttgctggcttacatttcttctctgagttctagctttcagatggcgagattgtgtctgagtttcaccttacacccccagaatctggtacagggcctggaatccatgtcccttaatatttgatgaataataaatatactgggtgtgaggaacgaatgggaccttcctgagatatgtatctggaagtcattaatggggaaaagtgctctcaagagtggtctaaagattttagaattattttcacagaaatagtgtttgaagtcattggaacgaattagacactatgggagaaagaagaaaaaaatgtctccgggaatgggaaaataagagcctatgaaggaccctgaaaaacacatgggttagagttgaaattcatgtggctgcaatgctatggaaacaaaaagagggaagttcataaaatagggataccctggggtccaacagttgcaaacacattaaagggaataaaaattttttaaatgccatgtgattttgaaataattctgtggttttaaaaagaactgttgcagttgaataaagataaaaatcacggagtgaggagaaagtgcatagtgaagaaatcgaggttgaaggtgaagcataatatatacagctcagtggttctcaaccaggtatgcacatcagttcacctgcacagatgtacaaatcactaaccctggcaccatttgcagttttctcattcagtagatctggaatggggcctgggattctgtaattttgaaaagcgttatagataactgaacctctggttgaaaatctttagtgtatgtccatcactttattagtttggctggtgcaccaatgaaggaagtaaggttaggggaagtgttatgggctgaattgcattccccccaaatttatatgttgaagccttaacccccaatatgactgtatttaccttaaataaataatgaggattaaatgacatcatacaggtggggccctaatccaaaagggctggtgtccttattagaagaggaagagacactggagtatgtgcgctctctctctctctctctccacactgagaaagcagccatccacaagctaggaggagaggtctcaccagaaataaatcctgctggtaccttagtcctgaacttccagcctccagagctgtgagaaataaatagctgttgtttaaaccaccctgttttagtgagcttcactaaaaataagggagaggcctttatttctaggatactggaatctagtatcctagttatttctaggatactagaatcaagttagagggagagaatgagccaatagcagtggataggaaaaaaacaaaatgattgaatagaaaggtacagctgagaaagccagaatctagaaaatgtgagaactgggattacagagaagtcagccttggagaaccacattatagcatttctgtatatttttcatttgatcctactaatggctttgagatacgcagatgaggaagattgatttcataggggccagatttgtacagttgtgaactggaagacctaggacgaggaacgtgtctgaattagcttttcctaatgagctctccttccacagcattttccaaactgctttcatttctgtgccaccttcaccatttctgccatattgaagtcagctccttactattatttttttgtgtgtatgtatatgtacacgtgtgtgtgtgtgtatcaacacacatattcaactctgatttttacttagcatcaacctatgcaacaataccacaggtttgacacgctagttatatttttaaaatgcatattaaattcaatatatatactttcaggaaaatccattccatgtatcacctaagggcatcttgcataccatcagtggcccatatgctgcctccatgatgaggaatgacactgtttttgagaaaggaggaaagaaaacgaggattcaggaggaaatgccttatattaagatggagatgaagatttgtgtgcatctcatttgaaggtggttaaaggtggttagcccctcaggcagtacagatcaaggaatgttggataggacatcacagaaatcattagagaattaattactccagaatagaggttttacatttttcaagtggtgacttgggctctgctgtctgttagtacgtcccctgcagagcagcgaaggatgaaggcagcagtagtcctggccttagacctaggcactcgggacccctgccctgggttcctgtttgaggatgctctgttccttcccaggatacaccaccttccttcttgggcacacccacactctccataactaggactctggaattctctgctcttagagactggacctgtctcttcttttgcttccctctccccacctgaactacattgcctctgtctgcaaccttaggttccagtgacggccaatagacagctggtggccaatagttagcaggtgtgtgtgtgtgtggacctaggactgaggtgtccacacacacatatgctaggctccttgtgctgcagagtaaagccatgggtggaaagaaaagggagggacccagtcatgtaaatattaggaaagaacttgattactgcagactcagagaactgagcaaaagagagagaagcaattctcagggaacaggagagacagttcaaagagaacatgccctgcaagttccatcctctgcacattcttaccactttgtagtaggaattagaattatccacagctgtgcaaatattgtgaggaagactttatttaaaatgggggctggatgtggtgggtaacacctgcaatcccagcactttggaagcccaaggcaggatccctcgagctcaggagtttgatacctcgtctctactgaaaaaaaaaaaaaaattaactgggcgtggtagtgcacgcctgtagtcatagctactctgaggtggaagaatcccttgagcccaggagtttgaggctacaatgagctatgatggtaccactgcactccagcctgggtgacagagcaagatcctgtctcataaaagaaaaataaataaataaataagaaactttaacaagcagaccaagagatagagtgctgtgtgcggttagtaccaaagactagattcatagaatcctcactgtggccattttgatacagactgaattggaacaggacaatgtagaacacagaggaagaacagcaacaggagtggaaacaagacaacaaaaaggccctgcatgagctgtgcacagaaatgttcccttacttgcactgggctaagattttcaccaattcttcaggaaaaaagaaaatggaagttagcattgaaatgacaccaagtattgttggttttggtttcaatcagatacatatgtattgaacaaactctatctttcatatattaaggaaggctctggtgttaataaaatagcatgaaaataaattcctgcaggaatcaggtgggagagagactacaggtggagaagatttaacatagagatttggagtaatttgtttggaaaatgtgctatggaaggcacgtaatataaataataaggttttggtcagctagcagcacatttgaagctagcatggatgtgtagggaggtcatcaagattctatagttttccttagtaaggctctgcagttgggaggaggagcaggatgaacgggtggagggaactgggtcaagcttggcacagtacccacttaaatattgaagtggctgaccttgctgcctgggctaattatcatcatcataatcactaaaaaatttttttgagctcttactatatgccagtttctgttcttaagtctttaaatggatcatctttgggctgggcaggaggcatgtgatcataagagaatcagcaagctgtgtaagatggaaaggcaggcagagtcattccaaagcttagtaaaggttctagaaatttgtattcaactgcttcagtgtatactgaacatggatgaagttcagtatgagaaattcagctttaaagatttgacagttccaaaattaatattgttataatgtccatactacccaaaatgatctattgatttaatgaaatccctatcaaaatttcaatgacatttttcctagaaataaaaaaaaattctaaaattttcacggaactacagaaaactctgaatagccaaagtaatcttatgcaaaaaagaacaaagctggaggcatctcattacctgacttcataatatactacaaagctatagtaatcaaagcagcatagtactggcgtaaaaattgatgtacagactaatggaacagacaggagggcacagaaataaatctgcacattacaatccattgttttttgacaaagaagccaagatgtatacactgaagcagttgaatacaaatttctagaacctttaccaagctttggaatcactttgcctgccttcccatatcttggggggtgtccaccccactgcgatgtcgatcgtaatacccagccaggggaggggggtgatattactccccatatggcggggggtgtccaccaccctgctatgtggatcataatacccagtggggtggaggggggtgatattactccccatatggcggagggtgtccagcctcctgcgatgtggattgtaataaccaggaggagagacgggggcgatattgctccccatatcgcagggggtgtccacccttctgcgatgtggaccgtaatacccagtgggagagacggggtgatattacttcacatatgtcggggggtgtccaccccactgcgatatagaccctaatacccagagagggagaaggggtaatattactccccatgtcatggggggtgttcaccctccttctatatggggagtaatatcatctctcccatcctggatattaggaacaatttcacagggtgtgtgtacacagcctgcaatgttgaaagtaatgtcatcctctccccctccggatattaggaacaatatcacaaaaggactgtacactttttgcgatatttcgagtaatatcatcctgtgattccctgaatattgggagacatattttccacaaggtgggtgtacactcattgctatactgggagtaacatcctactgtaccccccggaaattatgagcaatatcacaggggtgcacagccattgccatagcagaagtaatatcatgcgctccctcactagtttttaggaacaatatcacagggggaagtacaccttctggggtattgggaataatatcatcatctcttcttgtagatattaggtacaatatcacgggggggggtgtacaccccttgctctattagaagtaatatcgttctcgcctcttctagattttaccaataatatcacaagcggggtgtacatcccttgttatattgggagtaatagcatcttctttcaacctggatattgagaacaatattacatgggggtgtacatcccttcaatattcggagtaacagtatcttctccactcctggatataagaaacaatatcacaggcagggtgtacaccccttgttgtattgggagtaatagcatcttctttcaacctggatattgaaaactgtatcacatggtgagtgtccatgccttcaatattggtagtaatactaatttcttccctcctggatataagaaacaatatcacgggtgtggtgtacaccccttgcaatattgggagtaacgtcacctctccctatgtggttattacggagaaaatcacagggtggctgtacacttcctacgttattgggagtaatatcatccacaacccccctggatggcaggaaccgtatcacagaaggggtgtacagcccctgcgatattgggagtaatattattctcttgtccctgtacgttaggaactatatcacaggggggctgtacaccttctgtgatattagaattaatgttatcatcttctccactgaatattaggaacaatatcacagaagggtgtacaccccctgcgatcaggccagtaatatcatcggctccttccctggatattaggaacaatttcacaaggtgtgtacaccccctgcgctattgggagtaacattattctctcttcccctcgatattagaaagaatatcacaggtggagggtacaccccaccccctgcgatattgggagtaatatcatcctcttttaacctggatattaggagcggtgtcacagggggcgtgtacacttccttcgatactgggagtaatatcctctctccccgtaaatagtaggaaaaatatcaaaggtgtgtacagcacttgcgatattgagagtaacataatcctcccctcacctggatatcagaaataatatcacggtgggggggtgtacacaacctgcgatattgggagtaacattattttctgcccccatggatgttgagaacagtatcacaagggcggtgtacaccgtctgcgataatgggtgtaatagcgtcctcactccccctagatattaggaacaataccacaggcagattacacacccgctgcaacgttgggagtaatatcatcctttcccccctggatactaggaacaatatctcatgggaggtgtacagcccattccattttgggagtaatattaatttcttcattgctggaaataagaaacaatataacaggggtggtgtacacaccctgtgatattgccagtaatagagacttcgccccccccaccggatattaggaacaacatcaaaaaggggtgtatacagcgatattgggattaatatcacgctctcccccttgaatttaggaacaatatcaaagaaagggtgtccaccccttgcgatattgacagtaattacatcctctccctccgtggattttaagaacaataccacatagttggtgtacacgcactgcgatactggaagtaatgtcatcctcttccccctggatattaaaaacagtatcacagaggtggtctacaccccccgcgatgtggccagcaatatcatcctttcccccactggatattgggaacaacatcacaggggtgtgtacacctcctgcgctattgggagtagtatcattctctcttcttctggatattaggaataatatcataggtggggtgtacaacccctgcgatactggcagtaatattatcctcacgcaacctggatattcaaaaccgaataacaggggggtgtacaccccctgcgatattggtagtaacatcattctctcccccacttgatattacaaaacaatatcccaagaaagggtgtacaccctctgagatattgagagcattatcatcctctccccaactaaatatgaggaacaatgttggtgggggggatgtacaccccttgcgatattgggagtaatatcctctccctccctggatattagaaacaatatcaaaggggtcgtgtacaccccctgtgatattgggagtaatatcattctaatctccccgggatatttggaacaatattatggagggggtgtacaacctctgccatattgtgagtcatatcatttctcttcccctggatattaggaacaatatctagagtaataatatcccttcccttctggacattaagaacaatatcactgggtgggtgtacagcccctgcaatattgggagtaatatcatcctctccctctctcgatattaggaacaatatcccaaggtgggtgtacatcccctgcgatattgggcgtaatatcatcgtctgccaacatggatattgggaacaatttcacggggtggggagggggtgtacaccttcttccatgttgggagtaatatcatcctctccccccgaattgtaggaaaaacttcgaaagggttttaccacttgtgcaatattggcagtaatatcatcctctccccacctagatattaggaactatatcacaggatgctgtacacttcttgcgatattgggaggaatatcatcctctcccatcatggatattaagaacaatatcacagggaaggtggacaacccctgcgatattgagggtaatattatgctctccccttctggacatcaggaataatatcacaggaggtgtgtacaacccctgcgatattaggagtaatgccatcttttccccccgaatataagaaacaatatcacaggaagatgtacaccccctgagatattgggagtaatatcattctctcctactctggatattcagaacaatataacgggggtggagtggcgtgtatacccctgcggtattgggagtaatatcttcctctccaccgctggctattaggaacaatgtcacagaaggggtgtacaccccctggtgtattgggagtaatatcatcctctccgtccctggatattaggaacaatatcactaaggagtgtacacctcctgtgatactgagactagtatcatcctcttgccccctggatattaggaacaatatcacaggggtggtgtacacctcctgcgaatttggggcaaatgtcatcctctccacctttggatattagagacaatatcacaggaggggtctacgccccctgcaatattgggagtgatatcatcctctcccccccggatatcaggaacaatatcacagaagggatgtgcacccactgtgatattttgagtaatgtcatcctctacccgctggctattaagaacaatacaggtggtgtaagctttccgcgacattgggagttatagcatcgtctcccccagatatcaggaacaataatattaatattaataattaatatcaattattaatattaataaaatgatgctaattaatatcaatcattactattagtaattaaagtgcttacaatgaaattaatgttaataacatcaataagagccatagtaaataaaacattagcaatttatattgattaataactagtattagtattaataattaataataccattatgttagaaatcagtattagttgctatcaataattaataataataattagtgattactaatgacattatcactattatcatttctaataccgcacggggtctacacccaactgtgattttgttcctaatagtcagggcaggagagcatgatattagtttcaatatcgcagtaggtgtacacccgccctgtgatactgattctaatatccacgggtcagagtatgaaattactccaaatagagcagggggtgtccagccacccggtgatattgctcctaatattcacaaaagaagagaatgatatcactgccaatatcgcagggagtgtacacctcttctgtgatactgttcctagcatccggagggggagaggatgataatacttaaagtatcgcaggatgtgtacacccaccctgtgatattgttcctaatatccaggaagggagaggatgatattactcccctcatagcacagatgtacacccaccctgggatgttgttcctaatgtccatggaggagagaggctgatattactcccaatatcgcagggggtgtacatccaccctgtgatactgctcttaatattcaaaggccgggaggttgatattattcccaacatcgcagaaagtgtacacccccgtgtgatattgttcctaatatccagaaggggagaagatgatattactccccatatcgcaggaggtgtacagccactctgtgattttttttaataagcgggggggtggggggagaagataatattattctcaatttctcagggaatgtacaaccccctgtgagattgtccttaatattcaaagacagaggggatgatattactcccaatatcgcagaaagtgtacaccccctagtgatattgttcccatgatccacgatagaagaggatgatattactttcaatatcacagaatgtgtacacgcacccagtgatattgttcctaatttcaaggtgggagaggatgatatgacacctaatatcgcagagagtaaaaacactcctgtgatattgttcttaatatcaagggtggggagaggacgatattactgccaatactgcagagggtgtacacttgtctggaaatagttcataatttcaagaagggaagatggtattactcacaatatcataaacaagctgtcggtccaccgtggatcgtaatatccaagggaagagaggggggtgatattactccccatatcgtggggggtgcccacccccctgcgatgtggattgcaatatccagggggcaagatggggatgatattactccccatatcgcggggaatgtccaccccactgcgatgtggatcataatatccacgatatgggggtgatattactccacatattgcaggggggtgcccacccccctgcaatatggattgtaatatccaggggaggagaggggggtgataatactccccatattctcttatgatctcatgcctcctgcccagcccagagatgagactttccttacctaatgagaaaaggacagtctcttcaacaaacagtgctggaaaaactggatatccacatgtggaagaataaaaatggaccctcatctcacaacatacacaaaaatcaactcaaaatggattaaagacttaaatgtatgacccgaaaatgtaaaactatggaagaaaatataagggaaaaccctatgatgttgatctggacagtgatttttttggatatgacccgaaaggcacagacaacaaaagcaaaaataaagaaatgggattatgtcaaactaaaaagcttctgcccaagcaaggaaataatcaatagaatgaagagacaacctatggaatgagagaaaatatttgcaaaccatacatctgataagtggtcaatatccaaaatatataaggaaatcaaatgactcaataacaggaaatcaaataacctgatttacaaatgggcaaaggatctgagtagatatttctccaaagaagacatggaaatggccaattgctaagaaagtagattttaagtgttctttttacaaaaaaagataagtatttgagatagggctttgttaaatagctgaattttgccaatctacaatacataaatatatcaaaacatcatgttgtatgctataaatatatacaatttttatttgtcatttaaggtaaacaaatttttaaaaatgaaacaaacaaaaagatttgacaattccagaatgaatgactgagataaaatgtagtgatctgatcatcttgaaaggtcattacaattgattgaattattttggctgttgtggaatattttccacgtggccttgtttggaagcagggttataaataaggtcatcccttcctgattttagggatgtgaaatcaaacttagtattttaaaattttgttttgagttgggcttccactggtagaaaaataaatgagaacttaattccattatttagaattgaaaaaatagatttttaaacaaaatgatttgtctacctgtgctgtggtggaaaagtatgggtgtctgtgacagggtttcctttatcaagtgaaaaaacttcaacccagactgggctaatttttcatttggtaatatggccatatctgggaagcaatcatttccagatcttaactggcatttcaattactaacttttacatttcacatgtttaatggaacctggaaaaggagacacagattttagtcttcttggctagtttgtgggtatagaacaatcttaactcggacatcgtggaagtcagtgagctgtgtagacaggaccttctggggagctgattgttcatgcactgcaaaactctctttcaattattgaaatcaacttttttccaatgcctcaaagcaaggacgattctgaggcctttgaaagcaatttttcattttgtttctttgcatactgacacatctcgatgtttactacgtaacagaagagctaatttaaagcagtgtgttgctaagcctagctctctccctatgtctccctgcctctgccaccctggatcctgtggtcctcagtacttttctgtgccatacattagaatcccagaatggcattctaaataggagacaggcggcagagtagtaaaaattgagtgaatttatgattcaactgagaagattctctttccagtattcttttccccagtaaagtgattgtactgattcctttgtaaatttggtcacttggaaagttctaaggattgagcaaattgcttttaaagaatctccattttctgcatatgtatgtcacctactcaaaatcttattttccagtttaaattattttctaactaatatgttatacttccctcagcaatccctcaactgtaagaaaaatgcatttttttcttctagtgataaatagtaagttcattgcatttcttagaatataaacattcataattgataacgtccacacatctccccagtcctcatgtttgtattattagcttaatatggaaagactgtgtgtgtgtgtgtatgtgtgtgtgtgcatttgtgtccataataaaagagaaatcttatgtgtccataataaaagagaaatctattttgctaatgagagtttccaatcaacaaattttgccttgtgaattacagttttaaagtactttcaattgttaaatttattgctatttaaaatcctatttaggaaccttgctattaatactagaactttagttacagcctcaagtttgagcccctcccaaaaaatctcatctcctggagcctgcaaaagtgtataaaatatgttcagaaaaatacatcttggacagccatggagtggaatggagagctggtgggatatatggctgagaggagaggtccaagacagtgcctttcctggtcacaaggtcaaggtcaatatggctcacatgggtgatgccattttcttcttgttctcataacatccagaagatgtgctggctgatcagcagttttgcagaactgctactttggttctcagggagtgctctagaatatatttacataacttgagaaaaatgtcttgagcatatactgcatggccagtactgtgcctgagccctcttagtgtctagatgtgaattgtagttatagtctcatggctaaaagttgttttgtatttcagtctcttctgccacctggtttttaaaatgttttcctttttgagaaaatcacaattacctgtatatgtaaattttattgttaaagatgagtactgatattttgactttattttgggtcataggcttgcaaagctttacttaagacttcagtaagtaaaggcccatgactgatttgtagaatcactgaaataatagtaagactctacttctcagaagatgaaacagagtcttagagaagtttattactaaattagacagtttttttttgttttgtttttttttttgagatggtgtctcaccctgttgcccaggctggaatacagtggcacgatcctggctcactgcaatctccatctcccgggttcaagcgattctcctgcctcagcctctcaagtagctgggattacaggtatgtgccaccacgccgactaattttcatatttttagtagagatgggggtttcaccatgttggccaggctggtctcgaactcctgacctcaggtgctctgcccgccttgtcctcccaaagttctaggattacaggcatgagccattgtgcccagctgacagttgtgtttttaacttgaattttatacttaatttttgataagaatttttatttggggtgtattatgatatttgaatatatgatattttgtgggtatggagattgcagatgatttaccagatttgcagagcaagtaatagaggacagtttattccttcttagttttcacttgctcttcttccacatgtgttagccactgttagctccactccagatgagatagagcttcttttctgtctgagcatgaatttgctgggagccatgagataagttttttcttaggtcacatagttattaaataaatattcactgagtttaatttatgaacaacgaaagtaaaaccagacacgattcctccccaaaagatgagctcatgtgaaacagtggggaatgcatcatctttcaggttaccagtgtatggtggcactacagtatcaaggttatgtattatagacaataagtaaggaagacatatctgagctgattctaagatcagaatctggtgatgtgttaattgaacacttggcaattgctttcttagtttacccattcagattacttatcctattgaggaaatgaagatagaaaagattggtggctttattatatgttacactgatgctttgggttagagagcatgggttgcataaaatattttaaaatgcggatggataatttttagaccagttaggatggctacattagagaatccaagacaatgtctgccattatctttacaatacacactgatttttgtgtgtaccttgtcattatgtaagcttcctacagggctgtggtaagtcatggacagggttaaggagaagggtacatgtcgagaaactaaatcacatttggagaggagatgtaacaaaggtagggttcagaggtttactggtaacaattccaaatttggaatgaaaaagttactctttgtttagcgttcgagttgggagtttgccctgcaagagacagtcaaccactgacttcagtcgaacgtacttggaaagggaagaacttaaaccagccatgaacagaagaaagccaggttttctggaaacatcgccaaaacccagcaatttctcagaattttcagaggcgccaggggggtgtttgcatttcaatggaaaaagttctgaaagctctggaaactattctcagttttactttctcattgaaaggcaaaaaccatggctgtaagtaagagacagaagcatttgctatggctttgttaagaattaagaaaagggacctctggaaaatttgaattgtccaatcctttgccacagagccaagacaaagtggtccaagtcataatggcaaatagaaaataaaagtactgttagctttaagacaaaagtactcaatgtctggagccactttccaccagcctgggttttaaaagaaagacagaactttctagatttaaagagacatagttgcagctgtattgcaataacataatggtagctctcataagtacatacttgtcataagtatttaatcttttcacacactacaaataccttgttaggttgctaaggggttacagtacttatgagaaacgatctttgagaagaagaagaatactatttccagttaagatttagaagaattttaagtagatctatagtaacagtcaaaagtagaaaatatgcagtatagcaaacaaaattatttttggtctaattctaccacataaaacttgaaggcaacattgtccaacagaaatacactgtgaatcacatatgtaattaaaattttctacttgctacatttaagaagttaagacaaacaggtaaaattaattttaatgctgtattttgtttaatcaatgtctcaaatattatcattttaatatataatcaatataaaaaattagaagtgaaatactttacttttaatcttactgtatgaaatttataatttatgtttacaacatctctccatttggatgctaagttttcattggaaatacttgatttgtattcagatgtcataaaatttatggttgaaaaagtagatatataaacatacttaaaaattttctaataattgaaatgagtagcaatttttagttttaaactcattaaaattaataaaattaaacattcaatttctcagttgcactagccccgtttcaggtactcaactcagcagccacacgtggctaagtggaactgtattaaacagtgcagctcaaaaaggttgctaaattcatcttttattattctgtaattttgctctttcaaatattagctaaccagataagcttgtgaaagtgactaatgccccctttattatgcgaagatattttggggggaatacaaattgttctgtgagcttcgacctaccctttgctatagaggtcatttctccatttactgttaagtgtgcatatcttgctggaactcttcaaaaaccctgagcgagctttccatatgggaagcagtgagtcacttggtggggggatttcgggagaggaagatgaggaggtgaagtagagtcagcaggaagaggagcatttttcaaccagggtcagaaatgtgaacagtaattttcaggaaataaccacatattttcttattattaaaataattattactacaaaaaaattaataacattcagataagcctgaaaatatagaaaccatgcataattccattacccagagataaccactggtaacactgaacacatgtctttttagtcttataaatttattcacattaatgactactttctatagtggtttctattgcttcacagattcctgggagtctctgagacattttcagggggtccatgagatcaaaactattttcaaaaaaggactgagaagttatttcccctttttactgtgtggcacttgcgctgatgatgcgaaagtggtgtagacaaaactgctggctccttagcactaatcaaggtggtaacactgaattctactagaagtcattgcattcttaaacaccacacgcttagagtaaacacacacacatacacacagacaccctaaaccccaaaagacaaaaaaagtcaagacacgaataacctcctagtttcacttaagaacatccttggtaaagcaatacaattattaattatattaaatcttaacttttttttttttttttttttttttttgagacggagtctcgttctgtcgcccaggctggagtgcagtggcttgatctcggctcactgcaagctccgcctcccgggttcacgccattctcctgcctcagcctcccgagtagctgggactacaggcgcccaccaccacgcccggcttatttttgtatttttagtagagacggggtttcaccgtggtctcgatctcctgacctcgtgatccacccgcctcggcctcccaaagtgaaatattaacttttgattactcatctttttttatagtctgtgtggcaagtgaagtacaaatgaagtactcccgattcatattgaagcatgatggttgttttaggaaagacacctatgccattatttgagttgtgagctgaactagcagctttttttcccccaaggaatatcattcttacttaaaagaacaatactaataaacaaacatactgattattcagacttgcatatttggtggacattttatcaatgatgtgaccctgtcatttccaggataacaactgaaagtatttgttgctaatagtaaaatttgagctttcaaccaaaatttagaagtgtgaaaaactccatgaacttgatggcttcccaataattaaagacttttttttaaaaatgagatttatgatgatggtaaccgatgtgactttttgatgttatataaaatctgccaacatttggaaaatctacataactcagaaaaactaatattctcccaaacgataaatgcactgtgttcaaaatcacgcacgaataaaagatcctttcagagtgtgagatagatggacttcaatgtaatagtataaacattcagttatatggtttcaaattgcatattgtaactagcatttaagaaacattgctttttgagttttggtgtagcatcaaagaaaaatattcacaattagctgaaaaggctattaaaatacttctttttccagctccaagctgtgtgagagtagatttgttcccccatactttaatcaaaacaacatatcacaatggattctataaacagatatgatgagaatccagttgtcttccattgatatgatgagaatacagttgtcttccattaagtcaaacattagatttgcaaaaatataaacaataactcttttcttactcatttttttgtgggttaaaatattatatcacaaaatatgtaatttatgttaatttagttgatttattattattttaggtatgttgataaatattttaaatttttttcagttttaatttctaatgtggtaagttttaatagatataatacacataagcaaatatctctcagtagttaaaatactagaaattattgaggccctcaacaattttcaagagttgtgaagaggttctgagattaaaaaaaaaaaagttagagaaccactgctacaataggtccaatcttaggtgcctacccccatccccaactcaggctaactacagacatgacaaataaacagaaacgcaagaatcctactgtgtttcaaaaacattctctcagtacatacacatattttaaaacgtacttacaacatttaaaattgaaatcctactgtacatactcacttgtaatctgacttgtcccattcatcataaacactttttttttcctcaattttaagttcaggggtacgtgtgcaggatgtgcaggtttgttacataggtaaatgtgtactatggtggtttgctgcacaggccatcccatcgcctgggtattaagcccagcatccattagctattcttcctgatgctcgccctctccccacccgaaccctctgacaggccccattgtgtgttgttccctgccacgtgtccatgtgttctcatcactcagctcccacttataagtgagaatatgtggtatttgattttctgttcctgcattcgtttgctgaggataatggcttccagctccattcacatcccttcaaaggacataatctcattcctttttatggctatgtagtttttcatggtgtatatatgccatattttctttatccagtctatcatgggtgggcatttaggttgattccatgtctttgcaattgtgctgcaatgaacatacacgtgtatgtatctttataatagaatgatttatattcttttgggtatatgcccagtaatgggattgctgggtcaaatggtatttctgcctctaggtctttgaggaattgccacattgcattgtcttccataatggttaaactaatttacactcccaccagcagtgtaaaagagatgaacactttccaatgtcatgaaatattcctctcaagttggatttgtggaggttgtattgtattctactggtcagatgccactcagttcatttattgtgtctccttccatcagcaaggtttaggcaggaaaatgatgtttatgttttaagaaagtactctaataacaaaagagagagaatcaggggaagctgttagaaatctcttgaggaggaccaattaggtagacacagtgatggcctgagaaaaagcagtgaccttgggattgtgggggtgagagtacattaaggtgggcaagtgagtgggaagagagagatgtgtgctctattatgcatttttctagcatagagatcaaaggcctttggtaaatccaagtggcaatgttcagtgcattttccattctttcaaagcagtgcatgtttcactctttttaattttgaaatactcagtattttaataactgtgtaccatataatgtagagtttacatgtaaatgtcttcatttgcatttacacatggcttctttccacaaagttgtcatttctttagttttctgcagcataatttaattgcttatctaccagtcctgagtaaactcactcacttagggttttctcagcatttcatagatcatagatcacctctgccaattataggggtcattctttcccactttcctttccaaggtgacctgtaacttctgggcagcttacattgcctcatgacctctggatgaaagtgcctacttcagggtcttcctctggcttgtgttggcacctctgagctgtctgtaggtccactgtgatttctggttgctgatgcctgtcattgttctggcatctttgcaatgactgtgaacacatcttagtgtctctggtcactggtctatatgtttcgagtcatctttacccctgagggctccttaggtccattgtctgctctctgcagctcaggggaacagacagcacagagtctctgtggtggcttgtctaccattccctggagactgagagctgtcttgggctctatttgccaggtttgcatgcctacctaccattgtggctcctttgtaactcccacaaatacttaataattgttcaagaatgtatatagataaagggaggcattattgctattaaaactgcttgataacatcatggagatagcatgagactaagtcatttggactacttgttcataaaagacttcccatgggattagagaacaccataaaggaatgttttcttttagtcacattttaaatttctctatagtaaagcaaaccacagatagaagagtcacctgttttaaggtttcattattgcaaaatctcttgccatttgcctttctttactttctagagctgaaaaggaattgaggcataactaaatcctcctttgtgatttttcatagaagaaaactgaggtccagtgggggaagcgaattgtacaaaattacacacaagttagatgggaccaggtctctcaactcccagtctggagttcaattttttttttttgagacggagtcttgctctgttacctaggctggagtgcagtggcacaatctcagttcactgcaagctctgcctcccgggttcaagcaattctcgtgcctcagccacacaagaagctcggattacaggcatgtgccaccatgcccagctaatttttgtatttttagtacagatgggtttttgccatcttggctaggctggtcttgaactcccggcctccagcaatctacccaacttgggcctccaaatgtgctgggattataggcatgagccaccacgcctggccttctggagctcttttgaattcattcatttcttttctttataaattacccaatctgtagtattatgttatagcaatacaaaatgaactaagacagtgaccatcatacccaagattcaaggagccctcccaaccagctattaagatttgctccagaagctcttgccagaacttgagtctcaagcatgataagtatcaacatgtcaataaattgtgccctatcatacattaatattttgcctcgtctccatttatacaacaccttcacatttttctttcacatgcattgccctaatttctactgatttatattgttgatgtcctacaatagtttttagcaagcaaactattttatttcagcactcctcctcttgggcttatcctagttatcaatctggaggtaatgagggaagatattgaggaaagcaaacattgttttatgaagtgcctgcctcagatatgtttttgtgtgatcttcatggaaggtgaaattgcttttctctggcaaggggaatagcactgctttccccaggctgggtattcaaagttctcagactctgttatctaaaggacccccatcccaggtttcagtgtcccattttcttctgatcactgccttgaccttgacacagaggatctatggaggctgtgcactcagctctgtcatgctacaatttgatcctgggcctgattttccagcacaatccaccctgctgcttcaggagttgagagtctacttgacaactgtaaaaaaggctctggctttaacaatgtaccttgtgtcatcagtaggccactctgagcctatcattttcttccttcaatgtttcaaatacagttaaagaaagccaacccactccacaatccttacagttatcaaagtccagattctgcatattccaatgactcaccttccacttgaacctcatcctgactaaccacaggtagtaaccacagcctttgtagctgggatgccattccttgctaggggttcccataatttcactcttgtctccaaatgttgtagcccagtctactgatttgaagagtgtcctcttccccctggcaaattcatgactacctggaacctcagaagtcacccttatttgcgagcagggtctttgcagatgtaattagttaagattaggtcatactagatgacgatcggctctaaatccaacaactggtgtccttataagaaggccacatacagaggcacagagctaaacagggaagaacaccatgtgataacagaggcagagcttggagggatgcagctacaatccaaggaacaccaaggattgccagcaactaccataaactagaaaataagcatgaaacagactcttcctcagagctcctggaaagaatcaacctgaagacagctttgtttcagattcctggcctcctgaattgtgagagaataaatttctattgttttaagccacttagtttgtggtactttgttacgccagccctaggaaacaaacacacccaggttcccaagaaagcagcatttgaggcagagatcttatatgtggttactcctatgtgctattacaccttacatgctaatacttctgtattaggaatcagtagagagggtcagggcagtgatcagggaagagacaatggccaatgtgaggatgcaatatctagttggttgccttaaactacagaaccattagaagaaagaacgttaacaatgtttttatactgtctatttaagagagaaaggaggaataatatatccacatggtcacatttccctttgattaaaagtttacccatgggacattaagtcacctccacttaaaaggtgtacattcattggcactgttttcatcagggatgtctgaactatggtaatctgtgtgggagcatcattcagagaagagagaggagaaaaatgcactagtagctccctttcttgagctccaatctcctgccattgtctttcattgtctaaacccaactagaagccagctgcatcaggggacttggaaatagagtctacaagtgtcctttactgcagagaaaggagaggaaatggctctcagagccagccggccaggaacagacacatcaggcatggtggtatgaggaaaagtgcagggtggcgacttctgagaatctgtcctggcggcctccaattcagcctcctgctctgtatgctgtgctgtctctgcctttgtggctgactgggcagagggaccaactgcctggcagtctgtattagtccgttctcacgctgctaataaagacatacttgagactgggtaatttataaaagaaagagatttaattgactcacagtccagcatggctggggaggcctcaggaaacgtacaattatggcagaaggggaagcaaatatgtccatcttcacatggcggcaacaaggagaagtgcagagtgaagggtggcagcaaagcctcttacaaaaccatcagatttcgtgataactcacttactatcaagagaatagcatggagataactgcctccaagattcagttacctctcatcaggttcctcccacaacatgtgaggattatgggaactacaattcaagatgagatttgggtggggacagagccaaaccgtgtcattccacctctgaccgctccaaaatctcatgtcctcacatttcaaaaacacaatcatgcccttccaacagtcccccaaagtcttaacacattccagctttaactcaaaagtccaagtccaaagtctcatctgtaacaaggcaagttccttccacctacaagcctgttaaatcaaaatcaaattagttatttcctatatacaatgagggtacagggattgggtaaatacatccagtccgaatgggagaaattggccaaaacaaaaggacacagaccccatgcaagtccgaaatccaatagggcagtcattaaaccttaaagttccaaaatggtctcctttgactccttgtctcacatccatgtcatgctgatgcaagaggtaggctccaatggccttgggcagctccaccattgtggctttgcagggtacagctcctctcttagctgctttcatgggctgatgttgagtgtctgtggcttttccaggtgcatggtgcaagctgtcagtggatctaccattctggggtctgcatgatggtggccatcttctcacagctccgccaggcagtgccccagtggggattctgtgtaagggatccaaccccacattttcctttcacactgccctggcagacattctccctgaggggtctgccactgccgcaaacttctgcctggatatctgggcatttccatacatcctctgaaatctaggcggaggttcccaaacctcaattcttgatttctgtgcacccacaggctcaacaccatgtggaagctgccaaggctttgggcttgcaccctctgaagtgacagcctgagctctatgttggctccttttagccacagctggagctgaagcagctgggacacagggcatcatgtcctgaggctgcatagagcagggggtcgctggggccaacccaggaaaccatttttccctcctaggcctccaggcctgtaatgggaggggctgccatgaaggtctctgacaggctctggatacatttttcccatttcttggtgattaacttttggctccttgttacttaagcaaatttctgcagctggcttgaatttctccctagaaaatggggttttcttttctgtcacattgtcaggctgcaaattttccaaacttttatgctttgctttctcttgtacactttgctgcttagaaatttcttccactagataccctaaattgtctctcaagttcaaagttccacagatctccaggtccagaccaaaatgccaccagtctttttgcatagcaagagtgacctttactccagttcccaacgaattcctcatctccatctgagactacctcagcctggactttgttgtccaaattgttaccagcattttggtcaaatccattcaacaagtctctaggaagttccaaactttcccacatcttcctgtcttctgagccctccaagtctccaggaagttccaaactttctcacattttcctgtcttcttggaacagttggaataaactgttccaacctctgactgttacccagttccaaagttgcttccacatttttgggtatccttacagcaacacctcactctaccagtaccagtttacggtattaggccattttcatgctgctaacaaagacatacttgagactggataatttataaaggaaagaggtttaattgactcacagttcagcatggctggggaggcctcaggaaacttacaattatggcagaaagggaagcaaacacatccttcttcatatggtggcagcaaggagaagtgcatggtgaaggtggggaaaacccccttatgaagccatcaaatcttgttagaactcacgcactatcacaagaacagcatggagataaccacccccatgattcaattacctcccattgggtccctcccaagatatgtggggactataggaactacaattcaacatgagatttgggtggggagacacccaaaccataacacagtccttatggctgaggaccattgggccagtggtctacctcttctcccaaagtggccttatgcaaggtacctggagaaggtccacttatgagactctattaaactattaaatactattttcattcaccactgagtgaatagaaaatcagaaattaaggtcctattttatagacttcataaaatcacttgaattagtggagggttgattggggttttgtctttgtcatgagtacaaagtatcagtcatgatgagcctcattgagttttgtggggaggggtgtaccaaagttcggtagattacatgagtgaggaaggatggcaaagcctctacaggcaagcaatgcctagaaggagtggcacccgttctacagactccacaccagaaataaacactgctcatcaggggttcagcaagacagagctctggatccagatggactgctgaccaactgtgtgaacagaatagttgttctcaagtcttcccctgctcatttaaattactgaacaagttccactaccatgttaatgccaagctaaattacactagtcaatgcttttggtcaacatagaggtcaccttttaattttccccaatcttttctgctatagagcaaagcactaatactgtcctggcttctgttgctgcaatgcagtctttaggaatttagtcttaagtaaattctggtggagtaactcccgtgtaatccgtttcagtctagcatttgccaatgtcttagaaaagaggaagactgaaactcagagctttatttatttagtcagtcaacagagtttactgaatgttgactacacgcttggggctgagaaaaacagaagaaacctaagagacactctccctgacccagaggaccatctcatcttgcagtgggaatgtaactatgaatgaataagcctgatctgtggaccaggaaaggctttctgaaaacagtgatgtattaggttgtttgacagtattccaggctcagagagcagcccatagaaagccctgaggcagagaaaagcatagcttatttgaggagacaaaagttcatcatggtcagggtgtagcactaatggaaagaaaagggttaaagatgattgaacaaagtgatttttagtttacttatttgtttctatgtttggctaggaagcctgctattctaaaccattaattcgagaatccacatttgaaagcctcaaatttaatttgatgtatgtacatttattgggtaagatgtgattcctgacctcagataacttagagtctgacaggaaagataagacacatttttgtagtattataatacaagtcagaatgtaccttaagggaaagacagagtgccatatgaatgcaggaacacctgtgctggatttgttcctgcattcatttcttcaacaaatacttaaatagtatcttctctggggttacaaggatgaacaagacacaaactttaacttcaaggaattgattctactaagcaaggcacatacataaatcattagaattctttaagcacagagatagaaatatgcacaggctatgatgagataaatcaatggttttattttattgagcacttattaaatactttacatgcatttcccataccccccttactaggtaggtattctatcctcagttttcagatgagaaaactggcactgagagaagttaaagcaatttcagaggtcccaacatttgaaagttgaggatacggaattcaaacccagttcttactcatgacaagccccaggctcctaaccatcctacatagaatcctgcttcccaatctctcatagtactcagggcagagcatctcatctgagccaggcagagatgacaaatgcctccctgagcttagtttagggattaggaagtgttggggaggtgaaggggggtaggtgggtgccctaatagagggacaagctgagtagacccaggaggaagaaaactatccaatgttagggtattatgtccattctaggctgttggagattaagccaggaggcagaaaatggccagaaatatgcctggagaagaattgggatcatgcaggatatagaatgtatagtgggaaacagaactggaattggatttgcattttaaagtgattacaagggcagctgtatggaggatggcattgagggaaatgagagtgggagagaagttcaagattatcgtagagttgtagacaggagaaggtgagagtctgaacttagatattagcagaatggatgggaggagaggagaagcttgagaaaaagtcaggcagtgaagttaatgggctttctgaattctgtggctgtgaggagtcagcttagggagaaatcggggttgacttctaggttcctaactcagaagatggagtagatggatggtgttgccaccaaataaggagaaagcaggtttgggggttaggtgatgagttcagctttggtcatgttgagttggaagctccagtgagacatctagatgaagcagtcccacaagaaactgggaatctgaatcaaagttcgtgatagaaacatagcctagaaaaagatttcggaaccatcagcctaatggtggagctaaagcaaggagagtggaagagagtccccaagcagagagggtagagcgagctgaatgtgggatggtcatgcggggcaggcaactcttggagggggcacccatgtggaggtccttaaagaggaataaaggacacttcaggtcgtgtaatagtgtgagcaaaataggggaaaaagcaagaggtgttttcagagaatgtaatggttccatgtggctggataatagtgggtttgatgcagctatcaggtgattaagctgggaatgggttatagtcttgagagattgaggccaggcaatgagaatggaatacaattcagccttgaaaagaaaaaaattctggtacgtccttcaatatggatgaaccttgaggacattatgctaagagaaatacgccagtcacaaaaagacacatgctgtatgattccatttatatgaggtattttaagttatcaaattcatagagacaaaaggtagaatgatggttgccagaactgggggagggcaaaaagtgaagttgtttaataggtgcagagtatccatttttcacaaggaaggaaggtatgtgatgggatagtggtgatgcttgcacaactacactaaatgctgctgaactgtacacttaaaaaatggtggcaaggcatggtggctcatgcctgtaatcccagcactttgggaggctgtggcggatgggtcacgaggtcaagagatcgagaccatcctggccaatgtggtgaaacccaatctctactaaaaatacaaaaattagctgggcgtggtgctgtgcacctgtagtcccagctactcgggaggctgagacaggagaatagcttgaacccaggacgtggaggttgcagtgagcagagatggtgccactgcactgcagcctgggcgacaagagtgaaactctgtctcaaaaaaaaaaataggtaagatggggagggataggaaaatattcattaaaaggataccaaaaaatgataaggtgataaaattttatgttatgtggattttgccacaattgaaaatatcaaaagaagaaaaatgcaaagagaaaagaagtaatttttaaataaataaataaaaaaggcaggacttctattcagaggctatttccaatagttctgaggagagccaatgtggttagaattgggtaggtagcagcagaactgttagtggacccacatgaaagggctgtgtttatatgtcagagtcagtcaaatgttggcaatgtcatatggttcaacctaatagaaaggcaaaaagagacaaatcctttaatgaagttcaagaaaatatacattataaccatttaagttaaattgcaaaatatttcctggggcacttgctctcaaactaataaccaaatagcaaatattttccattttcaatcatcttaggtcaatttgaaaacagctttttagtttttattggagaaactcatattgtcttcacttgttcaatgtgaagttgagttgccaaaattgccttcagtacacatttgtcttttatatttcaaacagaggaaagtttccatttccccatttcattctgaaagctttcaaaaagtttgggcagtgcccagtgctgtccccgtccctcacttcatcatttcagctctagttcttgcacttggcagacttcggacgccaagtttctgcttcagtgctggtcaaaatcccacagaggactttggtaccaatacccactgacaattctctgagctgagagttgttaacttttcaacacagtgacagaatgaaaagagcaggttgtattatcatttataatcaaccaggacttaaaaaattcacacacacacgagaagtaccccaagagattattaaaaaggaaattttcaggtggttttcatagagattccaattctgtgtatcttggatggggtctgggaatatgtttttaacaaaaattaggttaattctgatacaggtcgtccatacactatttttttcagaaattgataagttaaatcagggcttattttttcctaaggataatcacagtcaaacaaataatattgttcttttaagttggtagacactctagcattctgagtgcatttttatttattatatagtacatccaaaaatcatttttctaaactttggaaatattttcagcaaatgaatgcataaaatgagatactgtgtgttttactagttttcctggtatttgaggacaaaagtcgtagttatcccttctcctgttttctccacctctctaagtatagaagtggggggaggagtaggaggagtaggaggaggaggaggaagaggagggaagaggaggaggaggaggttgtcagagcattaagaagcaagagagtagaatgttacagggggtgctacaatcacccagataatagcaggaagtagggtggagaggcatgttataaatcagaaagaagaatcttcggagaaggctgggaagcaggtgatttttagagttgaggaagcgggcacacctgcaaaacagaagagatttttggatgaaggttatagaacagcagtctagaggcagcagtgggagccagtttctgtccctagatactagagctccaagagcctgggagaatgactcatctctgcagaaagaggtgggaaggaatgtcgttgccaggggacccagtggctacgacagaaagatgccaaaaaaaggtactggatttctcccaacatctttgtcattggtcaaaagagacttccccaaacaatgaaatactgtttggagatcccactggatataggaccaaagggcaagcagcactgtgagcaaggatatggaaacccggaatgggataacctcactacctgcacaacacaaatagggtcaaggataatgttcaggagttgatttcctttggaagcttggcgggggaaggaatacactcttcagagcaggacttgaaaagtgagatgcttaggggccaggcaagtaaggtgaatgagtgatggtggattagtgaagagtgtgaacaactagagatctccaacctcatctaaagggactgaccttgcctctgtccaactattttcaggtgggcatatagaatgtagggtaacaaatcccctgtcattaatgaggcccaatgttggcagctaattcagatgttaaataaaatgcactgtcagccaaaccaaacatatctgtagccagatctaccccgtgggctgccaatgtatggtctcagctttggagccagagagactgttattaaacctctttgatactcagttttctcattcatgaaatgataggtggaaaaatactcgactttgatttttttgaaagctacttttggaaacggttagacttactcttcatgtcattaaatgaatgtatgcaaagtatttttcccgtgtctgctactgagtagatcctcagtaaatggctcttatgttgaccagaatcatgcatttttctcaaaattttcttccccaaacaatcaagcaactgctatttcttagaaatgtaaaagatttctgtgtctgcaactatccttcaggtcaagggatgactattagtgtagaaaaggtgtgtggctcagctcccttccctcagctgccctgctctagcaccttcctttcagatcttctggtcctatagatgcctgaaggtcacaggcagaaatatacgaattctacactaaaagaagttgtacaggaacctttaaacaacagcatcaaaagcatctgttaaagtaacgctttccactgagtgccttgctagacatggtacaaagtgcattcaacagacacagttcctttcctcttggaagacctaagacattccaatgacaacaacagatattttatattcataaaaagtgagataaatagcacatgaacaaataaattaacgaacctccctgacaaaaaaaatcgaggaaaggaatgcctgcatttattggtaagagaataatctgatgcatgttacaccaggggaaaactctgctgtctttttctgcctatcagggagctcataaagagatgagattttgaaattgaataatctcaagagattccttggtgagttaacaagaaatgaatgtccagatatatagagaggggagcattccaaatatagtgtgagacttgaggagaggtttagggatggaaaaagatgactgcttaaatggatttaaatacttttgcctggaagcatatgatcctggtgaaaaactaagatgtgactgactaggaaattctgagaatgaaatgatatgaggcaatgttctgttgaactccccagacctggccttcctcaggtaatgatcacaggcctgggaaatgtctgccatcttctagcaagagcttatttattttcacctggtttcatggtgttttttcagtcggtttaagtcagcttgctcctctattcttttctgcagtcttcccgtgtaggctcagggtaatctgactacaaactagtactagggaaggagactcaggaagaaggggataatgcacagttgctctgtttctagcaggagtggttctcactgtgtgtgactagcttgctgaaccgtgaccatctgcagtggctgtcaggggcctatgtgtggaaagttcgcctgaactttcttcctcttagattctgcttatccttgactggtcttgtagctgtctggaatttcttgtcaaagaaatgatattttgttttcacaaggctaaatttgttccagggactattttttcttcttaaaaacattgtttccatgattaactaaggattacaaaaaagttgtggggaggaaacctaatttcttccaaagtctttgaacctgtcagtttaactcagcaggaataaagaaataagctgatttgaaatgtgataactaactagctaaatacacacacacacacacacacacacacacacacacacacagacacccatatttgtatggaaaaaatttcaggattccaatatattgtttttgcctctacctatcctgaatagaggtaacggaaagcaaaagtaaatattggtttgtaatattctaagcaaagagtttggtagtggtatttgctgcttggcttcatcctggcttctgacctacttatcatctctgtctccttaggcaagttactcagctatagtctgctttactttcctttatgatagatggaaagggagagggctacataatattacctatgttagactggctatggagattaaattaatgcatgtaaactacttgaagagtgcctgacacccagtaagtattgaataaatgttagctaggatcatgcatacgattactgtataatgatcatgattgagattgagaaggtatgagcctaaatgtaggactaaattgaattagccttggcctaaggttctcaggtagttgagctataattaaacgcctttggccaatcctttttcaagtatcagagcatcttgggagggttagccctgggcaaaacatctgcttcaccacgccccatgaaggcctagaggctgggatgccctgagaggccacatgagaatgcacaggagggagacgtttactgtagtcctagcctaatcccaagttctattaattcagcaagtgattttttcaaagggcactctaatattcaaaattctctgcatcttcttatatataccttctgctaaatactatacattttaggagataagaataataatacatcaataaaatgtaaaagtatttttcctctttctaattaaaaatgacatacaagtagttcttgaattagaactactaattccctaatgataataatattattattttctgttacagaatgttttatagacatctagcaagtggcatcacatttccattgaattaatggatatttccaaatgtttgagaaaatccgaaaactggatgtcctgtacatacatttccattgaagtttatggcagtttctgggcacaatcacatcaatattgcacatctatagatagtttacaggttacataactgtggttttggatttaattgccaacttgttaccctgatagtaattccagacaggggaataacagagcgaaggggtctgcccattgtgttactgctgcctataaaaacaaataggatccttagggtttaattggaggacttataattgcacctaatgttaaaatgggaactttggacatctggaagatgagtctggatttggtcacttgcctttaggaattaaattcatgaaattgtgatggtcctaaagaacagtggtgttcccacctggatttatgcacaggcagaaatgacaaaggtgaatgtgagctggtctgcaaggccaaataagtcaggagagaaaaatggagtttggctttaaactcacaagtaatccaggatgatgactggcttctttggtcctaacatgaaaataagccatctaaaatgaagagcaggtacataaaaagtttgttcttacttggcaaagacatgcatggcttttggaacttgcaactacacagggtgtcacttggcatcatagagcccatttaggaaaagaatgacccatggtgacacgggctcgttggaaagggtcaggaaaggaacatatacagcaaaaggtacaatacagctttccgtagagaacactgggtatcattttcttccactcatccctcctctccaccatcaaagccaaacatttatataggtatgcattccaccctgcccaatgcattacaaatgccaataagagaggtaggactgttgtttccatttttttccttctaaagctattgaaagttctttgtctgttccttatatagttttaggaatacttttgaggaaattgcctttattctttatagtggatttcatataaagcaagttttgtgtttcttaggaataaaatttcaggcttctggaatattttttattttctctctccataaaaagataatttcaatttccctaaattactaggaatctactctacatggtgcagcaaaattttaaattatgtaatttagattactccagagtaaaacgtcttaaaaactgagagcacagcttaagtgtatggtctagaggcaagagttaatggcatggaaaagtagtaaaaggttggattagaaggtttaatacttttgatctctcagcccattgcagtttacttactccttaggagacacagatgggacacggcaggtgtgtgtaaggagcgaagcaattcatgaatactcagccatgaaatagaaaatcaaaatgaaataagtatgactgcaactatcttggtctattaacattcaactattaatacctactgttctttgaaagccattactgaatatttactgataagaaaaaaatgatagcttaggaagaggaagatgttcaggaaaagcatttaagcagggtttgaaagacttgtgattttcttaactcggggtaaaagtcgaccaattaaagtaggtttcccatccaaatgtttcccatccaaaatgatccctttttttttccccaagggatctaatttaggatcccttggaaaaaaattccaaaatgcattacaactattcataagggtgacacatggacctatttttctaaggactttgatttaatatttgaatgcaatggtatctgactttgttagtatagaatatttaaacttaaaaagaaaataccttaatttacttatgcataagcctattaaacacatttctaggggctctttttatgtttattctctagaacataacctatctttgaagtggtatattagtttttaaaaagtcattcctaagctgaataattaaactgaaaacaaaagctattcttagggtgtattccacatataaagctatgcacatgatgctttgattcaaataatatacttataaaactttgttattgtttgagttccatattcagaatggcaacttttgtttttgatgattattccatcctgaaacaatttcccccctgctcaattaaaccagaattaggagcacatttatatctgatgagacttaagcttctcaactgcctgcttcagaaatgtagacctttagtgcttgtgttcattttgtctctttgtggaaggctcaaaagaaaacagaatcaattcccttaagtttttctggaagaagaaggttggttttgttgctttgatcttagcatgttgtgcattttttattggctgttgaatataaaaagccacagcctcatctggtttttctgctatattctcatattgtaaatcacataatgccttccaatctaaagtaaaatgcctaagtccaaaatatcacttcaaaatggatttatcattatagttgatagaaagatttccagggtgtaagaaaacaattcaacagtttgattaatatgccacagactgctaaaaatatattcatgcattttagacaataaatttcaggatatagacatacactcatgctatttgagatccttttttcctaccattgcaagaggctgctttagctaatgcaacagctggctaggttattgcttcaacaatataattcataatgcaaaagcagctcttttccaaacattttagagcaactcaagttgtttacatctcctgtaggtgattttcctataactttgtgccaattggtgtcatactatttggtaaaaatctacattaaatcaagacaactgcacttggttaaatttctgtcatacagagaattatagaaaaattacagctgatttgaacttatcatcattaagtatatacagggttttagaaaatgaatgcaaactacaaaaatggagttgtataattaaacattaaatagtccaagtaataaaagtcatagattaattgtctctcagttctagtcagatcctttaaatactgtctcacgacttgagcattggttctttcatcggaagagtgcctatccttaaagttgggaaatttcagctcctttggagcaccgatcatctgtaaaaagtaattggcatcttcttccaaagtctcaaatttccctacaaaatcatagttgatcaaacacggatagcagagtttgctgaccttttcccagtgaatgtccattcctactggacggtgggaatccagcaagtagtggataaactctttgaacttgactccagatccattaattaatgcttcttcacaggcatttggtcgatatttcttgataattgcctttccgaatactggatggtaataactattggggtgttcaaatttgtccctaaaggctgatactaatctttccatgggatcacgaacaaacacagctttggtgtaagtatttaagcgggtatatatcccttttaggtcaaagctatctagcttcttcaaatgcttcccgtagtggacagcattgtgggagatgttgtatgcagaggaagccaatccatttagtaccatcagaattcttttccaattggaacagccagccttaggtacctcacaatataagattttgtgtttatcttctacatagattctggatactgtatgaaaaagatgtgactgatgatgactcaccccaccgtatttcttgcaaaactcctgaaggaaagaccttcgtttctcttgggtctcctcagttttcttccatttattatctttgactaaacttttgtttaaagggtgaatgtccactggccaattcatgttgctgaacttgttaaaaacagtcttagctccttgacgtttttcaatcaacttctctgttggtgaccctgtggacttacttaaagcttgatcccctccttgtgaatgactggtctttgttaagagcctagtagatctctcagaattgagtagaagattttcctttttttctcgtacatcctcaggcatgtgaaacttggggttctgttaaaataaagaaggagaaatgttgaaagcacagtcacgagtgtgggtatactggataaggaacttcacatatttgttttaaaatagtatcaaggagagcatatttcatataagctgccagaacaatttagcaaggcatgctgaacatacattttgtagtgagcttcttcacagaaaatgtagcaatgagaaatggcatctacaggatagggaggaaagagccctggatttttgtcctggctttgcctgtaatgcaataggatgtaactcaaccattctgagcatctatgacttttgggatattaataagtatgtcatcttcaagtactgttttagtttgtgcacctgaatgtagatacaaaatggagatgttttgagattgaaacttttattgtttttagggagcactctgtaatgcacagaatagttcaaaatcataaattacaacttaaaattttggcaaggctaattataaatctcgatgaccacttcagttttctaagtgcttgcaaaaatcatgtattttttttttcctgggaaaatgttttatttttctaaagcatttatcacaataatttaagaatttattatgatcatagtatacaatctcattcacatatgagaccttccctctttcccaagtgaagaatgactaaggaatccagaaaagtctacttgacgtcctgctctataaaactgtatcaaggtagagcaaaaatgtagttatcttttcagtaggatgaatgagtccatttaccacatactgttcatcttgccacatccttcctacaactctcacagtaaaagaagacatggaagacgggatttacaaggtggcatcctctggtagggatgaaaattttaaggaccttggcttttactctgggtaaactagggaacttttgtagggctctgggtagaaaagtaacatgatctcacttagacttgaaaaggatggtgtggagaggaatggactggatatatacatatagggttgtcagcatgttattggaaaagtaaatgaataaattctgtgctgtggacataatgcatggtgtcatcagcctagaggtggagggagtggtggggaaagtttcctagggaatataaacatgattgcaaatatatatatacatgatacacatgattgcatatatatatatatagtacatatatatgtgtgtgtgtgtatacacaatttttaaccattgtatccccaatagtgtctagaatggtctacagcctataataatttctctcaaatatttgtggaatgaacaagtgaatgaatgaatggaattaggtcttcaaggataattagtaattttctagcaaattaagcaatagaacagaggaatgaagcaccgttcatggagccacctccagacatcatggtcattccaccagctgaggttgaagggcactgcttttttttctagtgcaagaggactgtgtgaataaccccctgaataccatatgccaacgtgtacagccccgtgtatagccccgtgtattagtctgttctcatgctgctaataaagacacacccgagactgggtaatttataaagaaaaagatgtttaatgaactcacagttccacatggctggggaggcctcacaatcatggcagaaggtaaaggaagagcaaaggcctgtcttatatggtggcaggcaagagggagagtgtgcaggggaactgccctttataaaaccatcaaatcttgtgagacttattcactatcacgaggacagcatgggaaaaacccacccccatgattcaattacctcccacctggtccctcccatgacacgtggggattataggagctacaattcaagatgagatttgggttgggacacagccaaaccatatcaccccctgaaacggccactccaaatcttccataccattggaccgtctatttggagttttaactctaaaaccatttgtctgctgtcttctccagagactgccaggattacttcaaagccctttgtgcttctttactctgatcagtgatttgtagtacataaagttgtcactgaaaatataaaatttgactgtggtttgacagaccatagggttatgggtgcacatgcatggaaagtacttagcacaggccaaatataaaactgccatgatatttatactattacactgctataaataataactactattattgttgttttagcagcagcagcagtagtagtagttatagtactttaatcccagggacctggtgaatttaaagcctccccatttgtccattattattcagactataatttgtgtgtccctacatatgccctcaccaggtctcttctctgcttgacaatcagaaataaaaacaaaatccaccttcccctgtggcctctggactttctgctttgtggccatcaaattcccctttaatctccaggggtttctggaatgtttgtttccaagactctctgtaaatgaaacttggctgactcccaacactctgtgtctcttgcactttctcaagtaggtgaaacttgacttccttgaactacttgtctctccagccagaagatagggagtgatttccctgcagcccacggctgcttccaggacatcacccagcaaagccctctgcttctgtgaaatcaatgtgttctccttaagtctccctttccccctcctcttgttgtcatctacctttatcactgatctgtccactttacacactccagcttctaactcagctcctgtcattacatttagtgactctgacatccaatcaactctcagttccttgaccactttgtttttaacagaggagctctccacttcacatcaaacttggttatcaccagagcctttactattcccaccatctttctgaccactcttgtctcaccttccagttcagtgttatttcctggtttgcaattctttgaccacttttcactgttacccaggtcttaacagccagcatgactggctcttcattcttcagctctcagttggaaagtcacctctgtagaaaggctttccctattcaccctgtctaggttatttccctccctttcaaaatatttcctgcagaaccctgcttatttttctcatagcactaatcacactgagaaatgattttatttatttccttctctgttgtctttttcaccccactctacctccattgcactagaatataactgcagagaggtcttatctttcttgctctctgtggtactaagcacactgcctggcgcatagaagatgttaaggaaataattcttgaataagtaaatgtgcttctaatttaatagtggtcttctaaacaactgttttatgaccttgttgaagaaaaacaacattgaccaaaaggtcaagttaaacttgaataaacaattgaccaattcttgttaaggtgatgagaatctgtgtttaaataaacctttggcaaaagagaaaacaaataaaataagcacatgggaatctgcttgcagtaaagtagatgtggaggcttcgtgtttaacctgcctgccaaatcagatcagttcaaagtcactcaacgctgtctccaaacctgtcgagggcttgccagcaatccggatttccaggccttactgcagacatcctgaatcagaatgtctgagtgtaaggcccctgactttaatttcaacaagatccccaggtactccagtggcagtcatagcatttggggactactgaactagaatataagaaaggaaagtataaaaaaaggcacaagccttgaaaagttcctttcatcctatctgggggagaaagacatcaaatgtagtggacttgaatatttcagtaagaagagaaataacttggatgtagagtaggaatgtcacatgagccctcatgcagactagatgcaatgtctttcttgtttatccatttctcgttgctggaagtcttggatctccaagcaactttctaaagactagtttagctggggagataacctcatgagggaaaggttcaccactcaatataaattagtgtcctcctgttttattgagtgctagtaagtttcctctagtctaaccaaattgagatatgggaaaagggttaattctctaaagtaatggcaccagcaacccacaagggtggccaccagaccttctcctggaactcctcatctcaatgtcatccaccttataaaagctgttattcgggtttgatgacatccctcccagcccccatctaactccattttcttccaatcacagcaaagactccatgactaaggggtttgcattactaaaatcatagctaatgacatttcaaatttaaagctcataccaacaaagtcccatcatcatcatcatcatcatcatcttcacaacaataataaaagagtaaaatcttacatctccattttccttgggacactttattctgattgtccctgaggcaaacatgtatataaagccaaaattatcctgttgccttcaagagtggctccccctgtgttattttccgtttttgaaaaggtcctattactttcctgtcacccactcacaaaatctgagagatgctttaacaatgggaaagtaaattggctattttacatctcataatacttctttttttgtatctttctaaattaattacccccaattggatattcattatcctcctaattagtgtccctgcaattattactaaattattcttccccaaacattttgttttttatttcttaacattttgaactggatcctctagtatcagtgaacgtccccattcctttgctggcatttgcagcctggtgctgctgagcctcttctccttttgctttttttgcttctctcttaacacatgccctgtcctccacttgcttttatctgggctcttggcagccccaactcatggtctcctcctttcttgggacgttcaaaatcttctagtttgatgtaaaaatcctactttctccatgacaaccacccaggtctccagtgagtgattctactccctttgaaatgactatagcacttagtctgtacttcctgtgaggaaagtaattttattccagcttccacagttatttgattgttttgttggaaaaactcttttaactgcagctaaattgtaagctatggaggaaagctatagttttccataaatatccttaaagagtagatattgcagagttagctgaaagacatgtaactacagatttaaaaaaatgagtatctaaaaaaaatatggaaaaatgtgtggaatgttcattaagtctgcaataaacttgaaagcctaattcttgttatttttatttatttatttatttattttgagatggaatcttgttctgttgcccaggctggagtgcaatggcatgatcttggcttactgcagcctctgcctcctgggttccagcaattcttctgcctcagcctcctgggtagctgggattacaggcgcatgccaccacacccggctaatttttgtatttttagtagagacggggtctcaccatgttggccaggctggtctcaagctcctgacctcaggtgatccagccgcctcggcctcccaaactgctgggattacaggcatgagcccctgcgcctggccaattcttgttatttttaagggtttctgtatcaagcatatctcctctgtgaattcttatcgatcctcaacactgatatgaattatactttctttctccccgtcaaagttgttgagcacctcctatacatcaggttctgtgctggatgccagagatggtggggtttataagacaagtgcggactttattcatatacagttggtattctcatagggaaaagtatattaagcaaataactgcacaattaattaatctattaccatagtggcaaaggctccagcaagatactattggaagctgggagagcagaaatgggggtccaggatacaaagaaaagactggcccagtttgagtgttaagtcctctgtttattgtgttttattttattctaggtagttgttagggttaattgtttaggtaatgatctctctattttaatttcattaaatgtcagtgtgcactcttttaaatctatataacccccactagcatcaagaacactatcttgcattaataacatatgtttgaatttgattgaagcaaagaatatcattcctgcactgctccttattcaggcaacaaattcacattggttttatactgttgataagtgttgtacatttgtaggaccttatatactattgtggatcctatggaaactataaaacttgagactttgatcattctttcatcaatgcacatatatggaattactactgtatgttgttttaagcattatataaataaggatgagatagataaaatttgtggcccttcaaggaaaccaaagtttaattgatctgatgaaaataagcagtttatgaaaaaatgtgacaattgctataataaaaggataggtcaggtatttggaaaacaaagaaaaaagtgcttaatttttctggagagatttttgggggcaaatttcacaagggaggtgatgcctgagatgagcctgggaagatgactgaggagctaccaggtggacaagccagagatggcaagggctgtacatcctgacatcgagtctgcttgggggccagactcagatgacagggagaggcaggaggggttgggtgtcattccaggagggcctgggctgatataaacagtcagactttaccatatatatgatggggattttcaataaggtcgtgacaagattcacgatttaaaacattctggggcagtggggaggtgtgcctgggggcagagggatcttctggaagatgattatgattgtccatcaggaatccttaggagaggaactaagacaatggggtaagaatgaagaaaaagggagttgagacaaacttaggaaactgctcagattcgaagcataagggtgacagaagtgtaaagaatggctccccatttcctctctgagagaagaaatagaagtagcagtttttatgggggccctggggtgggtgtgggcattcactatcttcgatttcagacctcttgagtttaaggtgccttagagagctggaggtagatagcaggactgaaaagctgggtatagattcaggagttgttggctggtggaggtgcagctggattcatgggccttgaaggcactgcccagggagtaatttataatattactcttaataatgtatcttttgtgatttaccttgaatctagatagaagtgcagttatatttcttcacaccatcaaggagacctaattgtctccagtcattgataagataaatgatgggagagggtggggtgctcaaaagtcagtcttttctggggacacaggtcagtgtgtctctcctgggtccctctgtgccacagctactcctcttaaatcttgattccagggcttcagaagctgatggcatagttatgagaggggtgaagactgcgactgcatttccaacagaccctgaggacaattgggaagaatgtgagtacggagtcctaatatccagtgccatctgccccatctcgctctccatcctcaccctttgcccttccaccttcagttattcattaaacacgtgttttctgagcacaaactgtgctccaggtactgggctgtgcgttggtggtatagctagcaagacagacttggtccctgatcttacggagcatccttgtggtcagggtggggtagggagatacaaataagaaaaccaaagttatacttatgggaggtaatgagatggagaaaaaacttggtgcattaaaggacaaaaaaaaatttggcacaggaaaacatgaaagaggaatcctggctcgcaggtgagggagggtatctgggagaaactatgagccaggcagaatcatttccatttcctgtctctgtgacttatttcctctctcttgaatattcttctccattttgtttgcctagttaatagactagggggcatggagcaagctggtttaatcactgcatcaaacagaagagtagatgcagataagctcattttacagattaagaacctgagctcagagaatttaaataatgtgccaagttaacacagctattgctggagctggtgtctcaaatctctgtcttagtcatgcctggcttttttcagctgcatcatatatcaagcaatctatttcttgtttaatgtccattaaatgaactgatgtcaggaaagcaccaggcatatgcctgttacaagagataatggtcgttaagaacatggatttttgagtcagacagaactggttatgtgtcttcttctatcgttttctctctgggtgacctcggttatcttattttgtttttctgagcttcagtttccttatctggaaaatgaagataataacaacatctaccttgttggattataggaaatgcctgtagagattccttaatgtaaatatgttctccataaatattagatttttttattgatttaggcgctgaatatttttgagcaatttctatatgataagcagtttttaggtaagtatttgttttttattctgcttttttcatctctttctcctcttccttctctctcacaacatgtagcaaagttaaatgttcaatggcaataaaaatgagtgagaaaaaaagagaaggataagacacttgagagacagaaatgggaaagagaaaagataaaattaagtggaggcaaaggcaaagaaagaaaacagaagaaaagaaatcacaattatgggtaacagggaggaacagtgaacacttgaagagagtgggtaaagagagaaactactgaattacagtcttctccaagctatgagctttaaaatatttaaactgcttcaacacaaaccagctgtttctgttgtgaggctattcaagttgatccaaaaagctaatttctatggtcctcttggattcaaggattgaaactatggttttatttgccagttctttccatttttggatttaattcctattttttttctgcttgaagccaaacaagcttaaaatatgaggactgaggacataacataatgtgaatgtcaaggagaagtttctattggaaacagtgctctggtttgacaagaccatcagaagcggaaaactgacataaccttaatgtatataagtagataaggctactccccaaggggttcaatatgcttttatagatttatcattctatcttccttccaagttttgtaggaaaaatgagatgactcttttgtttgcaaatttacagataaataaatcaagacagacttgtgtaataacttgcacaaggtcactctagaaaatgaatggagaagtcaggaatgtagtccagttctctaattctaacccagtaaacattagttagcagaatatcttgtttttttaaagaaactcaaagccttaatgaggagctgcaacttgataaatgaaatacattcaaaatgtttggccctattttatttcttaggtttgtgtctgtacatattaaatgtggatgggaacagcaaaacccaataaattatatttggcaggaaagaagtagaataagttggtgttttcactattaggatttaaacatttcattggattttagatatctaatggatttgggatatggctctttaatatttccgtgtatttagttgtctgaaattagtattggtcagccagcctcccctccccttgcatttcaggttaatgccaacaacaatgtgtgtgtccaagagggtttggaggagcaatggaggggtgcaccctgactctgacaccttgttctaaagtatacagttgctagacagagttcttcttcttgttctctggaatgtggtgaagaggaaggaaccagctgtcttgtgttgcaatttcaaaatgtcaagttttctttttatgtgtgtgtgttatggccatggattggcaagaaaaagattttcacaggtgaaggggaggtcttcccctccacacctgtgggcgtttctcgtcggggggcgggggtacgagagactgagaaaagaaagagatacagagacaaagtatagagaaagaaaagtgggcccaggggatccgcgctcagcatatggtctctgagttccctcagtatttattgattattatctctaccatctctgagagggggatgtggcaggacaatagggtaacagtggggagagggtcagcaggaaaacatgtgaacaaatgtctctgtatcataaacaaggtaaagaaaaaggtgctgtgctttgatgtgcatatacataaacatctcaatgcattaaagagcagtattgccaccagcatgtctcaactccagtcctaaggtggttttctcctgtctcagtagatggaatataccatagggttttacaccgagacattccattgctcagggatgacagggatgagcaggagacagatgccttcctcttatctcaactgcaaagaggccttcctcttttactaatcctcctcagcacagaccatttatgggtgtcaggctgggggacgatcaggtctttcccttcccacaaggccacatttcagactatcacatggggagaaacctcggacaatacctggctttcctaggcagaggtccctgccgccttccgtggtgttttatttccctgggtacttgagattagggagtggtgatgacttttaacagcacgctgccttcaagcatttgtttaacaaagcacatcctgcatagccctaaatccattaaacgttgagtcgacacagcacttgtttcggggagcacagggttgggggtagggttacagataaacagcatctcaaggcagaagaatttttcttagtacagagcaaaatggagtctcttatgtctacttctttctacatagacacagtaacagtctgacttctctttcttttccccacacacaggcaagggggatgagtccataagatgacactggaaaaggggattggcttgagtgcaccagggggccagagacatgggtcatccctggtgacgggagttggaatgctcccctgagatggagactggaagtacaagaaagaagaaagttgttgtgaggtcaggagcatggtggctggatagatcttcaaagtatgaagagcattagcttttgcgtcagattgcctaggtcttccacctattaattgggtgattttaggacaatgtcatcatttgtggctccctagaatcagaccttaagtcaagggttgagaacaagttattaatttagtgttgattccaggaaacactggcaggagagtagggaactgagaaaggaaaggcacagaatatagggtggattattgagcaagttagcacagtgggaataggagctgaattctactgaggagccctcagaacaaatgtagagcatatctccccagagttattccacacaatcctatcagctgtggttaaaggtttctgcagggcgagttctggcaattccagtctgctctacaggcgggcagggtggactcactcaggcagagtcacaggtgtgggtagttggttggaagtctggctggagtgcaaaagaatgttaagagatgaataaatatgggaaggcacagctagcactcttacagagagtccattaacattcctgagtctgtttcctcatttttaaagtgggaattccaagaactattttggaaacgttgaaatgtaagtgaaggcattggctgggatccaggaccccaaacactctgtcttaccatagtaagaggtctcaattctgtcttcctatactcactcttcctttggaagtgtccatggtgtatgtttgtgtctatgcacacaaacaaggctgagaaaaggaacaccctacaactagatggaaccctaatcctgttcagctaagactatatagatctgtgggaattctgttgctcagagaaggcaatcctaactttgggcaggaggtctctttggaccctttaaccaagagccatgccaaaatatcagccctctgattctcaaactctgatactgggaaaaggtaagtcttttagagaattaactagataaatgcagttataaagtacctagtacagtacctgacatatagtgtctgccatatagtaggtttctccaaaatgtgaatgcatcctgtctctatgcctttcttctctgattttctttaaataccgggcatatcatctataacgctgctttcccaacttcagattaagatgaccatgggaacagtccctgtgtgcataagcagttgacagaggtggatgctaattcaattaatagtatccataggccagtgagcaaccaatgaggggacctggagcaaaagacactgtccaagtgggtagagagtaactagctaaatcaatgtgtccatctcccttttgggctgtagactggaaaatatggagagtggccagttattacggggtaggaggagagagagagagagatgaagagagaagaggaggcacaaaagtagcagaataggagtctgagagggcatctgagtcaagataaggtgaagctgggggctatgacgtaagtgacactccttttccaggaagcagcatatacctgcccccaaccctgcccaacatgccaatgcctactagtccaaagccacctgagtcctgggagcagcattgccatgtgcgagagtagtaggggcactggcaggaatgcactccattcgtctcactggattaagcatctactggtcccagatcagattggcctgtgtcagcacctttgagtgaaacacacgcccctctggcttatgtcacttgcatatttgacaactcagctatacttaagacagctccccaaagcctgctctaaccctcactggagagcaggcagctcacactctggtgctaccatgtgttacctgggccctgagttaggaagagagattgcctgtggtatcagatcatgccatggggattctgagtccatgctgagtggggtttcttttcaggatttcattctgagaaagaatgcaaaggaagaatatagaattacactagcagcaaagcagaaggacagaagggaagacaggagtcaagtgggttgtcatatgatgaggtcagagtgaatagagcactaacaaaactaagcgagcatcaaatggatatttgcaaggtctatgtatgcatgcattcagatacattttatcatctttattttttagaatattatttcattaactctaagttttgcagctttttggggtttccaaaatgggttacctctcctaaaaacagttgtacttgattcaagatatcaattaaatgggtactggaggcagccatggccacagcctctccttttgttccctttctttgtgagggcaagtataggttgcactgatcctgaccttttggcctgaggatggaagtcttcagtatctgtacaactttactcccaagagctggtgtagaatgagttcctctggccatgggaggatcgcagaggggcacctgccaccagcagcccagcctcagtaagtgcaatgtgcagttggcagaggggagggagctgggggcacaccaaccctttctgttacttcctgtaggcatagcccaagtctcaggaagcagaatatacatggggtggggtggggtggggtgggggaggagaggggagctgtttctgcccccacccattacctactagtccaaagccacttgagccatgggaacagcaatgctaaccacaatagctgcagggacctggaaggggattgttgatgcatccaactgcaatgctcttttacattgagatgttgatggacaggcttctacctagtcttctctagagatacacatatcataaagcaggcaagtataactctctacacattccttagatgctgtatcattacccccttccctcactacaattctgtaatctgcaccttgggaggaacaaacacgtcttattgcaccttgcccagaaatagtatcacagcttattaactccatctactccccacacaagggataacgactgtccactgaaggggtaaggaagtctcaagtgccacacaaggaattttcctagggccttccatcattttaggccaatagtaactcacctatagccagtactgtagcaagttgaaagtgtatggatttgggtaccattcatctgtaaaaaccaaagaaaagacttgcccttctggattaattcacagacctgtgggaagaccctcttgtctcacctgtgactcatgaccatattttgagatccccaagtccctggagcctgcttcctcctgagcaaagagggttgtctttatttcaacgggcaaggaaagtccatttgtttgtctccactcctgccagggctccactctccttcagttacaggagacctcctgaagcaaggctggagggagaggctgtgtggtaagagtgagctttgaatgagtatggactgagggcttcacatgcaccagatgctgcacaaaataattgaatttaatcctcactctggctctgacaggtggttgagatcatatttttattaaacttactcagcattttataatgggcaattaattgctggaggtgggattaaaatccagtcttgtccagctccaaaatggtatgtctctcactacctaacccatgctttcctctcggtgacatcacatctgtaactataggagtgtttccttgctatcagatccaaatgaatacaatcctttgtaccgagttaccttgaggtagccaaatgtgccggagtcaactctagttagaatgaatgaggacatcatcccacctttggttgcttcagctctccagtttaaaataatatatgttgggtaccaagaagctctactgaacatcattgttggaatgaccaaagtactaggctcttgctcctggacaacaatgatataagtcagcactgcctggactttgggtctctcctcaggtagcataaaccacacagagattgtgatcatctgctcagcttttatgtcagccttgcaacaaatctccttatcttcatgggatctttatcttcacttctgcctccacactactgttagaaacacatatactgagacttggtggttatggagtaataatatcttcactccatcaatgttgttttttttcaagaaaatttattttaaatcttggcacttccacagctgcaaaaaatctgggagaacaagccagcacttgtggagctgtgtgtgttagctggatcaggggtgaaggggggcaagctgaagtacctttcaacccctgataaactcccagggaccaaggaacctggtccccatggctttttatcactgagatgctagctctataatgccatctccatggtgatttctacattgaagaagaacatttatttcctgccaccagtaagagaccacctgagtgttcagttgcagtatcttcaactccccagatccatcagtagcattgtcttctctgggcttctcttatagaactcttttttagcaaagtcaagtttccatattctaggtagtaacttatcagatggatgttcaaaacgatggaagcaaagcattcatgtattgcatttcagttattttctctggggttttatcacccttcaggtggttgtctccaaaataacaggtgtcattctgctctattaatctggttcccctacctttatccaggcacttttctcttcagcgtcttcttcaaggtatttccagttgcccgccctgaactgtttcagaatgaggaggacacctggaggaatctacacgtgcatagaccaatttgcaaaagaacctgtgagccaacgtaggttgtgagatgcatatcccacatccagttcagcccagtaacttgggaaatgggggagaggtagctctgaagaccagacttagtacatttttacccccatccatgcttgcaactgtaagttgatcttaaattagtacttttaaccaagtcaacctcaatcacttgaataggatacccagctgaaaaacttggggtcactgaatcaatctcttatctgtaagagataatgatgcccacccaatggggttctgaaaaatatgtaatgcctgacatgtagtgtatactcactgaatgtggcttttaaccacaacctttatatttttgccgagtatcacctttctgcagcaaccgtgagaacctcgcgctaagcttgtcttagattgctcattcctttcctatatttagacaccaaactccattcattttccccttgaaatgttcattcccatgatcaagattttgcttaaacacattttgttttcatgtccagattattacctcagctggaagaattaataagcaacacgttcacccaagaagtatttactgagcacctactatgtgcattattttctggtgttggggctagggggcaaacgactctgacaagtctctgttctcaaggtactcacatttatatggatgaagatagataacaaacaaggaaaaaattggacagacaaaaaatttaggtggtgccaagtatgatgcaaacactaaaacagtaatgcaatagaagatgtcagagggagagtgggaaggttacgttaaatagatgtccaaggaagatctctctgaggagaagctactagggctgagatcttaatgacaacaaggaacccaagggctggaagcagagcgttttgaacatggccagtgggtgcaaaggccatcacacgtgaatgggcctggccaggtggaaggacagagggcaaggctgttgtggttgccctgtgagtgcgaacggcccaagatgggatgaaagaggaggtcgggaccacaccgtataggaatatcagatcatggtcagggctttggattttacaggggtgcagtataagccatggggagttttagacaggtacagaagtaatttacattttctttctttctttttttttttttttgaaacggagtcttgctctgtcccccaggctggagtgcagcggcgcgatctcggctcactgcaagctccgcctcccgggttcacgccattctcctgcctcagcctcccgagtagctgggactacaggcgcccgcaaccacgcccggctaattttttgtatttttagtagagatggggtttcaccatgttagtcaggatggtctcgatttcctgaccttgtgatccgcccgcccccgcctcccaaagtgctgggattacaggcgtgagccaccgcgcccggccgtagtttacattttctaaagcgtactctgccagccaagtggcaaacagacttgggcctcttaagagtggaagcaggaggaaacccgaagatcctggagagagactggtggctggtaccagtggagagggagcaaaaaggaaaatacaggatacaatttcaggaaaaatttcataccaatttcctgaggtaatttctgaactcgaacattttcagtgtcaccacattgtgtttcctgctgaatcaagtctacatcacttcggtttttaaagccttccacgatccttccctgaacactgtagttttcactgatggttggctgtttcaaactcccatatgatccatactgtatcattaataagcaagcaaggaataacacaccctctgctattctgtgcagtgtttcaggtttttagttttctctttcaagatagaaaatccctttagagtaggaactcggctggcactttctttcacatcctgcatagcacttagcaaagttctgtacacagggcacatgtggaaattgcttattgattgattaaaagcatatatcactggcatttgtatcttcagtatttctcttgtatgaagaagggtgattatctgtcaatattcattgcatcattgaaccaatgtacaatgcattaatcatcactgaagataaccagatgaggctttattgtaatctccttctattttgctgagataatttcacttgctttagagtttatgaggccataagtggctcccatctgttgatgaacatatttctaagagtcatttagtctcaagtatggaatacttgaggggaagttaaattgtaacttttatattaagtgtcatcttagtaacagaaccaaaattggaagcatgtgttcaattttggtttttcattttcaaagctttaggtcaggcaaagaattaatttcatttgtttacaaagtagattatgcctaataaaatctattttgtttatggtcacattttaatcaatccactgctttagaaaatgagagaattctgattggctaatcattcaacatagtaaattacattattccacatccacagaacactggcctaattgcattatccagtaatgataaaaatattccttttaatacattttgagcaaggcatataccagtgatgaaacagggaagaatcttgtttattccatccttgtttgatgatcgaccacagaatataacataacacttctgtgtataagaattttttcaacattaaggataataaggacaaggtagttttcactggatccttactggtactctgaattttcactatttgtccgcatttcttctccttcccggaaatttgttttctgcgaaaaacaagtgctactttgtcaaataaagcttaaataaaattggtttcaatttatgcataat

SEQ ID NO: 1792 - DNA, 196184 bp, Homo sapiens
cgaatttgaaaaggcggccccggagaggcgtgggcgccccccacacatttccagctcgcacccgggctccgaccgctcgccccgctcctctcgctgtgctcccggccggtgccgcgggttcggtccgggcgccggtgcgctcctgccggtcctcgtgcccgggactccgggtccccgcgggctgctgcgcacgatgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggtgagtagctcggggccgaggggccggggggtggggggagggagcggacagcgggggccctggccactgggtggctggagcgaggcttgggggctggagagcggggcgatccgggacttgggggcgcagggcagcggggactgggggctgcagacaccgggcagctggaacgagagctggagggggttggggtgcggggcgattcgggcctgggggcgcggggtggcggatgccaggggcaggggacacggggcaactgggacgaaatggcggtggctgggggttggggtcacggggggaaagaccgaagggccttgggtgcagggcgattgggggctggggcgcggggcggcgggggttgggggctgcagacggggcagctggaacgagcgatggaggaggctgggggttggggccgcggggctgcggggctgcggggttgcgggggctgaaggttcgggtccggctccggggctgcggtggtctctggccgcgcccaccctgtcccttcctttcttcgcttccccaaccttcgccccctcgttccgggctccgagtagaggtggttccgaccgccgtggctggggctggggctctgcccggggcgttcggccgctcacgtggctctgccgctcacctgcgcggctgcggctttgtgtcgcggagcaggttctcgggtggccaaggcctcgcgtcccgggcacccctctcctatcagcggccccaggacaccagaggggtcattcccgcccagtctttggggctgaggccgcggaggatcctcggctgcgactccccagccaccccgggacgtggaaccggctgggatcgggtggctccgtggcggggttggagagggcgcagggtcaccgggcccgggcgccgggacccgccaggcgtctccttcctctcggccggcaggtggcgccatggccacccccgggacgctcagggctgcggctccggagcccgcatttgaatttccccagaaaaccataagcatgcaagtaaaagttgccaaacgcctcgtttgcataactcgcttgaatttagcttttctcatttagtgataactacaacctacacagctatgacagcgctctggaatgcactacctgtgtctgttccctccgtctcttttttatattttaattttttttttttgcagaggcagaatctcaactctgttgcccaggcttgtcgcaaactcctgggctcaagcgatcctcccgccttggcctcccaatctccatttcttttgatccttaacaaccctagggttaaaacattagagtagtatctttcctttagctgaagaaacagaggctcaggatttgctaggcctaggagccactcaggactgacctcttgtgctttctttcttttttttttttttttaatatagggtcttgcttgctccccaggctggaatgcagtggtgcgatcatagctcactgcaaacctgatctcccaggctcaagtgatcccccgaccttggcctcctgtgtagctgagatcacaggtgtacaccatcatgactggctaattttttgattttttgtagaggtgggatctcactgtgttacacatgctggtctcaaacttctggcctcaagagatcctcctgcctcggcctcccaaaatgctgggattacaggcgtgagccaccacgccaggcccagatctggtgttttctagcatactgctctgcctatcaaagctaaaagacagctcctagttctttttttctccttgatatttaccaaatcagaggactccaagatgatttctggctaattccttaataacaaggagacagggatgtttcatgctgggaagaaatatacagtcatggctgaatagggcgggacccagaaaagcataaaagtgcctctggaaaagtttgtatgcaatcctatttctctcattttgtttggaaatacttacccggggcttctatgaggagcattctccaaacacccacgctagtgtggcctctgcacagttccatatgaggattgtctaaaaaacaagcttttcaagttacagaataatatatacagcacgatttcatttatgaaaaggaaaatcagatctacatctaggtagataaatgcctgaaaaaagtttctaggaaaccatttcagcagttaatgttatgaagaagtctagggctgggccaggggactgtcccattttccctctgtctgcttgtggcttgtctgaatgtttttctggtttctgtgttttttttgagacagagtctcgctctgtctcccaggctggagtgcaatggtgcaatcttggcttactgcaacctctgcctcccaagttcaagtgattctcctgcctcagcctcccaagtagctgggattacaggtgcccaccactgcgcctggctaatttttgtattgttggccaataaaaaatgtaacgttggccaggctggtctcaaactcctggcctcaaatgatctgcctgcctcagcctcccgaagtgctgggatcacaggcatgagccactgtgcttggtccctaagagaacctactggccggtacggggattgaatggatgttttgcaaggagcgtatattcatgtaatacttttgtaattaaaaggtgtgggaaggaaaaaaaaaaaggtgtttgcagcctgaaatacgcctgcaaaaaagcaagaggtgaggaccatgaagagcgggagcgaatggggacctcattctggcatttggtgggttggaacttggggacatctgcagaaacttggaagggatcattttagcacaaacaaaaagaggctcaaacaagtgtggaatcttccagaactctttccaccaggataagaacagggagaggatataattaggtttagggaggatgtggatgaatctgtgggcaatggattcctaaaaaggataccagaaggtgttggggaggcttggggcacattgatattccagagtgtgactgagtctctttgcccagaaagcccagcgtgggcattgcaggcacctggttgttgcctgggtgagttacaggctggagctggcttgggcgtcacatgtttctgtgtctcatgagctatctatcacaagtgtcccttgtccttgagatccaagatgtccagaagctgaaggcttggggacagcagtggtccttgcagccttggccttcagtagtgtgtttaccggggcttggcttcagttgacaggcaatgatgacagggctgtttcttgacaaagagtgctttaatttcattgttactgctccttgttaacgtctgatttttttttttttttttttttttttttttttttttttttttttaaagacagggtcttgctctgtcacccaggcaggagcgtaatggtgcaatcatagctcactgcagcctcgacctcctgggttcaagcaatcctcccacctcagcctcctaagtagttgggaccataggcatgggccaccatggctggctaacttttaaatttttcatagaggtggggtcctgctatgttgcccagggtggtcttgaactcctggcttcaagtaatccttcagctttggcctcccgaagtgttggaattacaggtgtgagccactgtgcctggccaaaaagcagtttttaattgttagtttgttcaaatcaggatctaaataagtctgcttattggttattctgtcttttctctcccttttagtgtaggaaagtcttccccctttgagagagtactttttcctccacgctgttgacttgttgaagaccagttgttctctgcgatgtccacgtactagatttagctatttccttcccagtggtgtagttaacttgatctgcaatgtccacgtactagttttgactaattgcttcccagtggtgtaattaattggatcctctgccccctgtatctcttctattttggaagttaggttggaaggtttgattagatttatggtctctatttgggcttgctgggagagacagaaattcttcataggtggtctagtctaccatattatatcaggagatgctctggactgatgtgtgtgtccccaccaaattcatatgttgaagccctatcctccaatgtggtggtatttggaggggggacctttggaggtaactagatttagatgaagttgtgagggctgtgccccattatttgattagggatgttataagaacaggaagagaggccaggtgcggtggctcatgcctgtaatctcagcactttgggaggcccaggtgggtggatcacctgaggtcaggagtttgagaccagtctggccaacatggtgaaaacccgtgtctactaaaaatacaaaaattagccgggcgtggtggtgcacaccggtagtcccagctacttgggaggctgaggcactaaaatcgcttaagcccgggaggcggagggtacaatgagctgagatcatgccactgcactccagcctgggcaacagagtgagactctgtctcaaaaaagaaaaaaaaaaaaaaaaagaagaagagaaatcagagctctctctctttgccatgtgaggacacagcacagcaagaaggtggctgtctgcaaaccagaaagagaaccctcaccaggaactgaatctgccagcaccttgatcttagacttcccagcctccagggctatgagaaataaatgtctgctacttaagccattcagtctgtggtattctgttacggcaaccttgagctgactaacagaaggatgtggctttattctggaaagctgggtgttaaatattcagcagaacaccactgtctacaagtctcctccactgtctcccttctttttgttgcaatttatttgttgaagaaacttggccttctagattgttcctttttcaggattttgttggttatatgctcatggtgcctgtgaacatgttcatctgtcctctttatttccagataatgggaaattagatcaagagcttggttggatctagttcttcctcctccttcgttttctattttggcagaattacatcttgggtgctgtagtgtttttccattggaaatcacaacgtctggttgtctctctttttctctcgtgatgcttgaggtgttggtgatcattgcgtatgtcattctttcattaaggatcgcaaagtggatgcaagacaggcaggcccccaaattggggcttagccaggagggttcttggcttcacccaggaaagaattcaagggtgagtgggtggtttcagacagcaactttaattgatgtggcagtgtacagctgcagcagaggtcctgctccttgcagagcagggataccccataggcagtgtgcccagactagcagctcagaggcagtttggcactatttatacttacttttaactatatgcaaattaaggggcagtttatgcaggaatttctaggatgaaggtggtaacttctaggttgttgggttgttgccatggaaaggcatggtaacttccgggtgttgccctggcaaatggtaactgacatggtgccctggtgagtgagtcttatggggatgtgcttcgtcctaacctgttttagctagtcctcaatttggtccggtgtcaaccccaacctccagagtcaagtcccgcctcctacttcaaagtagtactataattttgactctttttaaaattcgtaattgctagaatacttataatttcccccttatttactatttgtaggtagaaaaaactcactcaaaatctggctctttccaaaaaaaaaaattctttttgcaaatgtaagcaatttgtgtgtgtatgtgtgtgtgtgagcgtaacagtgtgtatgagtatgtgtgtgtttgtgtctgtatcctcctccttttcttacacagaggtaatatgctagttactctgtcttcaacttggcctttttccatcataacgtgttgtggagatggctctatcaaaaagcaaagatgggggggcatgatgactcacgcctgtcatcccagcactttgggaggccaaggtgggtggatcgcttgaggtcaggagttcgagaccagcctggccaacatggtgaaaccccttctctactaagaatacaaaaattagctgggcatggtggcgcatgcctgtaatcccagctacttaggaggctgaggcaggagaattgcttgaacccaggaggtggaggttgcagtgagctgagatcacgtcactgcactccagcctgggtgacagagcaagactcagtcttaaataaataaataaataaagcaaaggtaatctgcatctttttttttttttttttttttttgagacagagtctcgctctgtcgcccaggctggagtgcagtggcgcaatctcggctcactgcaagctctgcctcccgggttcaggccattctcctgcctcagccttctgagtagctgggactataatcacccgccaccacacccggctaatatttttgtatttttttttagtagagttctgcatccatttttatgggtctgttgttctgtacagtgtgagtgactgtatttattcagctagtcctctactgatagacacttgtgttggtaaatggcaaacacatgtttaattctgctagatagcgtcaagtttccctccactggggttacagcattttgcattcccatcagcagtttcttcttggggtacattttgaagagtccattttattttattttatttatttgttttttgagatggagtttcgctcttgttgcccatgctggagtgcaatggcatgatctcggctcaccgcaacttccgcctcccaggttcaagcgattctcctgcttcagcctccgtagtagctgggattacaggcatgtgccatcatgcctggctaattttgtattttttgtagagatgggtttctccatgttggtcaggctggtctcaaactcccgacttcaggtgatccacccgcctcagcctcccaaagtgctgggattacaggcatgaaccaccgcgcctggcctgaagaggacattttaaatgatgctggttgatatggcctttcaggggtaagaatagacttccctgatcttatagcacctgcaagtcctggccacccctaacctttttggggcttggggcaagactaaagatgaagaccattcaccatttggctagatatttaaaagtataaaatcaagctgacacactgtttgttttgttgttgttgtttgttttgtttttgttttttgagacggagtctggctctgttgcccaggctggagtgcagtggcacgatcttagctcactgcaacctccgcttcccaggttgaagcgattctcctgcctcagccttccgactagctggtattacaggcatgcaccaccatgcctggctaattttttgtatttttagaagagatggggttttgtcatgttggccaggctggtctcgaactcctgacctcaggttatctgcccacctcatcctcccaaagtgctgggattacaggcatgagccactgcaccctgcccacctttccttcatctatacctgctgcttcaaactctctctgtctctgaattcactttcttgtggtttcgtctaagccaaagtgcttggtgtgtcccctcctcactcaaaatgcctccctcttaccttgactcccccctcttttggtagaaccacaagcacccttcctccaggaagtctctctggatttacctcccagctttctgttcatctcatttgtgggtagcccctgcacctgtgatttgtgggtagcccctgcatctgtgattgtggttttggttctagaactcacttccccagtttccctccttgcagatggagtcatttctccttcctcatttactccctacaggagtggctctgagcagccgtccttgggcaagcgtgcatgagctggagcttagccctgcccaccacccaccactgcctcttggaaatgtgagccgctccaggtcaggcatttaatcaccttgcattcactgagcccacgtgtaggtagggtagaggctggggactcaaacgtgaaggcagggggctgtgcctggtggcctgcatggaggaagagctcagcagactctggggaagtggatgatcacatccatggggacttgtccctccgactggattgcatgcctctgcagtgttggacccctgcctttgctctctggttccctacattcaagaattggcaactgtgattagctatggtgcctcatgcctttaatcccagcactttgggagaccgaggtgggaggatcacttgagcccaggagtttgagaccagctgggacaacatagccagaccctgtctctgtaaaaaaaaaaaaaattaaaaaattagctgggtgtggtggtgcacacttgtagtcctggtggaagctgaggtaggaggatcacttgagcccaggagtttgagaccagcccgggaaatatagtcagaccctgtctttgcaaaaaaaaaactttaaaaaattagttgggcatggtggtgcacacttgtagtcccaggtatttgggaggctaaggtgggaagaacgcttgaacccaggaagttgaagctgcagtgagctatgattacaccactgcgctccagcctgggtgacagagtgagaccctgtctctggggcagtgagatgtttcagacccagcctccgtccttgatgagctcagagactggttggggaaaacagatccatgagcaagagtggaatttggtgtgatacaaatgtgtgcaaagtgagctaggggagttagggtttgtgggagcctgggagtctttgtgcctcagttttctcatctgtaaaatgggaatgacttcagtacttcattaagttgttctggggcttacatgggttaatattaataatgttcttaggaaaaaggatagtaaaccctctgttcatgaatgtgaccgtggactgcattcatatgccttgcaaaggttgcaaggacgggggagttccacaaatatatgaagccttggaatctttttctggggagcattttgttttttgagacggagtctggctgtgttgcccaggctggagtgcagtggtgcgatcttggctcactgcaacctccgcctccagggttcaagcgattgtcctgccccagcctcccaagtagctgggattacaggcgcccaccaacatgccaggctaagttttgtatttttagtagagctggggtttctccacgttggccaggtcttgaactcctgacgtcaagtgatccatctgccttggcctcccaaagtgctgggattataggtgtgagccaccgcacctggccttctggggagcattttgttaggattgtgttcctgaccacatacttagggaaatgttctagtggatagagactaaatgttgaggacttctcagaggagtcaacataggaggtgggttttgtaggatgaacaggagagcttgaggcagtgactggggcattctgggcagacagacaactgtgtaaaggcttggaagtgtcattagctattgcctgacatatagttagtgggactgagttcagagtggctggactaatgggatgtggtggctcatgcctgtaatcccagcactttgggaggccaaggtgggaggattgcttgagctcaggagttcaagaccagcctgggcaacacagcaagaccccgtctctaccaaaaataaaaaattagccaggtgtggtggaacacacctgtagtctcagctactcaggagactgaggtgggaggattgcttgagcccaggagtttgaggccgcagtgaactatgatcgtgccactgcactccaatcagggtgacagagcaagagcagaccatgggcttgggcaggcagaggacaggcactgagcttttggagtctggatgtgaagtctccttcctgccaccttgaggagcttgccttcatagtctgggctttgtcacagtcaggcttgtgccaactttgctggtcggggagaggctggcagaggaaggatagtggaaggagggaggccagttaggaggtagttgatggatggagcaggggagaagggagtgctcagagctagcaggacctggccccttggtggatcacggataggcagagacaggctacaggcctgagctcctggctgtctccagtgcctgggggacaccaaggagcctgctgctttgcttctcagaacattgcaaattttttgcagcactttcttggtttgcaatggcagcaaagcagagttcaaacatcttgcatttttgtgaaatacttttatttttcctgcatggagttttcaaccccaaatttcagcatctcctggacttgcacggatcaggtgctcaaggaaagtttgttgagtgaatgaatgaacacatgaatgaatgaacaaataccttgacctttctcctttgggacaccgaggcagtgcctctgcctcagtgcacgtttgcagttctgagggatcctggagcgaggtccctttctctgcacaggccagctcctgaagctgcttttaggggaaccatggagactccagctttagaggtcccgcttctccctttgaagtgtgagcacatagaggagggagacttttcctgagaatcacacagaatggctttgatgttaatatcagtgagaccttgtcctcaagctccaggattttctgaatcttccctctcttcatctcactcccctcttcccccagctcatctgttattttaaaatccattcccagagaaacaattcctatggcaataagagcactcctccaggcttctcttggctcgaactcgtgtgacacttcattgccacttccagagtgtgtgagctggacccggaccaattcagcctggggcaggggaaaagagcaacaataactaactgttagaggattttcgggaatgttagcacaaagtgctccgggaattctgcagacaatcctacggaaacatacacatgccgtgctgttctgccctccgagttgtcaggggtccctggccttcccagcctggccttgtctctacctgcctcccagaaaccagggtctagagcttctcttcggagtcctgtaacagactaccctgaaacaagctggactgagtccaggttaattctgaaatactggaggagagcggtgtgcgttctggccccctgcatctccttgtttgccccacccctaactacctccagagtgatctatgtaaagcaggagtccccaaccctgaggtcacagacaagtaccggttcaagaccagttcaaggaaccgggccgcacagcaggaggtgagtgataggcgaaaaagcctgaagcttcatctctacagctgctgccctcgctcgcattactgccttagctctgcctcctgtcagaccagcagcggcagtagattttcataggagctccagccctgttgtaaactgcacaggcgagggatctaggttatgcacttttatgagaatctgatgtctgatgatctgtcattgtctcccatcacccccagatgggaccgtctagttgcaggaaaacaagctcagggctcccattgattctacatgatggtgagtagtaggattatttcattatatattacaatgtcataataatagaaataaagtgcacaggccagacacggtggctcacgcctgtaatcccaacactttgggaggccaaggcgggcagatcatctgaggtcatgatggagtttgagaccggcctggccaacatggtgaaaccctgtctccaataaaaatacaaagaattagccaggtgtgttggcgggcacctgtaattccagctacttgggaggctgaggcaggagaatcgcttgacctgtgaagcggaggttgcagtgagccgagatcacaccactgcactccagcctgggtgacagagtaagactccatcttaaaaaaaaattttttttaaataaataaaaaaaaagaggaaggctgtgaagagtaggatctggaaccaggctgcctgagtctgagtccaggttctgtgtggccctgactaagttgcctgccctctctatgcctcagtcacctcatctataaaatgggtatgattagagtgtttccttcataaggtcattctggggcttatgcaagttaatattaatcaagcgcttagaacaatgtctagtatgtgctctaggaggccatatgaaaggataaaggcttctctcagatggtgtagtgtgctgatggggacttggcaaagcttgggaagatgatggatttcacaaacataggaagcatggctgggcacagtggctcacacctataatcccagcactttgggaggccaaggcatgaggatcacttgagaccaggagttcgagaccagcccgggcaacatagcgaaatcccctgtctacaaaaaaataaaataaaaattagccaggtgtggtagggcacacttgcaatctcagctacttgggaggggaggctgaggcaggaggattgcttgagcccaggagtgtgagaccagcctgggcaacatagcaagaccccatatctacagaagaaagaaagaaagaaaaagaaaattggccaggcacggtggctcacgcttgtaatcccagcactttgggaggctgaggtgggcagatcacgaggtcaggagatccagaccatcctggctaacacggtgaaaccctgtctctactaaaaataaaaaaattggctgggtgtggtggcgggtgcctgtagtcccacctacttgggaggctgaggcaggagaatggcatgaacccgggaggcggtgcttgcagtgagccaagatcgcgccactgcactccagcctgggcgaaagagtgagactccatctcaaagaaaaaaaaaaaaaaaaagaaaattagccaggcacggtgatgtgtgattgtagtcccagctacttgggagaggaggctgaggtgggaggatcacttgagcccagaagcatgagcccagccttggcaatatagcaagaccctgtatctacaaaaaaaaaaaaaaaagaatagaaactagccaggtgtggtgttgaatgcttatagtcccagctacctgggaggggaggctgaggcggcaggatcacttgagccgaggaggtggaggctatgattaagtcactgcactccagtgtgggtgacagagtgagaccctgtctcaaaaaaagtctcaaaaatatcctccccaaaacaaaacaacaaacatatgaggccacagaatccttttctagggtgccttttgccagggtggtgtctttcagactgcacaccctgtgagatgctgttgtggatgggggctaaatgctgaggacttcctagaggagtctccattcaaagcaggtcttgtaggatgagcaaaatgtcctgataggtttccggtgctctcccagagctggtcctaagcctgctcactggggtcgtttcggaccttctcctgtagctgagcccacccttgctgctgcaggggagccggagaaaacagaagctgtaatcctgatggtttttccttgtctcttaggaccctgctcaggttttcaagaccagagtgaggggtgtgggcctatctgcactcccagctgaacctcagccactttgggcgtcagtgcagaggatcatccccagatgtgattgaggagcagatgggagggatcggagggtgctcagatgcctgtggtgaggactgaggctgaggatttattttctttattttattttctttatttattttttgaggcagagtctggctctgtcacccagactagagtgcagtggcgtgatcttagctcactgcaatctctgcctcctggcttcaagtgattctcctgcctcagtctcccgagtagctgtgattataggtacctgccaccacacctggctaactgttgtatgtttagtagagatagagttttaccatgtttgccaggctggtctcaaactcctgacctcaggtgatccgcctgcctcggcctcgcaaagtgctgggattacaggcctgagccactgtgcctggccttcttttcttttttcttttttccttttaaatagagatgggggtgtcactatgttgtccaggtcagtctcaacctcctggcctcaagtgatcctcccaccttggcatcccaaagtgctgggattacaggcatgagtcactgtgcccggctgaggatttctgatgagcttcatgtcccagacagtgtgagagcagaagggacctggggaggccctaaggttggggggaaagggctttttctgccttgtctcatgcagccagcctgcagtgactcactttttttttggagccagggtctcactctgttgttcaggctggaatgcagtgatgtgatcacatagctcactgcagccttgactgtctggactcaagtgatccttccaccttagcctctcgagtaggtggaactataggcatgcactaccatgcctgtatcattttggtattttttgtaaagactgggtcttgcaacgttgcccaagctggtcttgaactcctgggctcaagcgattctcctccctcagcctcccaaagtgctggaattacaggtaggagctactatgaccagcagtgacttacttctgaaggacccacagttaagccagcaacttcccttcattgctttagtccctcatcagtgaacaaaacaaaataggttggaatcaaatgaggaaatgtgtttagtagataggctgactgatcattgctgttcatttgaatgagggctccatctatccttttttaaattttaatttttttacattttagagacagggtcttgctctgtcaccaaggctagagagcggtggcacaatcacaggtcactgcagcctccacctctcggactcaggtgatcctcgtgcttcagcctcctgagtagcttggactacaggtgtgcaccagcatgtctggctaatttatcatttaaaaattttttggggggctgggcctggtggctcaaacctgtaatcccagcactttgggagactggggcaggtggatcaccttaggtaaggagttcgagaccagcctggtcaacatgttgaaaccctgtctctactaaaaatacaaaaattagctgggtgtggtggtgcatggctgtaatcccagctacttggtattggctctgtttctccataggctgtgaggcagggatttaacttagttttttactcaaaccgccctcacacttttattgaataacccattcttccttgctaatttgaaatgccacttttatcatatactaaatttccctatatgcatgaagcaggagaatcgcttgaaccggggaggcagaggttgcagtgagctgagattatgccgttgcactccagtttgggcgacagagcaagactccatctaaaacaaaaaaaatttttttttgtacagacagtgtttccctatgtcacccaggctggtctcgaactcctggcttcaagcgatcctccagacttgggggctggggacaccaagaccggtggggggacagacatttgctctgcatgtgtgtaagctgtttgcactcatgactgagtggtggtttgcagcctaaatattatctgtctttgtttgcaagaatttgatctcccaccccctttcttgttctggaaatgcaaggactctgcggcatttgtccgagaatctccgacagttcccagccccttggaggatgtcccctgcttggagtctttatgatcggctcagacttttcttttccccggggagttgtccctggatcagggtttgttgcaggatgtctgcggctgtgcggcccctggaggcgaccaggcctgccaaacactcactggagtctcacttgggcttccccagcccccgtagttacgaagcctttgagagaaggtagcagtttccttctgatttggctccggctgtctgcgccccagccagttgcctctggcttctgacatttttgtcattcctgctcttctgggagggtttatctcccttcctggcctcctttgattgacttggccacacggctgatgcttgggctccaagaagtcttggcctgccccgggcacccatttctgccgtgatgtgatcctggctggctgcaggatttgccagcctcttcccatcttttgttctgcgactgatgacaattagaccctgaaacgcttcacacagggactctgaacatgtgtgtctaccagggcaggagtggagcaggcaggtgagcctctgcatcaggggctcggagggagccccgtcctggctctgcctgatgggagaagacctggctgtgctcctggtctctcttggtgctctgctcaccattgcctgcctttcaccctccagatccttcctgcctctcaccctccagatccttcctgcctcagggcctttgcacagattgttgcccctgcctttgtcagaggtgcgtgaaccacagcagctacatcatgaatacaggttgggtaaaatgaggctgaggcctactgggctacttacccagatggttatggcattctaagtcacagggcgagataggaggtcagcacaagatcataaagaccttgctgataaaacaggttgcagtaaaaaagccggccaaaacccaccaaaaccaagatggagatgagagtgacctctggtcgtcctcactgttacactcccaccagcgccataacagtttgcaaatgccttggcaatgtcaggaagttaccttttatggtctaaaaagggaaggcatgaataatccaccccttgtttagcatatcatcaagaaataatcataaaaatgggcaaccagcggcccttagggctgctctgtctatggagtagccattctctattcctttacttacttactttcttttttttctttttgagacggagtctcactctgttgcccagtcaggagtgcagtggtgcgatctcggctcactgcaacctctgcctcccgggtttaagtgatccttctgcctcagcatcccgagtagctggcactacaggtgcctgccaccatagctggctaatttttgtatttttagtagtgatggggtttcactatattggccaggctggtctcgaactcctgactttatgatccacctgcctcagcctcccaaagtgctgggattacaggcgtaagctactgcacccagctacatttttttttttttttttttttgaaacagagtctctctctgtcgcccagactggagtgcagtggcgctatcttggctactgcaacctctgcctttcaggttcaagcaattctcatccctcagcctcccaagtagctgggactacaggcacgcactaccacgcctggctaattttttatattttaatagagacgagggtttcaccatgttgcccaggttggtcttgaattcctgagcttagccaatccacccaccttagcctccctcctttaccttcttaataaatttgtttttactttactctatggacttgccccaaattctttctcacacaagatctcagaactgtctcttggggtctggatcaggacccctttctggccacaccctgatcagtctttgtgacttttggcctaggtaactcctgcccagactttagagatcagcttaaacatcacatcttcagggaccctttacttgcccttcaggataatatcaggttcctttgttaaaagctcttagagctagctctctaacttagaggcttatgacaacagtgagtaaattccataactaacgaattgataattcatgagtggttatcttcccagagatggcaaattctcccagggcagtggtcctgtctggttttcttctgtagctctaggttctaggttgttctctgtcatccttgcctggattacagagggtgcttgggaaatgaccaacctctttgcaagctgtgttagattcgttttgctgctgtaacaaattaccacaaatttagtgacttaaaataataccagttcattatcttacagttcttgagatcagaagtccaaaatagctctcactgggctaaaatcaaggtatttacagggctggtctttttggaggctctgggaaagaacctatttccatgccttttccagcttctagaatttatcagcattccttgacttgtacctccttcctctatctccaaagggcattactccaacctttctttctgatacctcctttctctctgactttgatcttcctgcctctctcttgtatggaccttttagattaggttgggctcatctggataccccctcaacttcagtatgcttaatttaatcatcaagtccctttaaccatgtgtcttagttccttttgtgctgctggaatagaaaagcacagactggataatttataatgtatgaaaatttattggctcatggctctggaggctgggaagtccaaaagccaggggctggtatctggcaaaggctgtgtcattttatggtggaagggcaaagagagggagagaaagagcgagagattaaactctaagcctcaagcccttttacaatccgtataatctattcgtgagggtggagcttttatgacctaaacatcttccattaggccccacctcccaacactgttgcactggggattaagtttctaatgtgtgctttgtgggggacacattcaaaccatagcactgcataagataacattttctcaggtttcagggattagaaagaggacgtccctgggggagatattatttggccaaacacacaaacggagatgaaaagggaaagatgtgccagatactggggagccttggagggttgcactgatcttaggctccaaaaagaattaagactgaaagtggctttggcatcaaaaggctgttaagattcagccttgagctaagggtcattagagcatggattttccatttgttttttaaaatttttatttatattttgttgctattttgagatagggtcttggcctgtttcctgggctagagtgcagttgcatgattatggcttactgcagtttcatactcctgggctcaagcaatcctcctgcctcagcctcttgagtggctgggactgcaggtgcatgctaccatatctggtcaatttttaaatattttgtaaagaagaggtcttgctatcttgtccaggctggtctcaaattcctggcctcaagcaattctgggttggcctcccaaagcactgggattacaggtatgagccatcgtacctggctctgtttctccataggctgtgaggtagggatttaacttagttttttgcccaaactgccttcacacttttattgaataacccattcttccttgctaatttgaaatgccacttttatcatataataaatttccctatatgcatgatcctttttctgaactcttattttctactgaactctatctggtctggtgccaaaaccacagttctgtgttttaattattatatctttatcatatattttgttagctgatagaacaatttctccttcactgttctttatcaaaatattcttagttgttcttatacatctttttattttgggtgaattttaaaatcatcttttctaggtttataaaaatgctgttgggattttgatcagggtgtgttaaattaatggagtcataggattacaggtttatggccaagcttggtggctcacacctgtaatccaagcactttgggaggctgaggcgggcagactgcttgaggccaggagtttgagaccaggctggccaacgtggagaatatcgctactaaaaatacaaaagttagctgggcgtggtgatgtatgcctgtaatcccagctactctggaggtggaggcaggagaatcacttgagccccggaggcagaggttgcagtgagctgagatcacatcactgcactccagcctgggtgacagagcaagatcctgtctcaaaaaaacaaaaacaagaaagaattacatgcttataacattgtgtgttttttaggaacatgtcctgctgctccattgactcagagttttttagacttaggcattttatcatttttattgctgtcatgaaaggactcttttgttccttgccatttataaacatttatgtttggcaggtaggaaagctgttcatttgaggcatgtcgattttgtatcagctacctttgtgaattttcaaaaaattattttaatttttttttaggtagttctctagggtttttggaggtggagaattttattttttatttttatttttattttttattttgaattttaattttttgagatggagtttcacttttgttgcccaggctggagtacaatggcacgatctcagctcaccgcaacctccacctcctgggttcaaatgattatcctgcctcagcctccgaagtagctgggattacaggcatgtgccaccacgcctggctaattttttttttcttttttatgagacagagtctcgctctgttgcccaggctggggtgcagtggcatgatcttggctcactgcaatctctgcctccccggttcaagcgatcctcctgcctcagcccccctagtagctgggattataggcatgtgccaccgtgcccagctactttttgtatttttagtagagacagggtttcgccatgttggccaggctagtcttgaactcctgacctcacgtgatccacctgcctcggcctcccaaagtgctgggattacaggcatgagccacagcgccctgcctaattttgtatttttagtagagatgggatttctctatgttggtcaggctggtctcaaactcttgacctcagctgatctgcccacctcggcctcccaaagtgctgggattactggcatgagccgctgtgcccagccgataattttttttttaaggaaggcaatattttttgcaagtttgtttatttatttatttatttgagacagggtctcactccattgacaagcctggagtgccgtgatgcaatcactctttactgcagcttccaactcctgggctcaggtgatcctcccatcccagccttctgagtagctgagaccacaggcgtgcgccaccatgcttgactaatttttaaattatttgtagagatgggggtcttcctatattgttcaggctggttttttttttttttttttttttttaagacggagtctcactgtgttgcctaggctagagttcaatagcgtcatctcggcttactgcaacctccgcctccggggttcaaaccattctcctgcctcagcctcccgagtagctgggattacaggcttcagccagctaaattttgtatttttagtagagatggggtttcaccatgttggacaggctgatcttgaactcctgacctcaggtgatccacctgccttggcctcccaaagtgctgggattacagacatgaggtactgtgcctggcctcaggctggtcttgacctcctgggctcaagcaatcctccagcctcggcctcccagtgtgttgggattacaggcatgagctattgcacctggccagtggagactcttatagtcttccaatgtgtgtgtatgtgtgttggtcattgtgtgtgttaggactctctagaggggcagaactaataggatatatatgtatatatgaaagggagttgattaaggagaattgactcatgcaatcacagggtgaagtcccataataagccgtctacaagctgaggagctaggaagccagcagtggttcgtcctagttccaaaacctccaaagtaaggaagccaacagtgcagccttcagtctgtggctgaaggtctgaaagcccctggcaaaccactggcgtacatttaagagttcaaaagctgaaaagcctggcgtctgatatttgagggcaggaagcttccagcacgggagaacaatgaaggctggaagactcagcaagtcagctcctttcaccttctctgcctgctttttctagccacgctggcagccgattgaatggtgcccacccacattgagggtgggtcctcctcacccagtccactgactcaactgttaatctcctctgaaaacacccagaaacaactagaaacaatactttgcattcttcaatccaatcaatttgacactatatatacacacacacacacacactatatatatatatatatatacacacacacacatatatatgtgtatatatatagtatgtgtgtgtatatacggtgtgtgtgtatatatatactcgacactaaatatgtatatatatatatgtgtatatatatgtgtgtatatatatatatatatatttgtgacggagtctcactctgttgcccaggctgcagtgcagtggcgtgatcttggctcactgcaacctccgcagcctgggttcaagtgattctcctgcctcagcctcctgagtagctgggatcacaggcatccgccaccatgcccagctaatttttgtatttttagtagagatggggtttctccatgttggccaggctggtctcgaactcctgacctcaagtgatccacttgcctcagcctcccaaagtgctgggattacaggcgtgagccaccacgcctggccccatacaattgaaaaaaattttttttaattttttaatttatttgtttatttgttttttgagtctcactctgtcgcccaggttggagtgcagtggtgcgatctcggctcactgcaaactctgcctcccaggttcacgccattctcctgcctcagcctcccaagtagctgggactacaggcgcccaccaccacgcccggctaattttttgtatttttagtagagaccggatgttagttagctagtagttagctaggatggtctcgatctcctgacctcgtgatctgcctgcctcggcctcccaaagtgttgggattacaggcgtgagccaccgcgcccggccacaatttttatatgttggttatacctcagagaaataggggaataaaaaacctcaaaaccttgttgagtttcatcaagggtggggcttcatcttttttgcagaggatgtccgaagtagaaggctctgaggggagagaaaagttctagagaggggatgatgctgcagttggccagactgcattctgaattgtgtatctcctgccgagtgtctgccctgagcaggcctcctctggtcctgtcctagcttgtttttttttttttttttttttttaattttttgagacagggtctggctctgttgcccaggctaagtgcagtggcacgatcacggctcactgcagcctcaacctcctgggctcaagcaagcctcctgagtagctaggactacaggtgtgcaccacctagctaattttaatctttattttttttgagatagggtttcactctgttgcccaggctggagtgcagcggtgcaccgcacctggccctggcttgctttgttctcgtttcacgcacttcatctgcagctgaaccgcaggcccctgggggtcaggagccctgtcccagaaggttatgtctgtcacgacaggtaatccagcactgagcacaggatgtgaattaaaacaatcccttattgaatcaacggcagctggacccactgggacagcgctgtgttgactttttgggctgcaaagtccaactcacgcaggagctcacaaggctggagttggattctgacccgaagtgaaccaggagtgaacagggagcacggtggacccagacccaatgtgagggtccaggctgttgcctgagtaaggagtttggcaggaaagctcaatattctgtactggaagggggtggtagcattgcaagttgtctgcctgctaggcctaggtccgggacagctgcttgtggggacagctgtctcagcgtcggacagagcatctgccctagattaatcccagaacctggccacgcccctggggagcagagccggggtagggttaccgcacaccaggaaacgcgcctgctttgctgacagcgggtgggtagcttgcaggatggatgggctctgggggcggccaggggtgccactgggaaaggcagactcactgctggctgagccaaagccacccccacgggatgcaagctgacactcccaagagctgctttctttccgctggacccgaaaccggcacgagatgatctccaagaattatgagaagagttgggaatggaaaccaaatgttcgtgtcaggtagaaaaagctgatggaagcccatagcccagcaggctctgggtgcttcagggttcaggctcctgtggtcagcacagatgtttaggtgaaagaaacccgacacactgaaaaaaaaaaaagtttattttttcccccttgattatatttattatagaaaacctggaaaatctggaaaagtgaaaaatcatttatcattgtattttgcaaacattttaaactttttattatttatattgtggtaaaatagacctaacagacgatttactgtcttttattttcttctttttatttttatttttttttgagacagagttttactctgtcacccaggctggagtgcagtgtgaagcattctctctctcgctctctctctctctctttatatatatataaatacatacatatatatataaagagagagattttatatatatattgtaatattttttaacatatattttaatataattatatatatatatatatttatatatatatatatatatatatatttttttttaagacagagtctcactgtgtcacccaggctggagtgcagtggtgcaatctcgactcactgcaacctccatctcctgggttcaagcgattctcatacctcagcctctcgagtagctgggactataggcatgcgccaccatacctggctagtttttgtttcttattaaagaggggtttcaccatgttggccaagtatcggactcccagcctcaagtgatttgctcacctcagcctcccaaagtgctgggagtacaggcgtgagccactgcgccctgccaaaatttaccatcttaaaccatttcccagtgtatagcacagtggcattaaagacatttacattgtcatgcaatcaccatcaccatccatctctggaactcttttcatcttgcaaaactgaaactctgggccgggcgccgtggctcacgcctgtaatcccagtactttgggaggctaaggcgggtggatcacctgaggtcaggagttcaagaccagcctggccaacatggtgaaaccctgtctccactaaaaatacaaaaaattagctgggtgtgctggtggaagcctgtaattcagctatctgggaggctgaggcaggagaatctcctgaacccgggagacggaggttgcagtcagccgagatcgcgccattacacttcagcctgggcaacaagagcaaaactctgtctcaaaaacagacaaacaaaaagccccgaaactctgtacctgtgaaatgctaactgcatttctgtcctcccctggcccctggcaatcaccacctattttctttttttttttttgagacagtctcactctgttgcccaggctcgagtgtaatggcacgatctcagttcactgcaacctccacctgccaggttcaagcaattctcctgcctcagccccccaactagctgggactaggggcacagccactgtgcccggctaagtttttttttgtacttttagtagaaacagggtttcaccatgttggccaggctggtctcaaactcctgacctcaagtgatcctcccgcctcggcctcccaaagtactgggattacaggcgtgagccaccatgcctggccctttttcttttcagccttggacttagcgactgagtagctcctcttgtacattgcctttctggaacacatagcagatcaggaatatctaccaattcctctgacaaggacaggattttggccgccatggggcttccccttcttgggctttttagccttgaggtgaccgtttttcaccttgccaccagaatcagccttcttggcttcaggtttcctcagtatccgtcttaacattttcacccactgtcttgcaagatgggaaagagcgggttttgaccgaatgggtatgaagtggtatctcattgtggttttgatttgtcttttcctaatgattagtgatgttgaacatctttttaggtgcttgctggccatttgtatatcttccttggagaaatttctattattaagctgttagccctgttttgaattgggttgtttctatattgttgttgagttgtaggagttccttatgtatctggatattaaccctttatcagatgtatgatttgcacattttttttttttttttttttgagatggagtctcactctgaagcccatgctagagtgcagcggctcagtcttggctcactgcaacctctgcctctggggctcaagcgattctcctgcctcagcctcctgagcagctgggactacaggcatgcaccaccatgtccagctattttttttgtattttattttattttttgagatggagtttttctcttgttgcccaggctggagtgcaatggcgcgatcttggctcacggcaacctctgctacccgggttcaagaaattctcgtgcctcagcctctcgagtagctgattacaggcatgcgccaccatgcccagctaattatgtacttttagtagagacgaggtttctccatgttgggcaggctggtctcgaactcccaacctcaggtgatccgcccatctcggcctcccaaagtgctgggattacaggcgtgagccaccgcgtctggcaattttttgtattttagtagagatggggtttcaccgtgttgcccaggtggtcttgaactccagagcccaggagatttccccacctcttcttgtattctgtgagttgccttttcactctgttgattggatctttcgatgcacagaaatttttacttttgatgtaacttaatttattgatatctctttttttctcctgttggctgggctttttttgggtgtcatagccaagaaatcattgccaatctagtgtcatgaagcttttaagagttttagaccttttaggtctcatgttaagggtttttttttttttttttttttttttttgagacaaagtctcattctgtcatccaggctagggtgcagtggcacaatctcagctcgctgcaacctgccttctgggttcaagcgattctcctgcctcagcctcccgagtagctggaattacaggtgtgtgccacctgtaatggggtttcaccgtgttggccaggctggtcttgaactcctgacctcaagcgatctgcccgcctcggcctctcaatgtgctaggattacagatgtgaggcactgagcctggctttagttttgttttggtgagacagggtcttgctctgttgttcaggctggagggcagtagtgcaatcatagctcactgcagcctcaaactcctgggctcaagccatccacccacctctgcctcctgagtagctgggactacaggcatgcactaccatgcctggctactttttaaattttttgagaaatgggatcttgctatattgtccaggctggtctcaaactcttggcctcaagtaatcctccagcctcaggctctcaaagcattcagattacagatgtgagccaccatgcctggcctggagccacttttaaagaagccaccagctttagggcatggaagtggatggagaagggagatatttctaaaaatttcttggaaatatctggtgaggtctcagggattccgaggctgggaagctcagtgggctgtgcaaccggtccaggctgtgtggggagggggccttgcctgtgggcctcccggggacctcagaattctttgctcctctctcctcccactgtggctttagagatcctttccctctctaggtctactctttggcctgtgccctttgcctctggcctgacctgctaaccaaagccttctgttctgaggtcagccgctgcctggctgtggtaacaggagcctcaggggaacagagcagcggaaggaaagggggatggggagggccccagcccttgaagctgagcagatggcaaagaaaaacatggcctgtttgcctctctggggtgtccggttctgggggcaaggcaggagtttctctggtctcagtttattcacacatgactgtgcgtgggagcatataggggggtgtgggtcaccccctttttgctggaagcatccgggcctggccgggattctattttttttattttttttaaaaagtgttcctggggcctgattgtatctgatctgtgaattcatcttgggcaagggctgtgatatactcctgggcccgtatcctaggacctagagaaggtcctattggatgacagctggagccaggaaatttcagaagcaaactagagtcttcatgtttctcatttagtccttctaggtcttctctatggttctctggaaggagacattgatctctgcatttggaccctatttttattattatttatttttgagacggagtctcactcttctgcccaggctggagtgcagtggcacgatctcagctcactgcaacctccacctcccaggttcaaagagattctcctgcctcccgagtagctgggactacaggcgtgtgccaccacgcccggctaatttttctatttttagtagagacggggtatcaccatgtcagtcaggctggtctcaaactcctgacctcaaatgatctgcccacctcggtcttccaaagtgctggggttataggcatgagccaccatgccaagcctttcttttcttttcttttcttttcttttcttttcttttttttctgtagagatgtggtcttgctatgttgctcaggctgatcttgaattcctggtctcaagtgatcctcccgcctcagcttcctaaagtgctgggattacaggcatgagccacagcacctggcctggaagtgcattctcagagtccagcagggcagtgtgtgttcttcgaggcagggaagtgtatgggcctgagacatcagtggatgcaaatggctaaggaaagaggtcattctggcagaggagggagaagttgctagagatttcactgcagaggtgtgacggggctgggccgtgagggtggcgggtgcacaggcaggagggttactccaggttgcaggaaaacagcaggagtgaaggtacatgagggccatgagtctggcctgttggggcagtgtgcatctacctcctgccccccagctataggcaccggttcctttttccatctgttgttatgagcaggtgccttccgtaccagctagggaacaagtatccaacaaccaggcttttttttttttttttttttttaagatggagtctcactctgtcatctaggctggactgtagtggtgccatctcagctcactgcaacctccgcctcccgggttcaagcaattctcctgcctcagcctcctgagtagctaggattactggtgcccaccaccatacctggctaatttttgtatttttagtagagatggggtttcaccacattggccaggctagtgtcaaactcctgacctcgagtgatccacccgcctcagcctcccaaagtgctgggactacagggatgagccattgcacctggccaaaaaccaggctttttggtgatggctgggaacccagaaagggtgacagtcatttgtgatccaattcctagttgtctgaaatgtgcctccctccaccgcatggcctcaccactgatagcttggtcacctatcagctgtgtggtctgggcttgccacgggtgggacgcaggagagtggccctcaaagataggtaagtcctaatccctgcaacctgtgaatatgctactttacatggtaaaagggactgttcagatgtaaacaaaataaggatcttttttacattttcaataaaaaaatgtttttttgttttttttttttttgagatggagtctcgctctattgcccaggctggagtgcagtggcacaatctcagctcactgcaacccccaccttctgggttcaagcagttctcctgcctcagcctcccagtagctgagattacaggcgtgtgccaccatgcccagctaattcttttgtaattttagtacagacagggtatattagtcagagttttctagagggacagaactaataggatatatgtatatgggagtttgttaaggagtattaactcctgaattaacacgatcacaaggtctcacaataggccatctgcaagctgaggagcaaggaagccagtctgagtcccaaagctgaagaaattggagttggatgtttcagggcaggaagcatccagcacgggagaaagatgtgggctgggaggctaggccagtctagccttttcacatttttctacctgctttatattctagctgcactggcagctgatgagatggtgcccacccagattgagggtgggtctgcctttcccagcccactgactcaaactgacaacatcttcacagacacacccaggatcaatactttgcatccttcaatccaatcaagttgacactcagtattaaccatcacacagggtttcatcatgttggctgggctggtcttgaactcctgacctcagatgatccacctacctcagcctcccaaagtgctgggattacaggtgtgagccactgtgcctggccaatttttaatttattttagagacagggtctcactctgtcacccaggctggagtgcagtggtgtgatcctagctcactacagcctcaaacttctgggctccagggatcctcccacttcagcttcctgagtagctgcgactacaggtgtgtgccactacacctggctaatttttaaaaatattttattttttagattaaaaaaaaattttttttttagagatgggatcttgctatgttgcccaggctggtctcaaacttctggcctcaagtagccctcctgcgtaagcctcccaaagtgctgggattataggcatgagccactgcgcctggctgggaaccaatgcttattgagcacctactgtgtactaggcttagagctaggaccagtggaccttgtaagagggtagcaagagggccagagtgagtagtaggagatgttaccatggaaaccagaggttggagtgatgtcaaaaagaagcctccagccaagggacagggggatctctagaagccaggaaaggcaagaaatagattctcccacggagactctggaggaaactcacctgctgtcaccttggacgtctcatttctagaatgataagattataaacgtgtgctgttttaagtcactcagttggtggtaatttgttatagcacaaggggttttgtttgttttttagagacagggtcttgctgtgttgcccaggctaaagtgcaatggtacaataatagctcactgcagcctcgaattcttggccttaagcaatcctcctgcctcagcctcctgagtagctgggaccacaggtgtgtaccaccacgcctagctatttttttcttttcttttttttttttttttttgtagagatggggtctcgctatgttgctcaggctggtcttgaactcctgggctgaagcgatcctcctgcttccacctcccaaagtgctgggattacaggaatgagctgctgcgcccggccaaccacactcttttctctcatctgtagaatggtctcagtatccttgtcctgactctgtgtctctgaggatgagaaagcaggagacctccagttctccttggctgttgctgtagatttgtttccataaagcggtttctttttcttttcttttttttttttttttttttttgagacagagtctcgtgctgtcacctaggctaaggtgcagtggtgtgatctcggctcactgaaacctctgcctcccaggttaagtgattctcgtgccccagccccttgaatagctgtgattacaggtgcctgccaccatgcctggctaatttttgtatttttagtagagacggggtttctccatgttggccaggctggtcttgaactactgacctcagacgatccgtctgccctggcctcccaaagtgctgggattgcgggcatgagccaccgcgcccagccccataaagcagtttctagatctcactgtcatatggctccgaatgtcctgttgtgagatctcttctgaaagggagaaaaccttatcctgaggaattctaaccgaaagcctggagaacccaccacagactgattaaaagaaatctttctcgtaggaaaactgcaagtcctgagtctccagctttttcatgtgtgacccttgggtggcccacttcagagcattctgcagcttgtgatgggtttaattttctgttttgatcccacggtgaaaccacaaatgagtagaagtgccttaggcaggccctccgccctggtagccccactcttgggatgaggctaggtgggaactggccgtctgcaggggttcctgggaaaaaagctctttaatcagcggggctggagggaaaatggctctgcaggaatgaattgagaacttgaaacggcatctttccctctggttgccaggggagagttgcaattcttttgcggtgattttgtgactttcttgtggtcaaccccctggtgcctgtcggacttgagcacagcagccagatgagaggggaaaaatagggggaaggtggctccttccacctgagggacatctgcctttaatcaccgctgaaaacaaagcaggccaaggaattgcctgcgacccgctgagggcagctcaggtatctctggaggctgcagccttggggttgtcgagggtctcagccttggggtctttgtgcacttaggtgctctgggagaaaaccttctggaactttgttttgttcacatccggcccttgcttgaaaactcctggtggcccagcatggtggctcacgcctgtaatcccagcattttgggaggttgcagtgggaggattgcttgagcccaggagtttgaggccagcctgggcaacatagtgagatcctgtttctaccaaaaaaccaaaaaaacattagccaggtgtggtgtggtggtgagtgcctatagtcccagctactggggagggtgagggggggataattgcttgaacccaggaggttgaggctgcagtgagccgagatcgcaccactgcactccagtctggatgacagagcaagaccctgtctttaaaacacaacacaacacaacacaaaactcctagtggttccccatgcctcaggccaaggttcaaatcccatagcatggcacttaaggcctttgtctcttcctagtctactgcccagcctcagcctcacttcccagcccctgactgactactccaagccccatagagctgctcctctgacaattccagagctgttaagcatttcttttttttttgagatggagtcttgctatgttgcccaggctggagtgcagtggcacaatctcagctcactgcaacctctgcctcccgggttcaagcaattctcctgcctcagcctccctagtagctgggactacaggtgcccgccatcatgcctggctaatttttgtattttagtacagatgagatttcaccatgttggccaggctggtcttgaactcctgacctcaagtgatccacccacctcggcctcccaaaggtgctggggttacaggtgtgagctaccactcctggccatgctctttagaggactgtggcaccctagaggaggacagaatcccaggcttggggacaagggtttgatgtcagagactggagaatgcagctccctagagcaagacccagtggagatcagacggtgaatgtgtggaagaactggggctccacatcttgtggctgtggggtgctccttcagcagcccaggcctggggtgacgctgggtagatggggctgtaagatgcagaggtgggggaatgaggagcaaagacaggctccaaagcatgggatggagagacatggccaaaggtgaggctttgggaacaaagggaggggctagagtccctgtgcaatgggtgaagttgacctccctgtccctccccggcagaaccagacaccaccttctaagggctcctgtgcactgcaggtccttgcctgttcttgtcacctgtgtcatgtttctgtgattctttgtgttgtctgtgtcttctcattagattgcaggtctccttttcagctgtctcaggccagtaagtgtctcaggatctggtgcttagaaagggcttcacaaatgttcattgaacagaggacttagaattgctttcttttccttccttccttccttccttcttcttcatcttctttctttttttttatctttcttttttctcttctttcttttctctttctttacttcttttctccttcctcctttctttgctctccttccttccttccttctcctttccttctccttctccttcccttcccttcccttccttctctcctccccccccctcctttttttttttgagacagggtctccctctgtcacccagggtgatgtgcaatggtggggtcatagctcagtgcagcctcaacctcctgggctcaagtgatcttcctgccttagcctcccgagtagctgggactacaggcacacaccaccgtgcctggataattttttgttgtttgcagagacaaggcatcttgctaggttgcccaggctggtctcgaactcctggcttcaagcagtcttcccacctcagccccccaaggtgctgggattacaggtgtgagccaccatgcctggtctaaagtgtataatctcaactatacagcttgatgagtttctacttatgtgtatgctcatgtaaaccaccattcaggcccagagggagaacatttccagcacccagagggctctggtgtgcccaggtaggccccctagaggtaaccatggttctgatttcatcaccatagaatagctttgcctgtccttgaatgtcatataaacagaatcattcagcatgaactctattgggtgtgacttcttttgctctgcatcatctctgtgtgattcatttagattgttgaagtggcttgtgctttttcagtgctgtgtactattccactgcaggaatcccatgctgcttccattctcctttcgtggacattctggattgtttttcactgtatctattttacaatctattggagaatatgagctggagcttgtcagcttgaacttgtcattttccaatgaggagacctggagattaggggtcacttagccaatgtcacctgggaagtcacaggctgagctgggataagaccccagtttcttgacacacagctctgtgattccctctccctccgcccataaagggcagaaatacgaactcctgagctttctcggcaaccaagtcctcttattgggcttatggacatgtccgcttatggacggaatcctgactttccctcgccccaagtcagcaggtcacagagaacccaagcagcctctaagatgtcataggtctccctcctgacctgcaataatggcaagaatcaatgtgtcagcggctgcttttcgtcgtgtgcttccgtgagccagactttgcaccaagggcaaatgtgttattcaccctctcagccctgcttccttgtctgtacctcgggaagcaattcagtcccctccccagttatcactccccaaagcagcgcgtagagttctcagagggccgctgcagaggagggggtcgactttgctgagtcgaagcccttcatcataagggcattatcaggcggcagtctgattagaatcacaaatgcctggctagggtagatatgggaggaggggctgattctgtgctgggaaggtgggagtggtgcgggatgcttacccaggtgtggagtgagcccctgggtgggctgcacagggggatggacagagctttaaaatactcagtgtgggtcagaattgcccatcaagatgagagacactaggcgtggtggctcatacctgtaatcccagcacttagggaggacgagggaggaggattgcttgagcccaggagcttcagaccaacctgggcaatatagtgagacccccatctctacaaaaaatttcaaaattagccaggtgtggtggcgcaggcccatagtctcagctgctcaggaggctgaggcgagaggattgcttgagcccaggaggtcaaggcaacaatgagctataattgtgccactgtactccaacatgggcaacagagtgacactctgtccaaaaattttaaaaaaaggaatattctttctaatgagctttctttccctttgtctctctcttctttctttctttctgaagcacgatctcagctcactggaacctccatctcctgtgttcaagcaattctcctgcctcagcctcctgagtagctaggattacaggtgtgcaccaccacacctggctaatttttgtatttttagtagatatgggatttcaccattttgcccaggctggtcttgaactcctgacctcaggtgatcctcctgcctcggcctcccagagtgctgggattacaggtataagctaccacacctggctaaattttgtatttttaatagagacagagtttcaccatgttgcccaggctggtctcaaactcctgacctcagctgatcctcctgcctcaacctctcagagtgctaggattacaggcgtgagccattgtgccccgccttcattctaattttgaacatgcattcccatgggaaataatctgatcacaaaatatgttagaaacaacataagaatcataaagttgtttcttccaatacacagtttatgtataattagttcttccatggcccccgctgcccctggccttcccagatatttacttatcacccactcaatgccagatgctgccgcagagatccaagttgagtaagtctctgctctcagggagagagagacagtcatgtccgggggtggtacagtggctgcgagtgctgtgggcagagttggaggaaccaaagggcggggaccaaatctgtgcagaggggacagcaaatatttgagagtgaaggggccacttgagcaggatgtggaagacgagtaggtggccctcagggaggcaggggtggggaggggagtaggcattctagactttggtgggctaaaggcccagatgtggagagaggcatggctcagcctagggctcaggggttcaggagcgcagggagatccttgcagaaggcctggtgggctcggtcatggagtgggctttgtcccttccagacctcagtccacactgcctttcttttttttcctattttttttttttttttttttttttttgagatggagtctcactctgtcacccaggctggagtgcagtggcacgatctcggctcactgcaacctccacctcctggattcaagtgattgtcctgcctcagcctcctgagtagctgggattgcaggtgcccgccaccactcctggctaatttttgtatttttattttattttattttttgtttgtttatttgttttgagatggagtttcgctcttgttgcccaggctggagcgcaatggtgcggtctcagctcactgcaacctctgcctcccaggttcaaacgattcttctgctttagcctcccgagtagctgggattacaggtgcacatcaccatgcccagctaagttttgtatttttagtagagaccgggtttcaccatgttggccaggctggtcttgaactcttgacctcaggtgatccacccaccttggcctcccaaagtgctgggattacagacatgagccactgcgcccgacccacaccgccttccttccttcacttgttcattcagtaaataccactgatgtgggccctgcgctaaacccgaacgaggggtggggagatgcggagacgggagttcaagggcctgtggtctctctgcaggctgcagttacacgggtcaggtggacagcagcacgtctgcacaggtgtgtcccgtgtgaggctgcatttggctggaagttgtcaccgagtccctggcttggggatgattttgcagacccagggatggcgctgtcataccagctctttgcagaactacctgcctggagaaggcataggggtaaggctttccctgatccttcaagccgtctggacagtggagaccagccccagaggattgtagaacatgacgaggcctttgactctgcctgcctagcctcccagtcactgggcttctggacaagaggcagcactgctctgagcttcctaccagtgatgatgagggtgatgatgaaagctatgtcagcgggatggtctctaaagcctctcccagctctaatcctgccaggaggaggaggaagaagaagaggagcaggaggtggaggagaaggagaaggaagagaaagaggagagaaggaagaggagaaggaggaggaggaaaaggaagactagaagaaggaagaggagggggagcaggaggacaaagagaaggaggaggaagaggaagagtaggaggaagaagagaaagaggaggaggaaaaggaggaggaagaggaagagtaggaggaagaagaggaaaaggaggaggcagaagagggagaggaggaggtggaggaggaagaggaggaagaagatgttggaggctgaggaggaggaagagtaggaggtagaggaagaggaggagaaggaagagaaggaggaggaagaggaggaagaggaggagggagaagaggaggaggaggaggaagaccctggagagggatggaccctgcagcaatttcccaactgggccccaacccaggacaccacctcttgtctccagcggaaagctgcaggatctggtggtgtcgaagccacgtttcctctctgcctgctgggggttacgtgaactgccaaaaattcctaccttgaaaggtaggaagaaatgtcagacttggaaagaaatgatccaacataaaaggcagacttcattaccagccgggtttatttcattctcccctggattcggagtggcttcaaattctcccgggcctgacctttgcaggggaactgaggaatttctcagagatgccaagacagcagtgtgtggcgggggtgccaccggctgccggacaattagtcccagagcctggtcctttggaaaaggtgttctgctggtggagactcgctgggctgtgatgtgatcgtgtcggatgccaaattccacagtcagtccctttcagcagtcacattccttagattcttatcagggattttcccccccaagtgaacactgggaaccagcctccccgctgattgcaggaggatgggaggaaattaaaagcaggaatcctggcggttgtcctggttcgtcaccagcttgccgtgccagcttgagcccttcccttcccctttccccttctctgggcctcggttttctcacctgtaaaaagggggttggggcgggatgatctttccaaggcctctggctgtgaaaattctattttctctttcttttcttctttctttctctttttctttctttctttctttccttcattcttttttcttccttccttctttcctttcttctctttctctttctttctcccctcccctccctcccttccttccttccttccctccctccctccttccctccctcctttcactgcttcctttcatttctttctctctttctctccttctttcccttccttcctccctccctccctccctcccttgccccctttcctttcctgtcctgtcctttccctcctctcccctctcctcccctcccctttccttttctttctttcctctatctttcctcttcctttctttgacagggtcttgctcttttgcccaagctagagtgtggtggtgcaatctcagctcactgcagccttgacctccggggctcaagagatgctcccacctcagcttctcgagtagctgggattagtcacgtgccactatgcccagctaatttttaaatttttagtagagatggggtctcgctgtattgcccaggctggtctcaaattcctggctttaagcaatcctccctcctcagcctcccaaagtgctgggattacagtcatgagccactgcgtgtggccggcaaagtcttaataattctccattcaagtccatagagagatggtttcaggggacaatagacctaaacaaaattctgtcttcacagagtgggagatgcttgtgggacagttgctgcagtgggagattaggagtgggggccttcttgtgtgtcccctccttcatgggggagcattcctccccctgaaatggtgcagctctactaagtctctactaaaaatacaaaaattagtggggtgtggtggtatgtgcctgtaatcccagttaattgggaggctgaggcaggagaatcacttgagcctgggaggcagaagttgcagtgagctgagattatgctactgcactccagcctgggagacagagtgagactctgcttcaacaacaacaacaaaacaaaacaaaacaaaaaaactttttgtagagaccaggtcttgctatattgcccaggttggtcttgaactcctggcctcaagtgatgctcctgcctcgacctctcaaagtgctggaattgcagcatgaaccaccgtgcccagcctaaaccatcttttcaatggcagtcctcttctcttctgttggcccacattttaaaacagcttttatgagagtgccatttattcagaaaaaaagactccaggattatcctggttaaatttcagattaaagcctgatccaggccgggcacggtggctcacgcctgtaatcccagcactttgggaagcctaggcgggcaggtcacttgaggtcaggagttcgagaccagcctggccaacatggtgaaaccctgtctctactaaaaatataaaatttgccggtgtgctggtgggcacctgtagtcccagctacttgggaggctgaggcaggagaatcgcttgaaccagggaggtggatgttgcagtgagccaagatcatgccatagcactccagcctgggcaacagagctatgcaagaagagaagctgtgtccttatttctggacacagttgtgtgaggttgtgaagcctggagcggtggcagccatcttagagccatgaggcaagacagcctggggaaggcagagcaggaggcagggtctttgactgtgtgatgctgcctaattagccaactctgcagccactcacttctcaatatgtgaaatcttaagtgacctggttgttcaagcccaatttatcagtagggtttttacaacgcatctgaaagcatcctcgccaaaacaacctgctgtcaaaacatactatcaaggcgtgagaatgtgagaccgggagacacttggtgtcctggttgcaccatttaccctccccccccaaatggctttgggcaaatctcaatgccacaacctcagttttccatctacaaagtagcagttcaccttcccaggggagccagaagtcccaaagacaatagcaccgatatgaatgtaaatttgtggactgcaaacttctaagcatagcagatgttaccattaaactataaataggccaggcacagtggctcatacctggaatcccatctctttaggaggctgaagtaggaggattgcttgagcccaggagctcaagaccagcctaggctatatagtgaatctccctgtctctacaaaaacaaagtgcgaaaattagctaagtgtaatgatacgcgcctgtggttccagctacgcaggaggctgaagagggaggattgcttgagctcaggaagcagaggttgcagtgagctgtgatcatgccactgcaccccagcctgggtcacagagtgagattttgtctccaaaataaataaataaacaaataaataattgtactttatgggccgggcatggtggctcatgcctatgatcccagcactttgggaggcggaggcgggcagatcacaaggtcaggagatcgagaccatcctggctaacacggtgaaaccccgtctctactaaaaatacaaaaattagccgggcgtggtggcaggcgcctgtagtcccagctactcaggagaccgaggcaggagaatggcgtgaaccccgggaggcagagcttgcagtgagctgagatcgcgccactgcactccagcctgggtgacggaacagagcgagactccgtctctaaaaaaaaaaaaattatactttataatgaaaatataatcataatcctgaactagctctatctcttctggtaaggaaaggagacaagactttttacccacatggtatctacatttttttttttttagagacaaagtcactgtatcacccaggccagatcgcagtggtacaattacagctcactacagccttggactccttgggctcaagtgatcctcccacctcagctccccaaattggactacagacacaagccaccatgcccagctaatttttttttccccaaatgctgatcctccctgaatgctggtcctccctaaatcctgattgtccctgaatgctgatgcttcctaaaatgatcctccttaaatgtgctcctccctgaatgctgatcttttctcacgtggtcctccctcacatgatcctccctaagtgccgaccctatagaaagcgcttggcaccatctctccccctagcctgttccctctggccctcctattaatggcggtagttggggatcactgctgaagtgctcaaaaccacacagcctgcttggccaaatcacatacttctcagctgccccctccacatggaaaactcaatccatcagtggccccgccagcccttcccgccagtgcgcaggcaaggagccgatgctgcctgtggggctggctctcaggtggggtgggccccaaaattccccaccgtggaagctgctggagaataaatgcagataacgaggagggaggaagctgagaggctggtggcacggccgtgctccgtggagtaggtcgtgcactcccggagcccctctccctcctccccggatggaaatccacacaactcctttgcccttcagacctccgtgctgcgccctggaaaccatgtcatcgcctttgtgtttttgcaaaaagatttggtcagtcgccatggagatttcagatcatcttttccctccaaaaatcaatgaccttaacttttcaattccttccctgcggtgcttcgaaatggacagttccagtaaaaactattatgaggaaacgcaggcaggtctatctgctatccaaacactcctactgttttttgtgcccgaaaaactgatcaggccatggtgttacatacactcggctattcctatgtgaacaaaaccaccactccctgcggtgttgaggcggatgagtgatggacaggaacagcagcctcagagacactcattttgctggaagggatgacccgatttgtgccaatttgctcgatggcagacagatgatggagaagtgctctcagggggctgttggggggctatggccatgagcaccttcatggactgtccatttacccccactgggctcagcttccagcttctgcctctccatcctgccccagcaggtactcctggaaccccactctgagttcccttctttaaaaactttccatgtgttggccgggtgcagtggtgcaggcctgtagtcctagctacttgagaggtggaagaatctcttgagcccaggagttctgagaccagcctgggcgacatagcaggaccccatctctgcaaaacatttcttaaaaaaatagctgggcatggtggcacgcacttgtagtcccagctacttgagaggctgaggcaggaggattgcttgagcccaggaggttgaggctgcagtgagctagaattgcatcactgcactccagcccgggcaacagaacaagatgctgtccctgtaaaaaacaaacaagaaaacctcatcctactttccacgttttcacctcctcttttccaatagggtgagtctccaagctcctccagagccaacatgtctccaccttccacccccatcgagtgggtatcctgctcgccccttcaaggatggggtatctactccacccactgtgggcagcccattgcacttgtgggcagctcttcctggcagcgggtacctccttatcctgagtgatgcctgtctcccagcagcttaatgctctgacctgactccatgccctctggggccatgagagcaagtctggtccaactcccctacaggatgttggggcagaaagctggctgccttcaccatggccctccgcttgtctctgctcgatattcctgaggaacctgtcctcaacagccctcacctgttcttctagagagggcaggtctgagcctgaggagccatgggacctccttttcacctggccaaatcccgggtgatgacttttcttcccatggaagctcacggctctaactctgacatcagcctcccctccctcccagctcaatcaccttctgcttgtaggacagtggccatagatatctcctcccggggctctgggtggcagtttctctgcatttctattgaacctcatggcagacacagggagagtcctcagtgaggtaggagatgggatttgactctggaggtggggtgcagacactggaccaaattgaggactagctaaaacagggaagaggtgaaagcacctctccataaaacataccccctagcaccataacgatttaccattgccatggcaacacccagaagttacagcccctttccatggcaatgacctgataacccagcagttagcaccccttcaaagttatcacccggaagttaccacttaatcatatgcaaattaaggggcgggttatacagaaattatgaataacctgcctgttaatttgcataccattaagatgggtataaataggagtgaagctctacctctgagctgctactctgggcacactgcctgtggggtagccctactctgtaaagagcagaacgtctgctgctgctgtgcactgctgctttgataaatttgctaataccactggcttgcccttgaattctttcctaggctaagccaagaaccctccctggttaagccccaacactggggttcacctatactgcatcagtggaagaagattctgagccagagtctaacatggagggtgtttattagggatggcttttaggataaatccctggggaagggaggggactgaggcaggaatgagcagaaggagacgagcctccatataggccaggacagctgccccagaccccatgaggctctgcagctgggatgctctttcagcgttgtccccaggcagggatatgtccaggcttttcaagtgcgcctccaccagtcacaggatggagggtgccccaggaagagctgggaccttggatgaggtgactctgagcagctgaatgatggatgtctgttgacagcacttcctgtagctggggctaaaagcctttctcaatgcaggggatctgggtggcacagcccaacatctaccacaagggctggtgggcatggaggggaacaaggtgtgttcctgatgctattttgctagtaagacagcctgggatggcctttgatttgtagaggccacaactctgttgactcatgctgaacttattgttggcaagaacctctacatcccatctgaggcttgtcctctgggctctggggctgcagtgcaggacttcatatttgcctggttgtatttcatgttgttagacttggctccttgctgcggctgtgcagatctagcttggatcccaactctctcctaagacccaggcccctgtctctgctggctcctggtcttccacagttcccagcagcagtttactgcctccccagtcaaggtcttcctctcctagaggcatggcctcaagaagacagacagccacgtgccaagacccagatcgtctggctgtttagcaaagtgtctaagagttgcccgttgacttgttgttgccttggacatgttatttactccttcctgtgcctcagtttccttctctgtaaaagtagaataataacagtacttaccacccagatttgggtgaagatgatcaggacaccttgcttaggtagcagaatgaggaggggaagagaaaccactccatgcgcttggctggggtctgaaccacactcaactctcatctcactggtttcaaacaggagtagggatagttcctcctccttgctatttttcctggtccttgagggatatgggtaagaaggacctatgaggggatattttatttgctctctgattatccacctgttctcattagcaaagtggatggagcatggggttgggaatgagaagactgagtttcaaggcataaatttactacatactcattctgtgacttgtggtcttctctggagtttcttatctgtaaaattcctgcatgtcacattgttgagaagaccgaacagaagaatgtacatgtattcatttgccagggctgccatgccaccgactgggtggcttaaacaaaagaagtttatcttctcatagttctggaagctggaagtagaagctggaagtagatcaaggtgtgttaccacctgatcagggttctcacccaccatgcagatgcagccaaaatactgaaacagcaggtgttgcagcagagaaagcatttaattatttcaaggcaactgagcgaggaggacaggagatagttctcaaatccaccttcctgagatttcagaggctagggtctttttttttgagacggagtctcgctctgttgcccaggcgggagtgcagtggtgtgatctctgctcacagcaacctccacctcccgggttcatgccattctcctgtttcagcctcccgagtagctgggactacaggtgcccaccaccacgcccggctaattttttgtgtttttagtagagacagggtttcaccatgttagccaggatggtcttgatctcctgacctcatgatccacccgcctcagcctcccaaagtgctgggattatgggtgtgagccaccgcacctggccagaggctagggtttttaaggttggtttggtgggcagggggctagggaatgggtgctactgattggttgggcatgaactcttaagggtgttaaaactatctttgtgcaccaagtccatttctgggtggtggagggtcatggattgctgggccagctggtgttcgttggttcatcagttcatctgaatgcaaactctaaaaagtattgcaaagaccagtcttaggtttcacaataacatgactcctgaatgctaagttattacagaagagcaaactagggaaaaatagtgggttcttgttttaccgtacctgcatcttagcaacttttggttgtcacaaaagaagttacatgactaaggatcattgttcttaagaaaagaagtttattaatcttgttggacagcctgcctgggactaggagaggaaggtagtgaattattagtgactactgtctgttgaaatgactgtacatgtaatcatgcataaaggatgaaaaggtcagagagaaaggaaaaaatatataacaaacatcttatgattgagttctcccgggttcaagagattctcctgcctcagcctcctgagtagctgggactacaggtgtgcaccaccacgcccggctaattttggtgtgtgtgtgtgtgtgtgtgtgtgttttgagacggagtcttgctctgtagcccaggctggagtggaatgtcacgatctcagttcattacaacctctgcctcctaggttcaagtgattcttctacctcacccttccagagtgctaggatttcaggcatgaggcaccacacccagctaatttttttttctaatttttttttgtagagctggggtcttgctacgttgcccaggctgggcaaaccttagttctaacagagcttcttgaacacagttggcaggcaacctcactggcactggcctttctgagggattgggcaggtgtggccaggtaattagaacagtgagggcaggtgtggtgctggggagctgggcctgaagctggacacccccaaccttgagatggctcagatcctgctggggctcaggtcctggcacagaccacagcccagagcagctgctgtggttgagctgagtgactgtggatgggagggctccttctgggatgcaggggttggggtcggagcaacagaactttaccaggcctgccctgtgtccgccgtcttcaggagctgggagtcttcccataggacgaaggctaagacagaggcatacaagggggccctgtgggacaggagaacctttcctggctggagggtcagggaaggctcgcgggagggacacggccacgtctgtgcttgagagcgcgccctctggtggtagatagaggagactgcaggctgggagggcaggaggggccgaggttcaggaccaccatgggaggggcgtcaggacacggacttgcaggcacggtgcctaattggccgtaaggaggcagggaagggagggaggaaaggagaaggtggagtctgggtgatttgctcctggtaaggaaacggggaacttagaggtgctggcctccaagctggaggagcaagtcggggttgaatagtgatggattcagttggattggacaggttggcattgtgtgtactgcagtgtcctgtgggacatgacggtgtgtgaccactgtctaggcaagcaggcaggcacagtggtgactcaacagggggccaggacagagctcaggatgaggaagtggggacagactgtgtggttctggtggaaaggaggggggccctggcaaggccttggggccttgcagaattgcttgagcccaggaggtcaaggctgcagtgagctatgattgtgccactgcactccaacctggacaacagaacaagactccattccaaaacaaaacaaaagaaaaaacaaaagccctggtctctgactcaggctcgggactcaagtgtcctggggagggaggggacgcatgagatcaaccctcaaagcaaagctcagttaggagcactggggcttggaaggccaagcctgaggctggggtagaggtggtgaggtaggaggtggaacttgactccaggggcagagcttggacaccagaccaaattgaggactagctaaacaaaacagatcggggcagaagcgcctccccataagacatgcccaccagtgcgccatgtcagtttcccattgccatgacaacaccaggagttaccacccctttccatgacaacgacccaacaaccctaaagctaccaccctcatcctggaagtttacgcataaaccacccccaatttgcatacaattaaaagtggggccggcacagtggctcatgcctgtaatcccagcactttgggaggcccaggcgggcagatcatttgaggtcaggagtttgacaccagcctgattaatatggtgaaaccccctctctactaaaagtataaaaattagccaggcgtggtggtgtgcacctgtaatcccagctactagggaggctgagacaggagaaccccttgaacctgggaggcggaggttgtaatgagccaagattgcatcgctgcccttcagcctgggccacagagcgagactccgtctcaaaaaaaaaaaaaaaaaaaaaaagtgggtatagatatgagtgcagccctgcctctgagctgctactctgggcacactgcctctggggtagccctgctctgcagggagcaggacctctgctgctgctgtgcactgccacttcaataaaagttgcaacaccactggcttgtccttgaattctttcctgggggaaactaagaaccctccctggctaagcctcaattttggggctcccctgtcccgtgtcaccagggcaatggggggaagaggctgcttcagcagcatctcttagggcagcaggcagcctcggagaggggttgactggtcacattccgagatgggcatgaacctgggaagtgtcctgaagatctctctatcgcatcatgacatgatttcctgaaatcacttagcacttgttttctctattaaccgccaattaaggatttgatggctcagccaagtcacagagccaaacgcctggtggggtgaaagtactgtgcaagcaagccttgagctggtggtggctcgggacggtttgattgctcctccccctaggtgaagtgggccgcctcttgcaagaaaaagagacttgtggccgggcgcggtggctcgtgcctataatcccagcactttgggaggctaaggcaggtagatcacttgaggtcaggagttccagaccagtctggccaacatggcgaaaccagtctctactaaaaatacaaaatattagccgggtatggtggcgggtgactgtaatcccagctacttgggaggctgatataggaaaattgtttgaacccaggaggcggaggctgtaatgagctgagatcatgccatcgcactccagcctgggccacaagagtaaaactccatctcaagaaaagaaaggaaatgaaaggaaaggaaagaaaaagaaaagaagaaagaaaagaaaaagaaaaggagacttgtttgggagcagatccgtcctcaagacctttgctaggagtgagtttactgtcttggaccctccctgagtgctcagctggggagaagggaagggaaatgaggaaggaacattgctgagatgatgcccagagataatgccagtcccttgccatcctgatggaggctgccgggagtgtgttcatttcttggcagttcgaggaccaggcctgccatgtcccagttctgtcctcctgggtcagtccttccaggagggtcgtgaaagggacatgtgtctcctgctaagcacctttctgggtgcagttattttatggcccccagagcactgttcacccactgctgtgcacccgccatagtcaggagctgaggtgcgcaggtgggcggtggcaggacgacaccaccagacagcagacagaggcagacaaaacactcaggacgcagggatcctaggggcaaggcaatgggggtccccacaaccgcggctacctggggatgcacaggctttagagctccatctggaaaggcctggagccctttccttgtctctgcctcccttcttcgttgtttttggccaagttttgatttttggaagccatttccagcccatttaaagaccaaatgttatggggacggtgatttgaggtatttggaaatgttttccaattcacagctcatttctctatggaaagccctgactcagtgtggttcagagatgctggacgacggcctgtctgttctagaaccctcgggcggatctcaggatcccacattaaaccatcctgaggaaagtcacctctctctctctctctctctctctcgctcgctctcgctctcactctgtgtttgtgtgtgtgtgtgtgtgtgtgtgtgtcggagtcttgctctgtcacgctggctggagtgtagtggcacgaactcggctcactgcaacctctacctcccgggctcaagcaattctcccgcctcagcctcccgagcagctgggatcacaggcacctgccaccacacccggctaattttttatttttattagagacgaggttttgccatgttggccaggctgatctcaaactcctgacctcatgtgatccgcccatctcggcctcccaaagtgctgggattacaggcatgagccactgcgcccggctcacctttctttttggaaacacacactgagtgcttgagctggagctgaggctttccagtagaatcaaaggaagggcctaggctgctgaagtctcccacagtttcaggacctttttaattggcagaggtggaattcacagtttgtactgggtaggtgggatcccgccagtcctcgggtcaggaagactagactccctttgcagctcagcctgtggtttgagctgtagctatgggcaatgaagtttaacctcttagactttcttttccatctgcaaactaggactgtctttaagctgttagattcctttgtagggtttaagtaaccagttgattaagaatgatgccttgattttggtaatgctgcatgatttacacactactgactgggatgtgttcatttagtcctgatcataaccccccccctttttttttttgagacggagtctctctctctgtcgcccaggctggagtgccgtggtgcgatcttggctcactgcaacctccgcctctcaggttcaagcgactcttctgccacagcctccccagtagctgggattacaggcgccctccaccatgcccggctaattttttgtatttttagtagagactgggtttcaccatgttggccagactggtctcgaactcctgacttcagatgatctacccgccttggtttctcaaagtgctgtgtttacaggcgtgagccactgtgcccagcctcatcataaccttaaaagttagattttaaatataactgaggctcagagaagggacatcactctgcctaagtcatacagcaggtttgtggcagaacctggttttaaactaggtttcctggtgcctgtgagaagagggctcaacttttcactactttcccttttcttccatgtttttgttttgttttgttttgttttgagacagggtctggctctgtcatccagactggagtgcagtggtgcgatcatagctctctccagccttgatccctgatctcaagcgatcctcctgcctcagcctcccgagtagctgggaccacaggcatgtgccaccatgcctggctaatttttactttttattgtatagagatggggtcttgccgtgttgcccaggttagtctggaacttctgggctcaagtgatcctcccacctcagccttccaaagtgctgggattataggcgtgagccactgcacccaacccctttcacgtatttttgagtgtgctagtactggtaatatgtattttcctagaaaattgtccagtagtcaggatttttgaaattttttgatgtaagattatacctaatatttgcttatacatttaaatctctatatggaatttttttttcttgttcttcatgtctattaaacctgagtttagcagggcatggtggcacacgcctggaatcccagccctttgggaagccgaggtgggacgatcacctgagcccaggagtttgagaccagcctgggcaacatagctagaccctgtttctacaaaaatgcaaaagttagccagcatgttggcgcacacctgtggtcccagctatctgggaggctgagatgggaggattgcatgagcccaggaggttgaggctgtggtgagccatgatcatgccactacactcctgacctcaagtgatccacccacctcggcctcccaaagtactgggattacaggcatgagctaccacacccagcctgaactcatgtctttcttcagctcttgtaaattttcttgttatttcttcaagtacatgcttctctttgttcttttttgatcatgccttccagagctactactatatagatgttggtccttggtcttcctctaggtcccttgttgcctgtttctgcctgttttccatctccttttctttttgcagtggctactgggaaaggtcacagcttagatttgcagctcatcggtttgccctttagctgtttccattctgtttttcatagtcatacatttcacttctaagataatgcatttttttaatttcattttttttgtgtgtgtatgtcacagggtcttgctctgtcacccagtgtggagtgcagcggtgcgatcatggctcactgcagtctcaaactcctgtgctccagcgatcctcctgcctcagcctcctgagtagctgggaccacaggcatgtcagggaccatgcctggctaatttttgtatatttttgtagatacagtgtttcaccatgttgcccaggctggtctaaactcctggggtcaagctatccacccgcctcagcctcccaaagtgctgggattacgggtgtgagccaccatgcctggccagaattttttagtgagtgatacattgtcttatttctttgaggacattaattatgctttaaaaaattatctccatctatttgctttactattttttaaggggatgtgatttattgcctgttgagttggtgcctttcttccatgatactggccttttttcctcaaataatttgaaagtcttggtatctggggttttccattagcttgtttctgtttcctgagaatttgtctgttggtgggctggaggtatggatgaagaatgggaaacgagtgtgtaagaattcatttatctgtctgactttgagagtgaccctgtttctcctggaggtcacaagcttttttttttttttcttttttccatcccccaagactgaaaggtcaccagtttttgaggtcagccagcacccactcctgtgaccatacctaccttaggacaggtgaatccaatgcctaatatcttttttttttttttttaaatagagacagggtctcgctctgtcacccaggccaaagtgcagtggcactatcatatctatgtatctctacatatctatagatacaggtatatctatatatctagacatagatatagagatatatctctatatctagacatagatatagagatatatctctatatctagacatagatatagagatatatctatagatatctatatctataatatatttatatcttgagatggagtcttactctgtcatccaggctagagtgcagtggtgcgatctcggctcactgcaacttctgcctcctgggttcaagtgattctcccgtctcagcctcccaagtagctgggtctacaggtgtgtgccaccaagcctggctatttgtttttgcatttttagtagagacagggtttctccatgttggccaggctggtctcgaactcctgacctcaggtgatccgcccactttgacctcccaaagtgctgggattacaggcatgagtcaccatgcccagtcgtatatatatactttttgtagagacaaacaggatcttgctatgttgcccaggctagtctagaattcctaagctcaagcgattctcccaccttggcctcccaaaatgctgggattatgagtgtgagccaccgcactcagcctccaatgcctgattcctgaaaccagcagggacaaggacccgggtcctacctgtccagctctttctatggtggtcccctaaccaatctctctgatggtcacctttgggtccctctctacctcctcatctgcatctgtgcccccatgtggctcctagcttcagccccggtcctcttttgtgtgtttctggctgtgatttttgccttcaatgtgggcccatctactttctgtctcttagggacccctccaaatgtctggcccattgcttctctctttccaatgcccttgaggactttttttcttattttattttattattatttttagacagggtctcgctctgtcacccaggctagagtgcagtggcatgatcacagcttactgtagcctcaacctcctgggctcaagtgatactcctgcctcagcctcttgagtggctaggactataggcgtgtgccaccacaggtaatttttaaatatttttgtagagatggggtctcgctatgttgcccaggctggtctcaaactcctgggctcaagtgatccatcctcctcggaccccaaaagtgctgagccaccacccggccagggacttattttttaattttcaatttctaggctatggggatgggaggaggaggtgggagcaccttaacctgatcccgtattgtttgtgtacgtcccttcctctttcctcctctccactgcccaagcttgctgccccttgcttcttgtactctgaaggcatttattccctagcccggcaggtcacatgtctcttcctttctcctggctcctccccttccttcagccttctggctctttctttctttctctctctctctctctctggctctttcccttcctccctccctccctctctccttctctctctctttctctctcattcctcctcccctcccctcccctcccctcccctcccctcccctcttctcccttcctctcctcctctcttcagggtttcactctgttgcccaggctgtagtgaagtagcatgatcatagccactatgatcctgggctcaagccatcccctgccccagcctcctgagtagctgggactacatgtgtgtgccaccacgcctgggctaattttttaatttttattttgtagaggcagggtctcactatgtggctcaggctgatcttgaactcctgggctcaagagatcctcctgcctcagcctcctaaagtgctaggattacaagtgtgagccactgtgcctggcctggccacttcccattgcaggcaagtctctagacttgccgtggtctctctccgctctgtgcctgttacaccgctgcttcccctgctggcttcgtcccctctcacggcccccacacattggtcagttggtcggttggtcggttggctaacttatcttgcactactcagctggtggcctcagggcctgctgggcgagatgccctgctccgttcctgtagcttgtgtgttcaccacgtggtggaacgtgttacctgctgttcctatggactgtgtcatctcctctccccaccagggtgagatttccacgggcagggctgagtctttctcaccaattccacactgagtggtcagtgacgggaatgatgccagggcttggtggccaagggttgcaagtgttctctcttcccctcagaccgagacagagggtctcagtgggccccccatccaagagagcgagcctccaccccaggtttgcgggggcccctccctgtccagcacggccccctgacccgaagttggcagctctgggaacaggcagggctcatgtgactgttgctctctccacaggcactggtgccatcacacagtgacacggacggtgtcctgccaggtgcagaatggctcggagacggtggtccagcgcgtgtaccagagctgccggtggccggggccctgcgccaacctcgtaaggtaaaggccgctgggctaggctgctctgcccttccctcccattccctcggacaaaaccagtcccaggatggctctgggagaggctgggctgtgctcacagacaaaggctgagcatgcatttatggagcaccttctgtatataaggcatgggtgtgtgtatatagggtatatatgtgtgtgtgcaaagatgtcagagacatgctcctaccgcaacagaaccacacaacccagtgggtgtttgacagacagaagaccaccacagatgagtggggtatgggatccgaggtcggggaaggccaggtggggttgaagagggaaccaaccagccttatggctccaggctggaacgaggggctacaatgaccttggaaatccagcctgtctttggccccatccatcacaggcctcgcccctggcagcactgccccactcaccaggcatgtccctctcactggccctacttgttactggacctgcccctcacgaggcctgcctttcaccagccctgaccctcatgagccccacccttcaccagccctgcccccaccagccttgcccctcaccagctctgcccctaccagccacgcccctcaccagccacacccctcaccagcccctccctctcaccagccccgcccatagtcagcccttccctctcaccagcccctccctctcaccagcccctccctctcaccagccctgaccagaccacaggcttcagggactcttcagcatccgcagagagatcttgctgtcagacaccagcattcacggtctccaaagttccaactctccttcttttcccttcttcctcctctccaggccgtgcttagctccagggactggcttccccaaaccactctccccacagcctgcccagcctggggcctctaccccaagcaccgtggagccgctgtcctcaaactccaaatcccttcccctcctttgtgccctccctaacgggacattttgcctgggtcagggttctccagagaaccaataggaagggatgggggagagggagagtgggagagagattgaaatggtaaggaattggcttgtatgattatggagactggcgattattccaaacctgcagggtgggctggctggctgagacccagggaggagagctgatgttgcagcttgagatgggctggctgctggtcaaatgcctccttcctccggggaagtcagtctttttcttaaagccttcgactgattggacaaggcccacccacattatagagggcaacctgctttactccaagtctactgatttaaattaatcttggctgggtgcggtggctcatgcttgtaatcccagcactttgggaggatgaggcgggtggatcacttgaggtcaggactttgagagcagcctggacaacatggcgaaacccagtttctactaaaaatacaaaaattagccaggcgtggtggtgggcgcctgcaatcccagctactgaggaggctgaggcaggagaatcacttgaacccaggaggtggagattgcagtaaaccgagattgcgccactgcactccagcctggaaaaaaaaaaaaagaaattgctacgtctcatgactggtgatgttaactttgatcgcttgcttatgatggtatctaccaggtttctccactgttgcataattatctttccctttgtcttttacatgtatgttgtggggagacattttaaacctatacgaacatcctgtttctcatcatactatcatattgcttgcaacagttaatgctatggtgtttgccaaatggtgatttcctattttcattcttctttaatagtagagatgcttcacttgagacccctattgcatacaagtgttttgatacaggtcattctgcaaggggaatggctaggtaaacggaatgtcattcattttcatttttattagaaacagctgcttttgccagttgcggtggctcacgcctgtaatcccagcactttgggaggctgaggcaggtggatcacctgaggtcgggagttcgagactagcatgaccaacatggtgaaacccagtctttactaaaaatacgaaaattagccagacgtggtggtgggcacctgtgattccagctactttggaggctaaggcaggagaatcacttgaaccgggagaaggaggttgcagtgagctgagattgtgccattgcactccagcctgggcaacaagaacaaaactccatctcaaaaaaaaaaaaatgctggttttaaatgctatactagagagatggcagtgggtccaaaatgaaaaaaaaaaaaaaaaaaaaaagctttttccttttcagcagagggtacagacactccctatcccctgccttccccacttccccaggagctaaattccaagactctcctgcctttctcgtcagcagggagtttcagattaccaggtcatggcctcttgatttgggaacagcttctgagaagaaaagtctttgaagtctgatctgtctgtgaccctgacaggctgggctttggctcagagctctgttggagaagtggctgtcctactctttctttctttctttttttttggagacaggatcttgctctgttgcccaggctggagtgcagtggtgcaatcatggctcactgcagcttccaattgctgggctgaagtgatcctcctgcgccagcctgaatagctaggactacaggcatgcatcaccgtgcctcactaattactttttctttggtagagacaggggtctcgccatgttgcccaggctggtcttgaactcctggcttcaagggatcctcctgcctcagcctctcaaattgctgggattacaggtgtgagccaccatgcctggtctcaacaagttaaagctgttacactatcaaaacacaataacgcagccgggcacggtggctcacgcctgcaattgcagcactttgggagtctgaggcgggtgaatcacctgaggtcaggagtttgagaccagtttggccaacatggagaaaccctgtctccactaaaaatacgaaaattagccaggtgtggtggtgagcacccgtaatcccagttattcaggaggctgaggcagggagaattgcttgaacctgggaggcagaggttgtagtgagccaagatcgtgccactgcactctagcctgggcgacagagtgagacttcctctcaaaacaaaaaccaaacaaaaaaaaagaaaaatacaataatgcacctataagaaaagctggacaagctagcgcctgaatcactgacctggactgaaaatttttcaagtgatcattaatgttgcatagttgttctctcctttaccacttaagtaattatctgaacaatgtttcagaagtgctggggtccggcccggcgtggtggctcacgcctataatcccagcatttttggaggataaggtgggtggatcacacggtcaggagtttgagaccagcctggccaatatggtgaaatcccatctctactaaaaatacaaaaaaattagctgagtgtggtgccacatgcctgtaatcccagctacttgggaggctgagggaggagaattgcttgaacctggcaggcggaggttgcagtgagccgagatcgcaccaccgcactacagcctgggcgacagagtgagactccgtcgcaaaaaaaaagaaggaccggggtcttcgatgtggtgttcactgactttccagggagttcttctcactcactccttggagttcggaggccaaaacagaacattcagtcagggctgacatgaatttgtcataagtctcccctttgcctataacatataactagtgggaaccttgctaattaaaacaatttggccagtgacagtggctcacacctgtagtcccagttacataggaggctgaggcaggaggattgcttgaggccaggagctcgagaccagcctgggcaacacagtgagacccaccccatttttacaaattttttaaaaaacatcagccatgggttgtggtgcgcacctgtacttgggaggcttaggtggaaggatcgcttgagcccaggagttcgaggctgcagtgagctgtgattgtgccactgtactccagcctgggcgacagagcgagaccgtgtctgaaaataaataaataaatacaataataaaacttaattttcattctcttagagaaatcccaaattgctgatcttaattgtcataatttctgctgttattatattttactagggaatgggccgggtgtggtggctcacacctgtaatcccggcactttggggggccaaggagggtggatcacctgaggtcaggagtttgagaccagcctggccaacatggtgaaaccctgtgtctactaaaaatacaaaaattagccaggtgtgatgatgcacacctgtaatcccagctactcaggaggctgaggcaggagaatcacttgaacctgggaagcggaggctgcactgagccaagatcatgttgctgtactccagcctgggtgacagagcaagtctccgtctcaaaaaaaatttaataatttattagggaaggagaggttaacacagttttctttctcactagtaactcataaatgagctagaattgggtgcacaccctctgtctgtggccttggggctgctgtctgggcagggagaggcaagatgacaacaggttgcagcattatcctttggtcccctggggttccatatgcattcctgtctcaggtcctggttttgctggccttgcctatatgaagcatctggtttgtggcagccatctcactggtctccccactccccaccctgccccgctctagctccttctctccacagaagctggagggatattttattttattttataagggtcaggatctccctttgtcccccaggctggagtgtagtggtgtgatcatagctcactgcagccttgaactcctgggctcaagcaatccttctgcctcagcctcctgagtagctgggactacaggcacacaccaccatgcccagttaatttaaaaaaaattttggccaggcgcggtggctcatgcctgtaatcctataactttgggaggctcagatgggtggatcacgaggtcagcagttcgagaccagcctgcccaacatggtgaaaccctgtctctactaaaaatacaaaaattagccaggcgtggtggcgggtgcctctaatcccagctactcaggagactgaggcaggagaatcgctttaacctgggaggcagtgttcattccctggccgaattgctcatcgtctgcccgctctgctagtctgggagccttaggaggtccgggactgtctcattggctgctgtgttccccatacctggcttgcaggagatgaagcagcattactgaattgaggttaggttaggaggatgaaatcagatcagagatgtcagagaactctgggttttgttttagatggagtctcattctgtcacccaggctggagtgcagtggcgtgatctcggctcactgcaacctctgtctcccaggttcaagtgatcctcccacctcagcctcccaagtagctgggactacaggtgtgcatcaggacacctggctaatttttttttctgtatatttagtggaaatggggtttcaccatgttggccatgtcggtctcgaactcctgaactacctcaaatgatcggcctccctcggcctcccaaagtgctgggattacaggtgtgagccaccatgcccggcccccagtgcttcttagcataatttttttttttttttttggagacggaatgtcattctatcacccaggctggagtgcggtggcgtgatctcagctcactgcaacttctgcttcccgggttcaagcgattgtcctaccccagacttctgagtagctgggaccataggtgtgtgccaccacacctggctaatttttgtatttttagtagggatgaggtttcaccatgttggccaggctggtctcgaactcctgacctcaagtgatccacccatcagcctctcaaagtgttgagattacaggcatgagctgctgcgtcaggccagcataattttttagcatagtttttcagttttcttaagagtctgctgcaagagtctgcgtgctgggtagaattccctgagcgagcagagcctgggtgggaggaactcggaaggttcctgggagcactttgaggcagggtctgtcttctgcactggtttccccatggctcataatggcttgtgtcatcactataaatgacgttaccaaaagaagcttcaataacgggggaatattcacctcacaatctatctgggagaggcggccaggtctcagccatgaagatcctgggatcctttgactgaactctccacccacacctgtgtgtccaccatgaccttcctcaaggtcgcagaagggcagcagcagctccaggcatcacgtctcacaccacagtgtcccaaaaaagagaggaaggggatgggacacagttttctcctatcagagagtacagccttttccagaatccctagcagacttccctggatgtctcattggtcaacatttttcctctgagcctcagtttctccagggctaagatggtggtgatagaaggctgcctcaagaggttcttggaaggggatgtgaggtttgcaggggaaggtcctgcactgagccttgctgtaataagaaccctgggaatgcagactgaggccaaagtatgggtgagctatgaagagaatcagaagcaggtcccagcacgtcagccgaggcagctcccagcgggcagttctggcctaggcatgccttgatcttgcattccgctctctgaggttagggtggcaaaccccagctgggccctgtgtagccgccttgtgtggtactctgttgcttaccatcctgcctgctcagtgtgtcttgctacatttcacccccagcatttacatagaaatttgcaaatgtgtgtatttcttgtctgttccccctcatcatttacttatttatttatctttaagagagggagcctcactctgttgctcagactggagtgcagtggcacaatcatagctcactttggcctcgaatgcctggactcaagtgatcctcatgccttagcctcccaactgggtgccatgatggatggatgccatatgcctggctaattaaaaaattttgttttttgtagatatgagatcttgctttgttgtccaggctggtcttgaactcctggcctcaagtggccattccacttcagcctcctgagtagctgggactacaggtgtgtgccaccacacctggttaattaaaaattttttttggcggggcatggtggctcatgcctgtaatcccagcactttgggaggcccaagtgggcagatcatttgaggtcaggagttcgagaccagcctggccaatgtggtaaaaccccttctctactaataatacaaaaattagtcaggcatggtggcaggcacctgtaattccagctactcgggaggctgaggcatgagaatcacttgaacccaggaggcggagattgcagtaaccaagatcgtgccactgcactccagcctgggtgacagagtgaaactgtttcttaaaaaaaaaaaaaattattttttgttttagatatgggatcttgctttgttgccgaggctggtcttgaactcctggcctcaagtgatccacctgggcttcccaaagtgctgggattacaggtgcgagccattgcacctggctgtcttcaccattttcaggagctgtaggggacccaattctggttcccttcattctttgaagcattttggatgctttcatttgtgttggcttaaaacttttgtgtggaaaagagaatggagtctgctcctcatggtgtgactaatgtaaacagcctctcctggttcccctcttcctacgacacatttcttttgctattttacacatttgtgatttctacggcgtgagtatattctagatttattgtcatgataacacaagaaagagaaaggggaaagtgtcttccaggttgttccccaggcttttttgggagttggaggtgtcaacttaagcaacagagagaagccctctgaaagaaatgacagcccgggcaacatagtgagaccctgtctctacaaaaattttaaaattagctgggtgtggtggtgcatgtctgtagttccagctactcaggaggctgaggtgggagaatggcttgaacctgggaggtttgaggctgcagtgagctatgattgcgccactgcactccagcctgggcaacacagtgagaccctgtctcaaaaaaaaaaaaaaaaggcaaagagaatgatatttatttgagaatgggcattgcaacgggagtatgcatgcatcgtaaatgatgcgggtattcagggaggaaaaggaagataagggtttttaaagaaaaagtgagaagtagataattgttctgaatcaattatccttggctacaagtatcaaaaacaagggtggtgtcagttcaaggttggacaggcagtcgctgggtagatgtaaatatatttttgtgcatgtgtaaggttgtggtggactttgtgcaaggttgtggtttttgcagtcttttgtggtcgtgtgtgtgtgtatgtgtgtgtgtgtgttgagacacagtcttgttatgttgctcaggctggtctccaactcaagcaatcctcctgcctcgctcggcctctcaaagtgtgaagattacaggcatgagccaccgcacctggcccgcaaataattttatcccattccctggcttgtattttcatcctctaaacagtcttttgaagagcaaaagtttttatgtttgatgcaatctaatttatcaattttctttttctttctttcttttttttttttttcttgagacggagtctcactctgttgccaggctggagtgcagtgacgtgatcttggctcactgcaatctctgcctccaggttcaagcagttctactgcctcagcttcctgagtagctgggattacaggcacctgccaccacgcctggctaatttttgtatttttagtagagacagggtttcaccatgttagccaggctggtctcaaactcctgatcttaagtgatccatccacctcagcctcccaaagtgctgggattacaggtgtgagccaccatgcctggcctctgcttttttttctaaaagttttatcgttttctgtttcacatttaaattcatcatacattttgagttattttttgcataaggtgtgaggtttaggttgagttttatttttttggcctatggatgcctaattgttctagcaccatttgttgaagacgtctcctttattgaattgcttttatagctttctcaaaaatcatttggacatttttttttctttctaagttctctgttctggtccattgatctgtgtaactagtgttttgccaataccacacagtcttgattactatggctatataataagttttgaaatcagatagattgattcttctcactttattcttttttttcctttcttttttactttttttttttttttttttttgagacaggattttgctctgtcgcccaggctggagtgtagtggttcaatcatagctcactgcagccttgacttcttgggctcaagtgatcctcctgcctcagcctcccgagtagctgagactacaggcacatgccaccatgcccagataattaaaaagaatttttttttgtagagataggatcttgctacattgcccaggttcgtctcaaactcctggcctcaagcagtcctcctgccttggtctctcaaagtgctgggattacaggagtaagtcaccatgcttggcctccagaattgttttagctattacagttcctttgtcttttcatataaatttcagaataatcttgtctatatctaccaaaagtcttgatgggattttttaaaataggaattgcatttaacctgtatatctatttggggagaattggtatttttagcatgttgagtcttccaatccaagaacatggtatctctctccatttacttagatctctttttatttcttccagctttcttcattgatttctttgatatcttgtagttttgggcatacaaatcttatacttattttgttagattcatacctaattattgcattttctgtgtgattgtcagtggtattttttggtaaaatttgtaaagctgtatttttaatttctttctctctttctctctttctttctttctttcgacggagtctcactctgttgcccaggctggagtgcagtgtagtggcgcgatctcagctcactgcaatctctgcttccagggttcaagcgattctcctgcctcagccccctgagtagctgggattacaggcacgcagcactgcacccagctaatttttgtatttttttttttagagacgggtttcaccatgttggtcaggctggtcttgaactcttgacctcatgatctgcctgcctcagcttcccaaagtgctgggattataggtgtgagtcaccatgtccagccagtatttttaatttctatgtccatatgttctttgctagtttataaaaacacaattgatatttatatattgatctcgtagcctgtaatgcagctgaattcactagttctgaaaggttttttgtagattccctgagatttgctatggaggcaatcatgttgtttgtcaacagagacagtcttattcctttccttttgatctgtatgccttttattttattttatttgagacggagtctcgctctgtcacccaggctggagtgcagtggtgcgatctcagctcactgcaacctcacctcccgggttcaagcaattcttctgcctcagcctcccgagtagctgggattacaggtggcccaccaccatgcccgctaattttttttattttttatttttaatagagatggggtttcgccatgttggccaggatggtcttgaactcctggcctcaagtgatccacctgcctcagcctcccaaagtgctgggatcataggcatgagtcactgcgcccagcctgtatgccttttattttattttcttgcctgtgtactggctagacttgtagcactatgttgaataggagtggtaagtgtggagagaattgtttgttcacaataaaacattctgctactaaagatgatattaaatgtaaggttttctttttgcttttctttctttttttctgaaacaaggtctctttcttttgcccaggctggagtgcactggtgcagtcatagctcactgcagcctgcagcctcgacctcctgggcttaagcaattcttccatctcagcctccccaatagctgggactttgggcgtgtgccaccatgcccagctaagttttgtatttttagtagggatggggtttcaccatgttgcgtaggctggtcttgaacccctgagcttagggagcttcctgctttggcctcccaaagtgttgggattaacagaggtgagccaccatgcccggctgtaaggttttcaaagatgctttttatcaaattaaggaagttttcctcttactatttttctgagagttttttttttaattatgggtgttgaattttgtcaaatgccttctttgcattgattgatatgatcatgtgatttttcttcgttaggctgttaatatgatgactacattgagtaactctcaaatgttgaagcaatgttgcaatcctggaataaactctacctggtgataattttgtgtttgttttagagatgggggtctcgttttgttgcccaggctggggtgcaatggtgtgatcatctctcactgcagccttgacctcctgagctcaagcaatcctcctgcctcagcctcccgagtagctgagactacaggcgtacaccaccatgcttggctaattttataatttttttttttttttttggagacgaagttttgctctcgttgcccaggctgtgagtgcaatcttggctcactgtaacagttgcctcctgggttcaagagattctcctgcctcagcttcccgagtagcggggattacagatgcccgccaccatgcccagctaattttttgtatttttagtagagacagggtttctccatgttggttaggctggtctcaaactcctgacctcaggtgatccacccgcttcagcttcccaaagtgctgggattacaggcatgagccaccatgtccatcctgatttaggttttgaagagatccctggctgctgtgggaagaatggacattgacccggcatgagatgatggtggctcatgctagggggatatctgaggacatgaagaggagtgggtggatccaggaggtattctggaagctgagatgacaggaatgtctggtcccttaatggcagggagcaatcagggactaccctaaattcctggcttgagcagttggctggcagggcatgccatttattgagatggggacactgggaggatgtcaggcatgagaggtgggagccggcagctgtgctttggctgagttgagttgcctgcaagccatccatagggaaagggtatcaagtaggaggctgagtcccaggaagaagccagagcgagaggcagattatatctcagagatcctaagatgccattggtagtaaaaagtgcattctttttttttgtttgtttttttgagatggagtttcactcttgttgcccaggctggagtgcaatggcatgatctcagcttactgcaacctctgccttctgggttcaaccgattctcctacctcagcctccctagtagctgggattagaggtatttgccaccacacctggctaattttgtatttttagtagagacagggtttcgccatattggtcaggctggtctcgaactcctgacctcaggtgacccacccgcctcggcctcccaaagtgctgggattacaggcgtaagccactgtatctggtgaagaagtgcattcttttattatggttaagaatgccactggaccggacgtggtggctcactcctgtaatcccaacacttcgggaggctgagatgggtggatcgcttgaggccagaagtttgagaccagcctgggcaacatagtgaaaccccgtttccactaaaaacagaaaaaattagttgggcatggtggtggccacctgtaatccaagttacttgggaggctgagatgggaggattgcttgagcacataaggtagaagttgtagtgaaccaagatcataccactgcactccagcctgagcaaccagagccagaccctgcatcaaaaaataaataaataaagttgtgggactggaggtgaccatggagatgaataaatggagaagggatactggcctcagaagagtcctgtgcatcccagccttacaggtggggcttaggaggggaggcaggtgtcctcctggtgtcctgggaggtgtttccagagggagggtggaacagagaatgcactgtcccagatgcttctgagacaccccataggatgagggcagaggagtaatcattgggtttggggtcactggagaccctggcaaatgcagtttttgggcagtgatgcttataaaccactgagaatgatcctcagaaaggggagaaaggctggggcaggcggggaaaggacagctgcagggaccaatgctggagaagccgagcagggtggctcggagaaagaggggggccctgtcagagcagcaacaggagggaaggccacagcaggggtgcccacgcagggggatccacagaacactgaaagtgatttccaggctgactcttcccaccaacccaggagtgccttgaaggcaggatgctctgtcctcatctcattattcccaggactttactacatggaccagcacattgaggtgctcaacaatgttcattaaatgaatgcgttcatcttcttgtgagatgaaaggaaaataggtatctgtaatacaaccattttctttgtggattttcccatctggtgattactcccttcccttccctccctccctccctccctccctccctccctccctccctccctccctctttctttctgctttctttctttttctttctttctttcttctttctctgtctctctttctctctcgttctttctctccccttccttccttccttctctctctctctctctcccgccccacctctctctctttttcccttcctccctccctcctgtctctctctttctctttgtctttgtagagacagggtcttgctctgttgcccaggctggagtgcaatggcacaatcatggctcactgcagcctccaactcctggtctccagtggtcctcccatctcagcctcccgagtagctgggactacaggcacacgccaccacgcttggttaatttctttttgttcttattttttgtagagacagggtctcactgtgttgcccaggctggtcttgaactcctgaacgcaagtgatcctcccgcctctatctctcaaagtgctgagattataggtgtgagccactgcgcctggcctgatttttttttttttaataatattagaatgttgtattgtgtgtgagtgagtgtgttggtgaggagagaaggcggcactcaaaactaacgctcactagtgagcatggggacagggtgcgaggcagggtgcccagtcaacagcatgatgtggacaagaatgcaggcacctgcctgctccggttgggtgtactggggacagtgaccttacctggggttttgcagatcatgtgttcatctattcaattgttcattcaatgttgtctgagcagtgaagggccaggaactagtgtgtagagagaacacgatcctctcctcgtgtgtacagggttgatgcggggaggacatgttcaaagattcacagcattggagggagacctggtccgtgggtttcccttgggagtgacatttagcagagacctgggggactaggagatttcactaggggaagagatgctggtgaggaggaaagagctctgttcagggttgggcgtggtggctcacgcctgtaatcctagcactttgggaggctgaggcaggcagatcacctgagatcaggagttcgagaccagcctggccaacatagtgaaaccctgtctctactagaaatacaaaaattagccaggtgtgatggcggttgctcctagctactcaggaggctgagacagaagacgtgctcaaacccgggaggcagaggttgcagtgagctgagattgtgccactgcactccagcctgggccacagcgagactccatctcaataaaaaaagaagacagctgttcaggccatgtagtcgcccctggaggaagcccctggctggaggcagacaccctgggccaaccccctccctgctggctgggaggctggactggactgggtgactttattgccagggtcggggactcaaaggcagacagacaaaccatgcttccctcctccgtgcctcagtttcccatcctgggaaatagaacccccccaccttcctctggagtggatcacagccccggctgggctctgttcattgcagtggggacgttgggcgtcacggacattgggtgtcactgacaccaccctagtcccctcctaaacccctcggttggctgctggctgggacgggctggggctctggggcctgatagacttagaaggacaagtcccagggactcggggggttaagttttcttcggccgggcttcccctgcccttggctgtctcccaggcccctcggagtcctttgatggcattagagccaaccttttccagatgtgctgagcagagggatttgccggaactctccggggcttcatctgcctccttcattcccctctgccagacggccccctgcccgccagcctcccccctctggttgggtcgcctgctgttcaggatggatgcccgcaaggcaacacaaagtcctggattgaagtgctttcttaaaacatgctctttcttccctgcctctcctccttagcgggactgtttgggttgagaagctcaccatggctgcccaccccaagcagtgggggcctgtctgggctgcatccactgcaccaccccgcaccgcccccaggtggactgtgaccctgggccagagggtgaggtgaggtttggcagaagaccctgcccactgggcccactgtccattccgtctggctctcgggaacgtctagcttggattctggggaggctggaggcctcagaaatgcagtgggaagcccctttcccctccccgctggcctgcagctattaatcaagagattaataatcccctgcctcccgctctgaaacctccactctcgtttcctgttgagtctccagcctgactcggaacctcccagtctgtttctcccctcgtgggggttcctagtgaggaagtggaggccaggggaggagtcgggggcgggcaggcatggaggctgagaaggggtacgtgcccagtgagggaggggcatctggctcccccaggcaaggttctgggctggcagagtcattctgagcaggcgatccctggatggtgcaatgtccccccgcacccgaggcaggacttcgtgacgctttgggccacatccactttggagaccagagagccaagacctctgcttactcacctccagtgatggggacctcatttctccggggagccctccccaccagcatttcattttttttttttttgagacagagtctcactctgtcccccaggctggagtgcagtggcacaatctctgctcactgcaacctccacctcctgatttcaagcaattctcctgcctcagccccctgagtagctgggattccaggtgtgcacaaccatgcctggctaatttttgtattttcagttgtgacggtttcaccatgttggccaggctggtctcgaattcctgacctcaggtgatccgcccgccttgacctcccaaagtgctgggattacaggcttgagccactcccagactgagactgcatccaggcaccctgttcgttgaatgcttcgttctttccaccagtcttcactgggtgcagacgatgtgcctcgctctaagctaggcaggcggtgtagccagtggctccgtggagaaggatgtcagacaaataattacatacatgggtgtacaatcataagtgcttagaagagaagtctgggtactttgagggtgtagattgaagaggcccagcttgctgtagggtggaagggaccgagtgtgggctagtcagggtgggcttctaagaggaggcagcactttcactgagctctgggaggctgcatgacttgggcagagacagagcacatgcacacagggccagtggagtcctgaatgggggcggagttccgaatggggggcggagttccgaatgggggcggagttctgaatgctggtggaattctgaatcgggcggagttctgaatgggggcggggaggagctggtggccaaggagaggaggagggatggccaaggtatacagtagccagatggcagaagtccacaaggttaggcttaggatttgggtattgtcctaagattttttttcttttaagagacagggcctcactctgttgcccaggctggagtgcagtggtacattcacagctcgctgcaagctcaaactcctggactcaagtgatcctcctgccttagcctcccaaatagctgaaactacaggcacgtgccactacaccccactaattttttttttttttttaagagacggggtctggctatgtttctcaggttggtctaaaactcctggactcaagcaatcttcccacctcagcctcccaagtacgtggggactacaggcatgcaccactatgcctggctaatttttaaatttttggtagaaatgggggtcttgctatgttgctcaggttggtcttgaactcctggcttcaggtgatcctcctgccttggcctcccgaagtgttgggattacaggcatgagccactgtgcctggccttgtcctgagattgaagaaaagctaggagaggttcaaggacatttctgctttaaaaacgtcacttggagctgggcgaggtggctcatgcctgtaatcctaacagtctgggaagccgaggcgggcggatcacctgaggtcgggagttggagaccaggctaaccaacatggagaaaccgcatatctactaaaaatacaaaattagccaggcgtggtggtgcatgcctgtaatcctagctactcgggagactgaggcaggagaatcacttaaacctggaaggtggaggctgcagtgagccgagattgtgccattgcactccagcctgggcaacagagcgagactccgtctcaaaaaaaaataaacaacagtaaaaacaaacaacaaaaaagcatcacttgggagaaccagagagggagggaggcagatggggtatatgtggaaagatggggtatatgcagtcaagggtggggtgaaggttcagggctggctcctccactttctgttggtgtggaccaagtccagctctgcacctacctgccgcacagtctctggtggactcagtgttttcatccataaaatgggacagtaatactctcaggtgtgagtgggccgagtacgcaggcattcagtggctacagcccccttaagttcccctttcttttctttttgtattttttttagacagtctcaatcttgcggtccaggctggagtgcagtggtgtgatctcagctcactgtaacttccgcctctcgggttcaagcaattctcctgcctcagcctcccaagtagctgggatcacaggcgtgcacaaccacgcctggctaatttttgtatttttagtagagatttttagtagagatggggtttcaccatgtttgtcaggctggtctcgaactccaagacgatccacccgtctgggcctcccaaattgctgggattacaggcgtgagccacagcgcccagccccctttctttcctgagctgattttgccatccttaaaatgggcatgtagaacattttccagggaccagtgaggggctcgcccaccttcagctcattcctggagtctggtggttttggcagacagactctaggaggaccaccccaccttggggtttgtttggacccacaccaggctgaatgtaatacccaggaaaagcctcagctctgcatcctgaaggggtgccaacagacccaggagagccagatccctagtcagtcgattgatagtgatatgtacctcctgggtgctgggcagatgtggtgggagaccttagaaaggcttcctggaggaggtgacctagagagagacagaaagagagagagacaagaaagaccagcccctcagagggcaatagggtgaaaccccgtctctactaaaaatacaaaaattagccaggagtggtggtgcgcacctgtaatcccagctactcgagaggctcaggcaggagaatcacttgaacccaggaggcggaggttgcagtgagccgagattgtgccactgcactccagcctgggcgacagggtgagactccgtctgaaaaaaaaaaaaaagaggtaaggaaactggtgtgctggagatttgtgagaagaccagtgtggctggaaaacaaagtcacctgcgaggccagggaggacaccagatcaaagcaggcagagcccgtgggccatagagtggacttggtgaccactggaagtcatggatggatggggctgctccaccttggggagaatccaggcatcagaggccaatcttgtttttgcctccaaaatctaagagttgttaaagtcttaggggtaggagggacaacaccccgctccagagctgtgtggcacctggccgggaccttgttattggcccttaatgttcccaccaagcagcaaagttgacactaccatgtggctggggactctgcagggagccttgaggaagatgagttccctcttggagcctggtgtcctcaactgagtgcggccttaaggctgacagaggttaaataaaatatgtacaccctgtttttgagggagggcagtccctaaactggatctgcattttagaaagtttgcctaggccaggggcagtggctcacgcctgtaatcccagcactttgggaggtcaaagtgggcagatcacctgaggtcaggagttcaagaccaacctggccaacatggtgaaaccccatttctactgaaaatacaaaaattagccaggtgtggtggtgtgcgcctgtaatcccagctactcaggaggctgaggcaggagaatcgcttgaacccgggaggtgaaggctgcagggagctgagatcgcgtcactacactccagccggggcaacagagcgagactctgtctcaaaacaaaaaaacaacaaaaaaagaaagtttgcccaactggaccctagcggcaggggctggcaattcttcatggggacaggaggccagcctccctcgggtttttttccaagactggggaaatgggccacaaatgtggaacctgtcttgggcattcaggtgagactcaggggggctaccaagctgagtcttggccggttgggatggtgacacagtgccacctactggtgtgccccacgcctggacttggcagccatcaggttccagagtggcatgggccaagcccatggaattcagaatgaggggccaagaaagactgtggccaggagcggtggctcatgcctgtaatcccagcactttgggaggccaagacaggcagatcacctgaggtcaggagttcgaggccagcctggccgacatggtgaaaccctgtctctacaaaaaataccaaaattagctaaaattaggttaaaaatacaaaattactcctgtaattgcagctacttgggaggctgaggcaggagaattgcttgaacccgggacacagaagttgcagtgagccacgattgcgccactgcactccagcctggcgacagagagagactccgtctcaaaaaaaaaaaaaaagaaagaaagaaaaagaaaaaagaaaagagcatctccagagggatgagctcagtttctgaatcaggggcccgagatcagtccctgtgtgtagatgagagggaaaacctttgcctgtactgaacgaacacaaattagtattactgggctctggaaccaattctgcctgggttcagatcccagttccaccaccttgacaaagttgcttaacctctttgtgcctcagtttccttgtctgtaaactgggaataatggcctctgttgttctcagtcagcttatgtaaaccactcagtacactgtgagtctgcaattgaagctactattatatttatatattttttaagacagagtctccctctgtcacccagactggagtgcagtggtgcaatctcagctcacttctatctgtgtctcccaggtttaagcgattcttgtgcctcagcctcctgagtagctgggattacaggcgcccaccaccatgcccggctattttttgtgtgtgtgtttttagtagagatggggtttcaccatgttggccaggctggtctcgaactcctggcctcaaatgatccacctgcctcagcctcccaaagtgttgggattacaggcgtgagccaccgtgcccggcctatcatacctacttttattgttctcatgaccatcttcatcattccaagtgtggattgaagtgagagtgtctggtgcatctggagggctcccgcctggtgggtgagggccagaggtgtctgtgtgaggtggaggagggccagcacatttggctcagcagcccggactctctcctgatgacagtggggacggccgaagggtgtgggttgggaggaatgaggtcaggtctgtattttgcaaacccagcatccatgcacccctcctgcactcacagccttacaccaggcatcctggtctccctggtatcctcatcatacagaccaggaaacaggctcagagaggtttaggtacctgtgcaatgttgtatagtgaattagggacagagcccaaatgccaggcttgcactcctgagcccagggctccattgatcccatcgtgcagaggttaagggagggacctgattttttggcatcagctgtgctcagcagggtgcaaacaacagcagcttggcccttgcgcctgccccgggccctgggtggactctgtagtttttctggtctctcgtagtcggaagaccatttcaggaattaattttaaaactgccatttttaatctaaacaaaagctctcctctgtccaagctgggcctgctttcggctggcagatctgcggcagcaagagggttgtgagccctttctgtttttctaggtctttctttttttttttttttgagacagagtcttgctctgtcacccagattggagtgcagtggcacgatctcggctcactgcaacctccgcctcccgggttcaaggaattcccctgctgcagcagactctgtctaaaaacagaacaaaagatatggcatagaaacatatttggggttgaaatattttgatttccttccttatctgccatgcgatgttatgctagagcctggttggaaagccagccacatcatatagggttaaaatagaacctgtgtgatgaggctttgtggtttgaaaggcgtgactccccaggctccttagataggaatctgggcaagagaagaaaacggtcagaggttagtcctcaggtatgtgagcgtgtttagtgtgttagtgtgaggctgagtgtgtgtttatccaagcgtgtgaataggtgcatgtgtgtgtacataattgcgtacaagtgtgtgactgtgagtgtgcatgagtgagtctgagggtgctgagcacgtgtttgtgtgagtgcgtgtgtggaagtgtgcacgagtgtgtttgtgcgagtgtgcaagcacgagtgtgcacacgagtgtgagagagcaaatgagtgtgtgactgtgtgagggtgtgcgtatgtgttagtttgtgagagcttgcaagtaagtttgtgcaagcgtgtgaaggtgtgagagtgtgtgagggcacgtgtgtcctcacatgggtatgtgaatgtgtgtgcatgtatgtgagtgtgtgtttattgtgaaaatcgtgtatttgtactcatcatcgcataccagagtcacttgctgtaaggaggggtgaccttggaactaaggctctgccacctctttccaaccccccatcctgcactggattgcccagttgctcccaaaagctgggggctttgctctccagctcacagctgtgggcacctctcctggtcatctcctacctcctgtcccagctgcacacaaccacgctacccccagatctccagggggaaactggtttgctggaatgtttatgaaacacgagtgcaggtttttgcttttttaaaaaagaaatgagcgtaacaggatttttcagattcagagctgtacttctgaaatccagttctccactcgtgtgttttcctgtcaacagtgcgtctccaaacgtcgcgcctgctgctaccaattaattcatgattgtttcattcaccgattaagttgctcgatgtcagcagatttaaattttgtgaagttatgtagttttgtcttcagggggacattgtgcaaacttgatcaagcagcagttatgacaatgcacgtaaagtgaataataaaagctgaatgtgtctcccttatgaaatttggtcatgcattttatattcgcgattcttggagtgtgacaaaaaagcatccaacttatgtgtaagaaaaatttcgaaactgtgggagtgtgaaactttacgatgggattcacagcattttgcaagaatttttttttttaattcctgcaagagtcccactactgtattccaagttttttcttttcctttttcttttcttttttttttttttttcagagacagggtcttgctctgttgcccaggctaagtgcagtggttcgatcatgctcactgtagcctcaaaactcctgggctccagtgaccctcccacctcagcctcccaagtagctgggactacaggtgtgcacaactatgccgggctaatttttttatttttattttttgtagagacagcatcttggtatattgcccaggctggtctcgaacttctgacttcaagcaatcctcctgcctcggcctcccaaagtgctaggactacaggtgtaacccctactcctggccgtgtatgccaagttttcttcattgaagtgtctcgctcttctcaggatgatgacacagttttataaatctatgaccgcaatatagcacaaagtgggtgttcaataaacccactttgggtttattgttggtgaatcaaccaaaagaaattataattgggaaaaaggtcagagtagatgatagttgaaaattttgcaggtcctgctaatttctttcttccttcctttccttccttcctttcttctttttttttttttttgagacagagtttcactcttgttgcccagtctggagtgcagtggcgtgatctccactcaccgcaactccgcctcctgggttcaaatgattctcctgcgtcaacctcccgagtagctgggattgcaggcatgcgccaccacacccagctaatttttgtatttttagtagagatggggtttctccatgttgggcaggctggtcttgaactcccgacctcaggtgatccgcccacctcggcctcccaaagtgctggaattacacgcgtgagccaccgtgcctggccccttttctttctttatcatcttggtcagtgttcagtgttcaggacactttcccctcacaggtggccacacttggagagttgtacaatggcagagctagaggggactttattttttattttattttattttgtttgtttattttttttgagatggagtctcactctttcacacaggctggagtgcagtggcatgatctcggctcactgcaacctccacctcccaggttcaagctattctgcctcagcctcctgagtagctgggactacaggtgcctgccatcatgcctggctaatttttgtatttttagtagagacagggtttcaccatgttggccaggctggtctcgaactcctgacctcagatgattcacccacctcggcctcccaaagtgctgggattacaggcgtgagccaccatgcctggccaggtactttatgtttactattattttttgtttgtttaaatttatgggttacaagtgcaaccgatatattgcacagtggtgaagtcagggctcttaggaaatccatcacccacataatgtactgtattagactgttcttgtgttgctataaagaaataccggagactgggtaatttataaagaaaagtttaatttggctcacagttctgcaggtttacaagcatggtgccggcatctccttggcttctggggaggtctctggaaactttcattcacggctgaaggcaaattgggattaagagagtgagggggccgggcgcggtggctcacgcctgtaatcccagcactttgggaggccgaggcgggcggatcacgaggtcaggagatcgagaccatcccggctaaaacggtgaaaccccgtctctgctaaaaatacaaaaaaattggccgggcgtggtggcgggcgcctgtagtcccagctgcttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagagagtgagggggcaccaggcgcggtggcccatgtctgtaatcgcagcgctttgggaggccgaggtgggcggatcacgaggtcaggagatcaagagcatcctggccaacaaggtgaaaccctgtctctactaaaagtacaaaaattagctgagagtggtggcatgtgcctgtaatcccagctacttgggaggctgaggcaggagaatcgcttgaatctgggaggcggaggttgcagtgagccgagatcgcgccactgaattccagcctgatgacagagcaagactccgtctcaaaaaaaaaaaaaaaaaaaaaaaagacagtgatgggggaggcgccacaccattttaaataaccagatgtcacgtgaactgagagccagaacccacttatcaccaaggggatggtgctagaccattcatgagaggtctgtcccctgatctaatcacctcctaccaggcttcacctaatgctgggaattacatttcaacctgagatctggagtttggacaaatatccaaaccctatcacatacattgcattcattacctacccatccctttccatgtctccattgtgtacacattgtttacctccctcttagagaacatatggtatttgtctttctgtgcctgggtggttcatgtaagataacagcctccagttccatccacgtttagatcacagctgatacagagagggatggcgacttgtgcagggtcacacagctgtcactgcccaaggggttcaccttgcctgctgcttagacacagctgatttatcaagacaggggaattgcaatagagaaagatggccgggtgccatggcttgctcctgtaatcgcagcactttggaaggctgaggtgggtggatcacttgaggccaggagttcgagagcagcctcacaaacatggtgaaaccctgtctctaccaaaaatacaaaaattagctgggcctggtggcacacacctataatctcagctactccggaggctgaggcaggagaatcgcttgaacctgggaggcagaggttgcagtgagcccagatcgcgccactgcactacagcctgggcaacagagtgagactctgtctcaactaaaaaaaaaaaaaagagagagagagagaaagagtaatttacacagagccggctgtatgggagactggaggtttttatcactcaaatcagtctcctgagcattcaggatggagtttttaaagacaatttggtgggtagaggctcggaagttggggagtggtgactggtcaggttggagatggaatcgtagggggtcgaagtgaggttttcttgctgtcttctgtttctggatgggatcatagcactgctcaagccagattacaggtctgggtggtatcagctgatccatcgaggacagggtctgcgaaatatctcaagcactgatcttaggttttataatggcgatgttatctccaggagcaatttggggaggttcagactcttgcagccataggctgcatgaccccgtaaaccataatttctaatcctgtagctaatttattagtcctacaaaggcagactggtacccaggtaagaagggggtctttttgggaaagagatattatcaattttgtttcagagtcaaaccataaactaaatttcttcccaagattagttcggcctactcccaggaatgaaggaggacagcctaaagttagaagcaagatggagtcagttaggtctgatctctttcgttgtcataacttcctccgttatgatttttgcaaaggcatttgcacagccagtgaacacggaccccggcagtggtttccacgccatgggggcctcccggagccctggctgggcaaaacagcctggcccatctttgcagcagtggggtctggaggtgggtgggtgggagctcatgcccccctgacgctgtctgtgtgttagttacaggactctgatcagacccacctacagagtgtcctaccgcacggtgacggtgctggagtggagatgctgccctggcttcaccgggagcaactgtgatgagggtaagttggcaggcacttgggctgcagggggccaggcgtgggccaggctggagtttctcccttctctggcctcctcctgcaagcagctttcctttcctccgtagcttgaaatcctttccttttcccaatcgcctctgaagcaaatgttctgtatcggcctggccaaaccaggatgaagctgcccgccctgcccgtgggcaccgaggcaggtcctagtttgcactggttgggtagtggaatacagaagccaaaaacagcactggtgccaggggaagggatttgatttctagccggtttcttccacttttggctccgatgcacccagaacccctggggcaggcagagttggatatctgggctctgagcaaatgcggatgaggtcccaccagccttgaggccacgtattttgtagactgagacagagaagctgaccggtagctgcagatagacgttcacccagctgctttctgcctttctgccctgttggtgtttagcccgggggcctgggctcagcctggctctggagcctgagagggtcacataacagcacttaggtgggccagcagtggcagacagagcaaatcccccttcactgctggccagggaaattgagtcctgcctaatgaacaagtttgcagcccaccttgttccccagcatggctggatgggtctggaggctgaggctcagcggtcagatttttcttctttttcttttttttttttgagacaaggtctcactctgttgcccaggctagagtggagtgacatgatcatggctcactgcagcctcgaactcctgggctcaattgatcctcccacttcaccctcctgtgcagttgggactgtaggtgtgcaccaccatacctagctatttttttgtatgatttttagagacgggtcttgcattgttgctcaggctgtctcgaactccttggatcaagcgatcctcccaccttagcctcccaaagtgctgggattacaggtgtgaaccacctctcccggctggaggggtcagttttgtatttggaaacagtagctgtctcccaccttcgctttctgacaaaattcttctcttctctgtcatcttgttacttactgatttgatagcaggatctatatgctttgagtgtaaactgtctaaagagctctttgggttacaaagaataacgcaattgacagaaatagagactctgacaattgcttcagggggcctctggcccacagcagagctgaaggaaaaaggctgggatgccagggagtccgacaggtgcctctggtcctggttgatgaggtgcctgatgctggcaggggaggctgggctatccttgttggaggttccagggctgacttggacccttctttggagaggagcaggaaggacctccaaggtgaaggggtgaggggatgccaggtttctgagcagtgggctggccctggcataatgctatggtgttgaacgaccacagctcacaggtccctcatggaggcctgagcccttcaatgccaggacttggacctgccattctggtcagcgccacggctgtggacacagccatctggtccccccaacgggatggagcaggcctgccatctagatcctgccaggggccgaggaggcgagagttgctagggaagtgattagtttacccttaagtaagtacctgagcctgtttcagtgatcaataaaatcagcaatgttagccgggaatggtggcttatgactgtaatcccagcatttcaggaggctgaagccggaggatcgcttgagcccaggagtttgagaccagcctgggcaacatggtgaaaccctgtctctactaaaatatacaaaaattagccaggtgaggtggcatgtgcctgtagtcccaggtactcaggaggctgaggtaggaggatcactgatgtatgtgtgtatacacacacacatgtatttgtagattgggggtccccaagaccacccttaggtttgacaccttgctagaagaactcagagaatgtattaaaaactattatgctcatggtcatggtttattacagcaaaaagatacagattaggatgggcgtggtggctcatgcctgtaatcccagcactttgggaggctgaggagggaggatcacttgaggtcaggagttcgagaccagcctgaccaacatgatcaaaccccaactctactaaaaacccaaaaattagccgggcatagtggtgggcgcctgtaatcccagctacttgggaggctgaggcagaagaatcgcttgaacccaggaggcacagattgcaatgagcctagattgtgcctctgtactccagcctggatgacagagtgagactcagtctcaaaaaaaaaaaaaaaagatacagattaaaatgagctagggaagagacacatggggcaggccgggcacaggagagtttcatgtatggaacctctagttgtcgcctcccagtggagttgtggacagctgtactttcccagcaatgacatgtgtcagtatatacaaaatattgccacccggggaagctcatctgagccagagattttactgtggcttaggtacatggaccatggccagcctgcatggctgactcagattctagcccctctggaagatgagctggtaccaggtggtgcaaggatgtcctcatcaacgacattgttagcacaaactatccaatgtggcctgcgttagcatagactgtgtggcatggtcgaaggtccccaggtaggcagatactgtgaccaacctggacattccaagggcttccaaatacctcccacgagccaagtgcaaaggccagacctcctttagggtaagattaattctttgtgtgtgtatatatataatatgtgtattacatattattattgaaatatataatatatagtaattgtgatatattaataatatatattctatattcaataatatagaattattgaattatttatattccatattctatatgaatatgaattccatagtctatatgaatatgaattccatagtctatatgaatatgaattccatagtctatatgaatatgaattccatagtctatatgaatatggaatgtagaatgatatacaattctatatggatattgaatgcgttattaataatttatatattccagtaatatatattatcaataattatagatattaattattgataataaatattatcaaataaatattcatatattgaataatatataatattgaataattgttgatatatattattgaataattattaataataattaatatatattccagtaacatataatatatattattgaaatatatgatacgtattatatattgttgaaatatataatatataattgaaatatataatatagtcattgagatatatatgtaatatatatctcaataattaatataatctcaataatatatataaaatatgttactgtagacaatttatacattgtatataatatatacaatatgaaagatatatttatatatgatgtaaattatgtattataatgtgaattatgtattataatttatattatatttctatttaaacaatgtatgtattatataaattatatataatgttatatttaaattataatttatattatatataaattatatacaatttaagtatccctagtccaaaatccaaaatgttctaaaatctgaaactttctgagccctgacatgatgctcaaaggaaatgccaagtagaacattttggatttctgattttctgatttgggatgctgaactggtaacataattatatattatacgtaaagtatataatttatatatgtatataaaaacgaacctgaaattaagaccactaaggttgagcctatggggtagtaaagacaaaagctttgtggttattgtctctactgaaaagaaatcatttgcatctttttttttttttttttgacggagtctcgctctgttgcccaggctggagtgcagtggcacagtctccactcactgcaacatcagcctcctgggttcaagcgattgtcccacctcagccttctgagtagcagggattacgggcatccaccaccacacccagctatgttttttgtatttttagtagagatggggtttcaccattttggccaggctggtctcgaactcccggcctcaggtgatctgcacccatcggcgtcccaaagtgctggaattgcaggcgtgagccaccgcgcacagccaaaatcatttgctttttaccagttttgtatgagttaacatccaacttggcagaatctgagctgcaatgcatagtgagcggtaactcaaagtgacattctcctggggtgtcatacggcacgtgggcaggctcatgagatagtgctgtagcctgactctagaaggttagtccctcagctttttgccctatttccacattttgcagagctcttcttgcagactgagtggatgaaacacagtagcccatggcagcaggtggcaggaccgtgggaggacagtccctgctgactgggaggtcctcaccaccaagtaggttcatgtggggctgtggacccacctttctcaatagaggaggcagaagtgaaggggggtgactgtgagctggtgaattgttccaaaggtgtccaccctcaagggcttggcacttcccttcaagaagaaatttcttatccgataaaccacattgatatgatcaatatacagtcatgcgtggcttaatgatgtggctatgttctgagaaatgcatcattggaagatttgtctttatgggaacaccaaaggatgtacttacagaaacctagatgatctagcctattacacacctaggctagatggtctagcctattgctctgggctacaaacctgtatagcatgtgactatgctgaattctggaggcattaggaatataatggtaagtatttgtgtatatcaacatatctacacatagaaaaggtacagtacaaatatattattattattatttattaatttttttttttgagatggagtctgtctgtcagccaggctgaagtgcagtggtgtgatctctgctcactgcaacctccgcctcctgggttcaacggattctcctgtcttagcctcccaagtacctggggttacaggcatctgccaccatgcctggctaattattgtatttttagtagagacggagtctcaccatgttggccaagctgacctcaagtgatctgcccgcccccgcctcccaaagtgttgggattacaggcgtgagccactgtgcccggtctaaaatacagaattataattttaatgggggtgggggagcagacgtggtggctcacgtttgtaatcccagcactttgggagcccaaggcagtggatcacttgaggtcaggagttcgagaccagcttggccaacatggcaaaaccccgtctctactaaaaatagaaaaactagccgggcgtggtggcacgtgcccgtagccccagctactcaggaggctgaggcaggagaatcacttgaacctgggaggaagaggttgcagtgagctaagatagtgccactgcactccagcctggttgacagagcgagaccctgtctcaaaaaggaaaagaaattttatgagaccactcgtatatgcagtctgtcgttgactgaaatgtcgttatgtggcatgtgactgtactcaccagaaacatctggagttcttggactgattatgatgagttccagcacctctcaagatgctctcagcctcagacctctgccagcccctccctggtggagaagccttctgggcttcaagcaccttgctcaggatgcgtgtccccttctgaaagttttagggttaagtgactcttctagctgtgtgcctgagggtcctggacatctcaggagtggggagttggcagctgaagaattcctgggagtctgagcctgggctgagtttgggatcggctcctgaaaacccttgtaaagattttacattcccgaatataaaccaataaagacagcaggctaaatcaaggccatgcccatgtcttgggcacattccgaagatggttgtggtgagtcccgcaccattaattcccttttgcgtctcattcctgcctctctggaaacaagcaggtccatgagatgcagttcagtgggttttgctgtggttcagtggggtttccctccctagacaccccaggagtgcaggtctaaggtttggaaatactttcctttctacatatgtctatacatgatccatcttaatgaattgcacatttcgtgtttgtgaattcacctccttgataaaattgatgggtaacccctaaatcaataacttgcagcggtcattcatggatatggggcacagtagcaaaaactttgagtcaccagacatgcatgtttcctactgaggtcaaaccaggtgacaccctggctccctgtttccctctcaaactgcaaagaagtgtcctgttcttttctttttttcctttccttttcttttctttcttttttttttttttgttatggagtctcgctctactgctcagactggagtgcaatggcatgatctcggctcactgcaacctcccaggttcaagtgattctcctgcctcagccttccaagtagctgggattacaggtgcccgccaccacacccagctaatttttgtatttttagtagagacagggtttcactatgttggtcaggttggtctcgaactcctgacctcagatgatccacccacctcggcctcccaaagtgctgggattacaggggtgagccaccgcacccggccaagtgtccttttcaaggtctgtttagtaccatagtttttgcatctttctgcctttttgggggtggtttgttgtttagaatgtcccccaggcatagcgctgaagtgctctctggtatccctaagcgcaaagaagctgtgatgttccttgcggagaaaatatgtgtgttagataagcctcgttcaggcatgagttacagtgctgttggctgtgagttcaatgttaatgaatctacagtaaatatgttaaaaggtgcctttaaacagaaacacaggtaagacaaggttatgtattaatgggttgatgatcctgaaatcagaggctcaaaggacctaaccctgtatttcccgtataagcaatggttcagtattcactaaggtagtgtaaatggtgatttcatagagcataaattctgtgagccagcatcaattgtatatatggatctatgtctaactaaatatctaaaacaaaattttttctttatctttttttttttttttttttgagatagagttctgctctgtcacccaggctggagtgcagtggtgccatctccactcactgcaacctccgcctcccaggcccaagtgatcctcccacctcagcctcccaagtagctgggactacgggcatgaaccaccacacctggctaatttttgtgtatctttgtagagacggggtttcaccatgttgcccaggctggtctccaactcctgggctcaagcaatccacctgcctagacctcccaaagtgctgggattacaggcatgagccaccatgggcagcctagttttttcttattacaaaagtaactacatgtttagtgcagaaaacatagaaacacgtagtattacacctctcacttgggtgagaagcctccagatctttttctgtgcttgcatgttaattgcactgtacatgctgtttggtaagtttcttttcttttctttttttttttttttttgagactgagtttcaccttgtagcccaggctggagtgcaatggtgcaatctcagctcactgcaacctccgcctcccaggctcaagcgattctcttgcctcagcctcccaggtagctgggattacaggtgtgcaccaccacccccagctaatttattatttttattatttttaattttttttgagatggagcctagctctgtcacccaagctgtagtgcagtggcgtgatctcagctcactgcaacctccgcctcctgggttcaaaccattctcctgcctcagcctcccaagtagctgggactgcaggtgcacgccaccaggcctggctaatatgttttgtatttttagtagagacgaggttttaccatgttggccaggctggtctcgaactcctgacctcaggtgatccgcctgcctcggcctcccaaaattctgggattacaggcgcgagccactgcacctggcctggtaagtttccttctcacataaattatcatgaacatctgtctttggcaatagatagccttctataatatcattgtgagtggttgtagaacttgagtatacacacactttattaaataatgtaagatatttaaattgtttctaatttttaaataacattactgtaagtatatatatatatatattttttttttaatggagataaaatttacacatacttaaatgcacagattttctctttttttgagatagggtttcattctgttgcccaggctggggtgcagtggtgtgatcatggctcactgcaaccttgacctcccaggctcaagcaatcctcctacctcagcctcccaaggagctgggactacaggtgtgcaacatgctgagctaattaaaaaaaaaaattctgtctgggcgcggtgtctcacgcctgtaatcccagcactttgggaggtggatcacctgaggtcgggagttcgagaccagcctgaccaacatggagaaacctcgtctctactaaaaatacaaaattagccggtcgtggtggcacatgcctctaatcccagctactcgggaggctgaggcaggggaatcgcttgaacttgggaggcagaggttatggtgagccgagatcacgccattgcactccacctcggcaacaagagcaaaactccatctcaaaaaattatatatatattttgtaaagacttgtttacaaaacaagtcttattatgttgaccaggctggtctcaaactcctggtttcaatctatcctcctgcctcggcctcccgaagtgctgggattttaggtgtaagccactgtgccaggcccacagatgttaaatgtacaatttgatgagttttgataaatgcatactcatttccatcagctcccagaaagtctctaccccagtgtaattgctcagtgggttcttcctgcctgccgcccagacaaaaccagttcgctgagaccgtggtattacagtaaagaagtattttaattaacatgatgccggccacgtgggagaactggagttatcactcaaatcagtttccttgaaggcttgaaggttagggtttttcaaggatagtttaatgggcaggggactagggaatgggtgctgcttactgtttggggatgccatcataggggtgtggaaaacggtccttgggcactgagtccaacactgggtgcaaggctacaggactggttgagtgatgagtcatgagtccgggtggggtcagtcagttgccagcatgcaaaagtctgaaaaatatctcaaaagaccaatcttaggttctaccatagttatctataggagcaactggggaagtcatcaatgttatgacctctggccgcatgtctcctgtgtcataaaggattatagaaaccatgtctacattttagcagaattcaggcacctataattctaatctcatgtcctttcattgtctttcaaaggcagtttcctcccctaaacaaggaaggaatccgttttagggagagagtgttatcatccttgcttcaaagttaaactataagctaaattccttccatgttcagcttggcctctacccaggagtgagcaaagacccccagcgtgtgaggttagaagcaagatggagtcagctatttcagatttcactcactgtcataatctttgcaaaggcagtttcactagaaagcactgttctgacttctatcatcatagatcaattttgactattcttgaactttatataaatggaaccatacagcatataatcttttgtgtatggtttgtttcacttgcatttttgagattcttccatgttttacatatacatgtgtagtttacttgtatttgttgctggatattattccattgcatgaataaccatcattttgctaggttgtggtatagcttaacttttttttttttttttttttgaaatggagtctcaccctgttgcccaagcaggagagcaatggcacgatctcggctcattgcaacctccgcctcctgggttcaagcgattctcctgcctcagcctcccaagtagctgggactacaggcacccaccagcacacctggcaaattttgtatttttagtagagatgggctttcaccatgttggccaggctggtcttaaactcctgagctcaagcaatctgcctggctcggccttctgaagtgctgggattacagggttagccatggcacttggcctcattagatttatactttaaggataattccttaagtcacatttcaccagtagatgtcctaccagttagttcaatctggctagcagcatagtggacttcatcacctttaccaatatcatgtcaatgtgtctgtattcctcacctgtgaaatggtactttaggccgggcacagtggctcacgcctgtaattccagcactttgagaggttgaggcaggaggatcacctgaggtcaggagtttgagaccagcctggccaacatggtgaaacctcgtctctactaaaaatccaaaaaaactagccgggcgtggtggtgcatgcctgtaatcccagctacttgggaggctgaggcaggagaatcactggaaggtggaggttagagtgatctaagtgagccaagtgagccaagatcacaccacggcactccagcctgggcaatgtgagtgaaaactctgtctccaaaaaaaaaagaaatggtactctatagtttagaaagtgttttcagtttgttgtgtttccattttgtagatgcagaaacaggcgcagaggaaataagagatttgtccaagtcatctagctaaggagtggccagtgtagaactgaaacctgggtcttttttttttttttggagacatggtctgactttgttgctcggcctggagtgcagtggcatgatcatagctcactgcagccttgaactcctgggctcgagcaatcctcccacctcagcctcttgagtagctgggactacagatgcgtgccaccatgcctggctaattttttaatttatttcatttttgttttgtaaagtgaggtttcactatgttgcctagattggtcttgaactcttggcctcaagcgatcctcccaccttggccttccgaagtgctgggattacaggcatgaatcactgtgcctggctgaacagggatctttttgttcctaattaggtgccctttactctaagctacctgggacctttgcagtcttgggaaatcccacccgaagttgtcccagtacaagggacagggccgctagtctctgggctggctccttcctgcaattcctaaggtggccttgtccctagagttcttttgtttgtttgtttgtttgttgtttgttttttgagacggagtctcgctctgtcaccaggctggagtgcagtggcacgatctcgtgctcactacaacctctgcctcctgggctgaagcgattctcctgcctcagcctcctgagtagctggaattacaggtgcccaccaccacacccggctaatttttttttttttttgtatttttagtagagatgggatttcatcgtgttagccaggatggtctcgatctcctgacctcatgatcctcccaccttggcctcccaaagcattgggattacaggcataagccaccacacctggcctacacctggcctacgaccgtggagttttaaggccccatctcacattggcttggtgttgtagaagagatttaccacaaagttgatcatctcctcaaccatcaggagatgataactttattctgagtaggggatttttactctttttttctgtattccagctggaaatgaatccaaccaggacaggaaatgaatcccctagactcctatatgggcaagggcaggcctgggacagaggggcttagctagtccatccaagcgtggagctgattgatttgagtccaaggcgatgctaaccattctgccccgactctagctctgtgtacgggcatgtctgtgttttgaatggctgagggttcaaagccagaaggagttagttctcctgagaagaggctgcagcctcctggtctatctgcagagctcatcgctttaggaaagtgactccccatgaatctgatgatgtttctgagacttgccttccatagctgtcattcaaactaggaccatttatcaaaatgagccgagtgcatagcacgttccgggcgccggatgcttggatcacattgatgaataagggacttcaggggctcccaggtgtgctgtgtgtgtgtggtggagagtgtgcaggggccagaggaatgaacaaatcatccaatactgtgagataaggacttcgctaaaggtacgattgaggtgttgtgagattcacaggaggtagagatctgggtgatcctcctctggttcaaggcctggctccctgggtctaagtttctcagaatcccacttcaccatgcatcctctctcttctgtagattgcatctttcttccccactggctctttcccatcagcacctaaggatactccagcatctctctcctttaagaaaacagcctcaggccaggcgcggtggctcacacctgtaatcccagcacttagggaggtggaggtgggcggatcacgaggtcaagagtttgagaccatcctggccaacatggtgaaaaattgtctctactaaaaatacaaaaattagctgggcatggtggcacgcatctgtaatcccagctacacaggaggctgaggcagaagaatcgcttgaacccgggaggcggaggttccaataagccgagatcatgtcactgcactccagcctgggtgatagagagagactccatctcaggaagaaaaaaaaaaaagaaagaaaagaaaacagcctcattgcgtctacatcattcttttgctgttggcttttctcagccagctttcttggaagcactggttgctctgcctgactcagtttccttgtttatagggtcttctccaacctctgcggccaggtctctgccctgcttactgtctcatttgcacctgcgggatgttactttattttattttttgaaacagggtcttgctctgtcacccaggctggagtgcagtggagctatcatagctcacttcaatctcctgggctcaagtgatcctccttcctcagcctcccaagtagctgggaccacaggtgcaccacaccacgcccagcaattttttttgttttgttttgttttacattttgtagagatagggtctctctatgttgccaaggctggtctcgaattcctggtctcaagcaattctcttgctttggccttccaaagtgctgggatcacaggtgtgagccactgcacctgccctcctcctcctcctccttctttttttttgacggagtttcgctgttgttgtgcaggctggtgtgtaatgacacgatctcagctccctgcaacctccgcctcccgggttcaagcgattctcctgcctcagcttcccaggtagctgggattacagatgcccgccactacacccgggtaattttgtatttttagtagagatggggattcgccatgttggtcaggctagtctcaaactcctcacctcaggtgatccacctgcctcgacctcccagagtgctgggattgcaggtgtgagccacggtgcccagccacctccttcttctaattatgatcttccctggggctaatttcacacattgccactcaaggtcacacaccttacctttctcactacagcagaggaagcatttctagaacctcctggttggggctggggtcccatcacatccacactgtggctgggagaagggaagggctttggtcaatgttatcaatcatcagctccagttgggcctgaggcatataagttcaaggtctcgtccacagtgtgctggcccagactgggcagagccagtggctggcaggggttgccggtccactccagccctcaccgttggggccatggggtgggttgattgggttttgcctctgcttagcctgttatggtgatggtgagtagagatggatgggctgtctatccacggagcactttttttttttttttttttttgagacgaagtcttgctctgttacccaggctggagtgcagtggtgcgatcttggctcactgcaacctctgcttcccagtttcaagtgattctcctgccttggcctcccaagtagctgagactacaggtgcccgcctccacgcccggctaatttttgtattttcagtagagatggggtttcaccatgttggcctggctggtctcacacccctgaccttgtgatccacccgccttggcctcccagagtgctgggattacaggcttgagccaccgcacccagcctcagggagcattttaaacttatctccttttcttttttgagatagggcctcactctgtcatccaggctggagtgcagtggtgccatctcggctcactgcaacctctgcctcctgggttcaagcaattctcctgcctcagcctcctgagtagctgggattataggtgtgtaccaccacacctggctaatttttgtatttttagtagaaagggggtttcaccatgttagtcaggctggtctcgaactcctgacttcaggtgatctgcctgcctcagcctcccaaagtgctgggattacaggcgtgagccaccgtgcccggccttaacttcatgtatttatttctttttctcttcctggggcctccagggctgtggtgtcatcaacagttccccgtactgtttactgggacccccatgcttccggcccccggtgacacgtgggagctcagtagctggcagggcaggacccatcatgagagtcccagaactggggaacaccgagaagcagagaatggggccccacgcagaccaggagccccatgcctgagctgcaaggagggacttgcaggcaaggttttccacctggatctgttcagatgcagtgaccttgcagagtgatggggccgggacacttcgtgcatcaaagcacataattaacaataaaaaggaaaggggcccaagaagaggggtcccagaagagaggtccaagtttcctagagggcaaggacaggccatgattgacaagccagaagtgggctcatgagaactgggctttctctgccaatagttgtgctgtcctgacctaagcttaccttctctaaatgtgtcaatctagaaagagaacagggctttggttttgcaagattaaaaaggtctgcaaattaattgcacacacattgtaataaatctccacccctttttcatcttgcaaattctatgaattttggatgcctcatataagtgaaatcacagtgttagtttttttgtgactgccttatttcgcttagcattatgtcttcaagattcatccatgtagcaagggtcagaatttccttcctttaaaggctgaatgatattccactgtagggatattactatccattcatctgccatgggacattgatttgggttgcttttacttcttggctattgtgaataatgctgccataaccataggttgcaaatatcccttccctcccctcctttcccttcccttcccttcccccctcttccccctcttcccccttccctccccttttctttttctttctttcacttgtccttcccttcccttccctccctccctttcttcttccctccctccctccccctcttccttccttccttccatccttccatccttccatccttccttcctccctcccgtcccctttctttctttttctctctctttctttcttttttcccctccctctctcccccctcccttccttcctcccttccccttttccttccttctttctttctttcttcctttctttctctctctctttcttccctccctcccttccttcctccttccttccctccctccctcttttttctcttttttcttttctttctttctttctttctttctttctttctttttctttctctctttctttcttcttttattctttcttaatctttctctctctctttcattgtttttcttttcctttttttgtgacagggtcttgctctgtcacccaggctaaattgcagtggcacaatgatagctcactgcagcctcgacgtcctgggctcaagcaatcctcctaccgtagtctcccaagtagctgggtctacaggcatgtaccaccatgcttggcaaattttcaaattttttataaaaatgggatcttgccatgttgcccaggctggtatggaactcctggcctcaagtgatcctcccatatcagctttccaaactgctgggattacaggctcatgccaccactcccagctaattttttatatttagtagagatagtgtttcaccatgttggtcaggctggtctcgaactcctgacctcagatgatccacccacctcggcctcccaaagtgctgagattacaggtgtgagccaccaagcccagcatctaattcttattttattattattttttttgagatggagttttgctcttgttgcccaggctgaggtgcaatggcgcgatctcagctcaccacaactctgcctcccgggttcaaacgattctcctgcctcagcctcctgagtagctgggattacaggctcctgccaccacgcctggctaattttgtattttcattagagatgaggtttctccatgttggtcaggctggtcttgaactcctgacctcaggtgatccacccaccttggcctcccaaagtgctggaattacaggcttgagctaccgtgcccggcctctaattcttatttttattttattcatttattttggagacagtgtcttgctcggttgcccagatgatcatagctcactgcagcctctaactcctgagctcaagtaatcctcccacctcagcttcctgagtaggcgggactacaggtacacaccaccatgcccggctaattttaaaattgtttgtagtggcggggtctcgctatgttgcccaggctggtctcaaacttctggctccaagtgatcctcccacctcagcctcccaaagcactggtattataggtgtaagtcaccacccttggctttaagcttctaattctttctttcttttttttttttttttttgttgggacagagtctcattctgttgcccaggctggaatgtggtagtgcgacgatagctcactgcagccttgaactcctgggctcaagcaatcttcccaccttagcctcccaagtagctgagactacaggtgcacaccacctgtagctctgctaagttttaaatttttcacagaggtaggttctcgctatgttgctgaggctgctctccaactcctgggctcaaacgatcctcctgcctcagcttctcaaagtgctggcattgcagatgtgagccaccacgcccaggctctctgcatcattttaacaaagagtcatagcctctgagccctgggctgtggcggggccagccctgtttccctctcacactccagtgcaggacaacatcagcaagtgctttcagattacaggtgtgagccactgcgcctggtcaggagttcaagaccagcctggccaacatggtgaaactctgtctctactaaaaatacaaaaaaatcagtcgggcgtggtggtgcatgcctgtagtcccagctactggggaggccaaggcaggagaattgcttgaacccagggggcagaggttgaagtgagccgagatcatgccattgcactccagcctggacgacaaagtgaaactgtctcaaaaaaaaaaaaaaaaaaaaagaaaagaaaaagaaacaaaggaagtgctctcggcctggcgtggcagtgatataagacatcaggccccttcccatgtaaccggaaacccatgaacagagcctggtggttttacaaacaggaggagcagaatggagaacagagaatctcatcttctgggggtccacacgtgttccccaagattgtgggaatgagtgtgtgcagctggcttgggcaagggtgccgtggcactgcaggggccagcagctttccacctatccaggacttgctaacaacttgctaacggccctgactgagatgactcagtttcccagctagaactccccagcagcaaatgcaggcttggctgctgtatcattgatcactcccagcctgtccctgccaagcaattctatatccctcacctgcttggagagtggaaaggccacaggcgtcaatagcctcagacccagcatttaaatcctggctccacacactagttctgtgggctggtcgcttcctgtctgaacctccatttgctcatctataaagtgagcacagcgatacctgtcttgcagaattgtcaatatattgtatatgaaatgaggtgacaagtacctgatgtggcacaattggtggtacagagtaggcctgaataaatggcccttgttactgtcattccccgacctgcccagcactaggcacaatagtgttagaaacccacattgattagccgggcacagtgactcatacctgtcatcccagcactttaggaggccaaggcaggaggattgcttgaggccaggagttagagactagcctggccaacatagaccccgtctctacagaaaactttaaaaattagctaggcatggtggtgtgcacctgctactcaggaggcaaaagtgggagaatcgcttgagcctcggaggttgaggctgcagtgagctgtgattgtgccactgcactccagcctgggtgacacagcgagaccctgtctccaaaaaatatataaataaatacagactgactgatttttgtattttccccttcaggatatagatgcttaggactgagatgagaatgctaagaccccggcatgttctggtgtgtgtgtgtgtgtgtgtgtgtgtgtgtgtgtgtgtgtgtgagagagagagattcagtctctgccttttcatgcaacgtgaagggtctcagtatggatcccctgagtaccagaaagcaccctgtcaggtagagggtgccaggaatccccggtcttgctgccagcgctgggagccctgggctgaggtccagagttagtgaccccctgcaaagctgctgttttcctttagggagtggagattggttggggtttggagtccaaccaaattccccttggagggcagcccatcagcaacagggatgctgtgaacgtccctgggaggtggtgggttgtgtagacagaggccggaagtcaggaccttttgaagcagcattattgtcaggggtaaatacctgaggttcatcatctcacgccagggaaatcaaagacatggacccacaagaagtgagtttaagagcagaggtttaataggtgataaagagagaaaagagaacagccctccctcctgcagatagagaggggctgccgagtgggtcttctggtttcatggcgaaatgcacagggcggggggaggatggggggtggtttatagatgagcctgaagaggcagagtctgatttacacagcgcccgagagattggtcagaccaggtgtgacgtttgcatagtgtgcgaagaagctggccatcccaccccaatcttttattgtgcagacgggttctctacctggctgctgccatcttgtctgttccttcctgtacacatggttgacaaagaaaagggaagatggggccgggcgcggtggctcacgcctgtaatcccagcactttgggaggctgaggcgggcagatcacgaggtcaggagatcaagaccatcctggctaacacggtgaaaccctgtctctactaaaaatacaaaaaattagccaggtatggtggcgggcgcctgtagtcccagctacttgggaggctgaggcagcagaatggcatgaacccgggaagcagggcttgcagtgagccgagatcgcgccactgcactccagcctgggtgacagagcgagactccgtctcaaaagaaaagaaaaagaaaagggaagaaggagccgccatgttgaacctacctggcccccaggtaacccttttctattggcacggctgccggcatttacatatgcaagcttttagcttgcttacctgtgcttgtagattttcaggctgctttttgttagaaaagaaatgattcacacttgtaatcccagcactttgggaggccaagtctggtagatggcttgaggtcaggagttcaagaccagcctgaccaacatggtgaaaccccgtctctactaaaaatacaaaaattagccgggcatggtggtgcacgcctgtaatcccagctactcaggaggttgaggcaagagaatcgcttgaacccgggaggtggaggtgcagccagccaagatcacaccactgcactccagcctgggcaacagagcaagactcagtctcaaaaaaaaaaaaataaaagaaattattttgcagctgctttttattaaaaggaaacccttaccaaggactctcttacccccactatctgcctaaagaatttctttctagctcttttatcactttgtaagtgacctgcccatccgtttctcttctggaaatagggtcataggagtagccctgctggggaaggggcaccttggaggtctctgctccccgaggcagggctccgtgccgccaagcaaggcctccgtaacgacccactgagccctggttatcgtaaacttcctgcagaagggggcttaccttcccatgatgccatgtctagacacaaggtcaggtataagttatggagatgatgtagcatgttcggtggttaaaccgtaaaactttaatgagagatttctgtgtcttgaacatgtgctggggaaactgtgggaggagggagggggagacgcattcacttcctttccacttcttctctggccatctgtaggggtgcaggcaccgccctggaggccaagcccttggcgctcagctgagatttggtgtcagtgagtggcctccaccagacctggcagttcccaggcctggctcccattaagcagctagatggagctctgccctgctgcaccgggtggaccttggccaagtcacagcctcgcagggcctcggttttctcatctgtgaaatggggttgggagagagactctcccagcacaaatgtttccatctcctgatcttctatgatctggcagagcgcatcagcagacacgcatgttgagcagaaggaatgcctctctgagtttcagacctgcctcgtggggccctggggacactgtagggcagaggaatagctttatggactgtaaagtgctgtgcagacacacagccctcctggaaattctgggggtctctctctgaaaaggggtgaaagctatgctggtagctatttaggagatatctttgtggaaaaggaaatggagactgctgtggttttttttctgactccaaatacattgctccaattctctgacaccaccaccattccattcagacactactgggagttagagcagaccccagagtttaagggctcaagaccataagactgctcccacgtcagatgccggccataaacggggtgcccagtttacctgcacttatgcaaattcaagggtttacacgatttctctctttttttttttttttgagacagagttttgctcttttcgccctggtgtgcagtggcacgatcttagctcactgcaatctccgcttcctggattcaagcaattctcctgcatcagcctcctgagtagctgggattacaggcgtgtgccaccatactcagctaatttttgtatttttagtagagatggggtttcaccatattggccaggttggtctcgaactcctggcctcaagtgatccgcccacctcagcctcccaaagtgatgggattacaggcgtgaaccaccgcgcccagctggtgtccacgatttctgcctcatgtttggtaattcgctagaaccactcacagaactcaggaaagcactttgctgatggttaccatcttattgtaaaggaaacacttgagtagcagccaactgggagagatgcacgtgaagtggcgtcgctgtctggggtaaatactcaagattcgttgtctcacgaccatgggcaactaggacacagacacacaaagaatgatggtcagtgcagaagttgaatcagcgaaagcaagagaagagctctctctgctgcagagagaggggtcccggagaaatggattgcctttttttttgtttttttttttttttcgagacagagtctggctctgtcatccaggatggagtgcagtggttcgatctcactgcaacctctgcctcccaggttcaagcgattctactgcctcagcctcctgaatagttgggattacaggcgcgcaccgccatgtccagctaattttttgtgtagggagggggtttcaccatgttggccaggctggtcttgaactcctgacctcaggtgatccgtccacctcggcctcccaaagtgctgggattacaggcatgagccaccacgcccagccccgggtagcccttttctattggcatagctgccggcattcacccctgcaagcttctgtctttcttctctatgtctgctgcttgatttttcaggctgctctttgttagaaaagaaatgatttgggggctgctttttgttaaaagggaaaccttgccaaggactgtatcgccgttgctctctgcctaaataatctctttctatctcctgtatcacataggccagtatggagggtggggacgggatgtagagcttctctatcttttctgagtatccgctgtcccagaacattcaggtgcttaccaacctggaagctccataatctccactgttagggtttttatatggggtctcgttacataggctcgattgattacatcattggccattgttgattaacacaatctcatctttcttctcttcctgggggtcaaggttggagctgaaagttcccaccctctagtcacgtggctggcttctctggcccccaccctctcaccctgaagctgtctaggggcccagcagggatcacctcacttagcataaactcagatttgggggaaagaggcttgttatgaataacaaaacacactcctatcactcaggaaattccaagggtcttaggggctccacgctagcaatttcaacaaagaccaaatacatatattttattataccacagacacagaggcctttggagctgaggctggatgctactctgtgtactgaagacactcactcgggccttaaggtcaaggtacaggaggccctgatttccagcaatgacatttcacagtgccagcccccacgtgccataatatctgttcccatgcaattaagcataagggctttatacttgccttgtgcacatggctgagcaatggcagagatttgaatagggtggctgatgtggagccacatcacgatacaccctgtgtgagtgtgttaccggaaaggagtgtcatctagactcccaatagtgggttcttggatcttacacaggaaagaattcagggtgagttgccgagtatagtgaagctaagataatgtattagagactactcaattacagaataggctatcctcagaaagcagaaggaatacactcacgtcaaatacaatgcttgcttaaatagaataacagagctaagaataatgttttgttgttgttgttgttgtttgttttttttttttttttttttttttttgagacagagtctcactctgttgcccaggctggagttcagtggcacagtctcagctcactgcaacctccacctaccgagttcaagcgattctcctgcctcagccttcagagtagctgggacgataggcacgcaccatcgtgcctggctcatttttgtatttttagtagagatggggtttcaccatgttggctgggctggtctccaactcctgacctcaagtgatctgcccaccttggcctcccaaagtgctgagattacaggcatgagccgctgcgcccggccagaataaggtcttacatgctttattccaaaggtttgtgatcaggttgtgacaggcaattagtattgctattctcttgtgtaactgttgatttcagcaagaattaataggtatgctattatctttaaagcaaaactttttttttgagacaggatcttactttgtcacccaggctggagtgcagtggtataaacatggctcactgcagcctcaaccgcccagggtcaagctatcctcctgcctcagaccgccaagtagctaagactataggcatgcgccatcacgcctggccagtttccaaatttgtttatagagatgatggtttcaccacgttgccaggctggtctggaactcctgagctcaagcaatctgccgaccttggcctcccaaagtgctgggattacaggtgtgagccgctgtgctcagccttgaaacttatttttaaactaaggatgttttttcttcttaagatatcagggcatcaggacatctctttaagttcgaggtcttatttagttagttaactcatcccttccaccataaacaccctgtaaccaagagtgcctaacttcctgggaatgtaacctaccaggtttggctttatttggccattattcaagatggagtcactctggttgagactcctccaacaggtggatccattccgccatggaggggttgtgctaagcatgtatggactgaggccatcctggtaggtgaggaccatgtagctcaggtcatgcacattgcgcctcgggaaaatgcctcccaggagagcatggagcagctgggatgaggacagcccttccctcagccaactgttccaccatcaaatcgcatttacgaagtgcccacatgctcttaggagcccataaacaccgcaatctgtggctctaaccctcactccttccagtcgaagtgttgtggggccccaggggacctccggatctgcagagggggtgcacttgtctctgggtctcctgttcccacaagaaccacctaaagcattgcctgcgtttccccgacatggcgttggaatgttccagaatccctgagccttgctgtgcctttgtagttatttattgcctgggcctctcattcagtgcttctcttacaggcttggagttttcttctttttttctcaattgcctatatgtttatcttcccaactggtttatgagctgactatgggttgcatctttttttttttctttttttttgacacggagtctcactctgtcgcccaggctggagtgcagtggcacaatctctgctcactgcaagctccacctcctgggttcacgccattcttccgcctcagcctcccgagtagctgggactacaggcgcccgccaccacgcctggctaattttttgtatttttagtagagacagggtttcaccattcaccgcatggtcttgatctcctgaccttgtgatccgcccacctcagcctcccaaaatgctgggattacaggcgtgagccactgcgcccggcctgggttgcatgttttgctgccgctttttggtctgctaggaccccacccagaggagaacaaacactggggcttggcaccacctgcagtcaaacctggtcccaccacctctagttgtgaagttttggacaagggctcatacaggcaacctcagcactttgggaggctgaggcaggagaattgcttgaggccaggagttcaagaccagcccaggcaacagagcaacaccttgtctccacacacacacacacacacacacacacacacacacacacacacacaaacacacacaacaaaaaacaaaaacaaaaacaaaacaaaacaaaaaaaattagccaggtgtggtagctcatgcctgtagtcccagctacttgggagattgtggtgggaggattgctttgaggctgggaggttgaggctgcagtgaactatgattattccaccaaaccgcagctgtgtgacagagtgaaaccctgtctcaaagaaaaaaaaaaagatatttcaagcaagctatctactttttcagagcctcactttgcccatcaatgaaatgggaaaaaatgatgcatatcctccagagtgttggaaatatcctccagagtgttggaaagtagagaggctgcttgaatgtgtctggtgcatggtgggcacccatgaaacaggtccaatgccagcctgtgaaaagcatgtacggctggcaaagccctgagccctcaacatcacttccttttactttcccagtaaccctgggcagcaggcaggcaacactgtgttcccattttacagatgagaaagatggggtcaggtggttaagtgattggatgaaggccacatagatagtaagtgaatgattgatcctacaccagaaaccgggcttgcttttcctggcaccatcctctctgaggaggaaatgaatgaatcaacaattacaatacagggttgggctgggtgtgatagcttatgcctgtaatcccagcactttgggaggtcgaggtaggaggatcacttgagcccaggaagtcgagaccagcctgggcaatatagcaagaccccatctctaaaaaaaaaaattagccaggtatggtgtcacacacctgtagactcagctactcagggggctgaggtgggaggatcgcttgagcccagaagtttgaagctgcattgagctatgatcccgccactgcactccagcctgggtgacagagccagaccctgtctcaaaaaataaatgaataaaataaaataaaatacagggttgcactgtgtctggggctatggtgaaaggcctctgcatgatggtagagggaagaaaagatttctattctcatccattgctaagtccatagttaatacccctgtgacacaagatagattaacaagagaaaaacatgcacatttgtttaagttttatgtgacataggaaacttcagacatgaagacccaaagaaacagggagacctgtgtatttttatgctaaatttgataaaaaagcggacagctgtggagaagtgtgattgcacaaaaagagtatgatctcaggccaggcgcagtggctcacgcctgtaatcccagcactctgggaggccaaggcgggtggatcccttgaggttaggagttcgagaccagcctagtcaacattgcaaaaatccatctctactaaaaatgcaaaaaattagctgggtgtggtgtggtgggtgcctgtattcccagctactcgggaggctgaggcaggagaatggcttgaacctgggaggcagaggcggaggtgagccgagatcgcgccactgcactccagcctgggcaacagagcaagactctgtctcaaataaaaaaggtatgacctcatcataacaaactgggtgaaacttagcaaggcatgttcagattcttctctgtgtccctgtgtcctcagagacaaggatgttcctttcctttaggtagggagggcacctctggggtaaaagtcttatgatctactttagaggaaagtcagagaattcttttatgacccgtgtcaggggaaaagtgtgggggaaagtcagaaagaacttcctgcttctgctgttttctcaaacaccaacataccatatttaggggtacagtgtcctgagccccactgatggagagaagcaggggctgttatttccactacagaaggttttcagaggccttattcacacacaaagggtgagggtggatttcagggccactaagttacgggctggacgcgagtgtgtgtgttcgatgtgtgtgtgcgtatattgtgggcctggtgtgtttccgtgttgttgtgatgtgcatgtgtgcctactgtgtattggatgtgcgtggcgatgatgcatgattctgtggtgattccttcctttccttccttccttcctttttctttctttctctttctttctttctttctttccttccttccttccttccttctttctttctttctctctctttctctctctctctttctttctctctctctttttctctctctttctttctctttctctctctttctttctctctctttctctctctctctctttctttctctctctctttctttcttctttctttttttctccctctctctttgtctctctttctttctttcttcttttcagtatctcatgttgtcacccaggctggagtgcagtggtgcagtctcagctcactgcaacctctgcctcccaggttcaagtgattcttgtgcctcagcctcttgagtagctgggattacaggtgcatgccaccactcccagctaattgtgtgtgtgtgtgtgtgtgtgtgtgtgtgtgtgtgagtagagatgggtttcactatcttggccaggctggtcttgaactcctgacctcaggtgatctgcccacctcgacctcctaaagtgctgggattataggtgtgagccacagtgcctggccaattctgtggtgattacatatatgcccatgtgttagtgttgtcaaaagacaaaatcataacaaatgtagttatagatctaattggtttttattcaaggtttatcaattcgggcagtcttcattctataaaatagaataagagcttccactgcaatagcaaaacactgggttttgtaagatggaaacaaggaaatagaatgataggaaaaaaccgggttggttaacatcgggttacttctggttacttggttactttttttttttttttgagacggagtctcgctctgttgcccaggctggagtgcagtggcatgatctcggctcactgcaagctctgcctccagagttcatgtcattctcctgcctcagcctcccgagtacctgggactacaggcgcccgccaccacacccggctaattttttgtatttttagtagagacggggttttaccgtgttagccaggatggtctcgatctcctgacctcgtgatccacccacctcggcctcccaaagtgctgggattacaggtgtgagccaccatgcccagccattttttttttttttgagatggaatcttgctctgttgcccaggctgaagtgcactggcacgatctcggctcactacaacctcctctgcctgggttcaagtgattctcctgcctcagcctcccgagtagctgggattacaggcatgcaccaccacgcccggctaagttttgtatttttagtagagaccagatttcaccatgttggccaggctggtcttgaactcctgacctcaggtgatctgcccgcctcagcctcccaaagttctgggattacagccatgagccaccgagcccggcctctggttacttttttgtaagggttaaggcaagggggatgtctgtattatactgactcaggtagactggaatctcctcttttcagggaaaactggtctgttagtgtgtgaattgtaaggtattgtgtgtctgcgtgggatatgcgtgctgtgtgtgtagttagtgtgaatgatacatggtcatgtttgtgcgtgtttgtgtgtgtgcattagcatgcggagtgtgaggtttgtgtgtgtgcagtttgcacagatgtgcagtgagtgcatagtatgtgtattataagccctcagtgaccctctcttgggctggttggatctgcctgagaaaatttgtctactcttgtatctggagggtgtacatctggccatctgccagctaggagctgagggggaggaagggtgtatagggagtatcttgatattcagtgtctaaacttgcacttaattcccagttttcagtatagttctcagaccctcaatcatacctggtattcttcagtcatgagattcccccattttttctctcctaagaataagcctccagatttctgcctgagtgaaggggaggacacagagacatcctctttctttgagactttgaacctatcttgttttcagcacctctgtataccttcatttgtccaagtacttggtatgttgccattgtgggaggggtgttctgcggtgtagatgagattttctcagctttccctgacctttcgtgggtcagtaaaatcagctaccatttgtccatttgttttgcggtttccacatttctgttgctgttgactcttttacccttgtcaatttctttgttcttgtccattgatatttcttttttatttatttattttttgagacggagtctcgctctgttgcccaggctggagggcaatggcaagatctcgcctcactgcaacttctgcctcccaggttgaagcgattctcccacctcagcctcctgagtacctgggattacaggtgctcaccactacgcccacctaatttttgtgtttttgtagaaatgggtttcatcatgttagctaggctggtcttgaactcctgacctcaagtgatccacccacctcagcctcccagcgtgctgggattacaggcatgagccgccacgcccagctcattgatatcttttaagaaaacacaaacctttctgtgacttgaggtgcggtttcgggagagcgtggtggtaaatgtgtgtctgctatctgtgcccaaaacagatgagcagaggaaaataaagtgtccttttgtaaaattaggtcatgacacaggacagccagactcagtcacccttagtgtccctctcaccattctaatggtaaagttaaaactctgaatctccaaaatttacataagaaatatttcaaattaaccgaaagtacacaaaacgccccataaaatacatatatacttaccactaagatttaacagttgttagcattatgtcatatttgcttcagtgtttcctttttaactttttattttgaaataatccagaacagtgtattttaaaggaataaaatgttatgggtatggctaaagtcaggtatcctgtatgcgttttctctttttcaaaatgtgacactaatcaagttggtgggtgtcattcctagacaaatttctctacttttactacatatatatttatagctataaacaaaacatactattgtgtgttttaaaatttgcataatgatgttctgctgaattcatcattttgtagcttgctttttcacttgacaaaatagtagtaagatctatacatattgactcttttgcctctcattgattttaactgctttatagtatttcactgtggggatatactgccatttatttatcattcccctactaacagatatattgcttctgctttttcacaattacaaacagtgctgcagggactacctttgaatccttgtgcatgcgagcaaaggcttgcccagacagaaaatacttacagttaattcttctacatattgtcaattgctctccaaactcagtgttccaatttccacttcaccagcagtgtataaaagttttccattattccacagtctagccaatttttggtgttactagaattattacattttggacacaaatggatgagaaactgtatatcattttaaaatttgcatctccctaatacatccaaatttaagcctctttcagttttgtttgttcaaaaattagtctttagacatcgctcttgaatgatggtttagctgggtataaaattctgggttgacagttatatttcctctgcattttggagatattacaccattatcttctagcctctattgttgctgttgaaagatttactgaaggtgtctttggaggtaattcattccttttctttggttgattatagtattttgtcattatatttggaattctgcagagccactatgatttggtgtctagatatgtatcagtttacttacccatttaagactctttgtaaatcttgaatccttgatacatgaggatccacatatttttaaatcaattccagaaaacctcaagctattatctcttcagattttgcctctttataaaatttcctctattctttgtttctggaactccttttattatttgtttgtttgcatttttattggcatatcatcattgtacatattttgggagtacatgtgatattttgatatgtgtatataatacataatgatcaaatatccatcacctcaaatatttatatttttcctgtgttggaaacattacaattcttctcttttagctattttgaaatctataataaattattgttaactataatttctctactgtactattgaatactaaaacaattttttttaagagtcagggtctcactagtttttccagactgttcttgaactcctgggctcaagcagtccttccacctcagccttctaagcagctgggatttagaacttattccttctatctagctgtatgtttttacccagtggaagttctttcagataatatcctcattctctcattctatcctctgagtctctaaactgctcataatttctatttcttttgcattttgggcaatattctcagatctagctttcattttatttgtcttctcttcagtgtgtccaataagactttttatctgccaatttaattattattattctaatttttccaagttatacttagttccttttcacttctaccctattttcaactccttcttttagctctttgatatttttaaacattcttattttacacatgtcatattttatttcatattagagtttttattttctcatgttgctggggctttaatctttctgattgttttaatttatttttgtttgtttgtttgttttgagacagggtgtcactctattgcctagcctggagtgtcatagtgcaatcctggcttaccataaccttgaccttctgtactcgagtgatcctcccacctcagcctcccaagtagctgggactataggcgtgcgtcaccatgcccagctttttggggggtattttttgtaaagacagagttttaccatgtagcccaggctggtctcgaactcttgggctcaagcgatcctcccgccttggcctcccaaagtgctgggattacaggtgtgagccactgtacctggccttccctggtgcttttatttcctctctcattgttgcttgtttccttgtttgttttgtaattttttatggttaactcatctttgtcacagcttgtttttcaatgagaaaacaagcagtccggattgtggaaccattcttccacaaagctttgtaaggcactccagaatatcctgggcaggagttgattttcatgttagtttcttgatttgtgggtttctggataaatgctagtgaatttctgatattaattcaaacctcagatccaaacaaggcacaggcctgaggtttggatgttatcaggggagattttctttttaaattcaggcaaagaggagatgccacgttgttccctcactctgctgatcagcagacagttttctagcaaatctttcatggaaggttgtcattccttatttcatgggttatcagaatgcatgggtgtaaaaccccacactgaaacagctaagttactatgatagccaccccacccaaggtcagttatagcatctttatgatttcatatagcagcttctgtgtcttcagtttttctctttattcttgtaagcacctcctttctttcttgggaactcagctatgcatttatcacaattatatatatatatataattatatagaatctcccaaaatatatatatatatatatataattgaaacagggactcactgtcaccccggctggagtgcatggcacggtcatagctcactgccatctcaaactcctgtgctcaagcgatcctccctgctcagcctcctaagtagctgggactacaggagcataccaccacacccagctgatttttaaatattttgtagaaacggggtcacgctatgttgcgcaggcttgacttgacctcctggcctcaagcaatcctcctgcctcagtctcccaaagtgctgggattacatgcatgagccaccccacccggccaatttttggtatattttgtccagcattccaaagtgtttgtagcagaggtttttctggttatcttacacaccatcctgttaaagaggtatctttttaaccttcttaagtttcaatttctttatttagacagtgggaatattgtcctttctacaaagaattatcgggactaggtaaggatttaagtaaacaatctaaccatgtggtaagtgcaccataaatgctaacaataatgattattattacactaatatcatatgtactctttttcctttttttttttttcctagaccaagtctcactctgtcacccaggctggagtgcagtggcatgatctcggctcactgcaacctctgcctcccgggtttaagcagttctcctcccgagtagctgagattacaggtgcctgccactatacctagctaatttttgtattttttagtagagacggggttttgccatgctggccaggctggtctctaactactgacctcaagggatccacctgccttgtcctcccaaagtgctgggattaaaggcgttagccaccaccgcgcctggccttctttttcctttttattgatgtttttatgtagctcagcatgaggcctttgaaaataaaatagcccattttctctcactgtaagttgcaatctttaattgcaccaaattcctcccaagaaggaagtggcagaaaggcaataaaatgagaagtgagtgctcttatattgtgtgagttacattaacatacattatctcatatcacccctatcataatcccatgatgcaggatattgtaatagtcaggatggactaggttgcactttggaaacaaacagtaccaaggttttagcaggttagcccagcacaagttcctgtcttactcctgcttcatgtgcagtgctggtcagtggctgagcatctcagggctccttagggtgactcacgcctgtaatcccagcactttgggaggccgaggcgggtggattacttgagaccaggagttcaagaccagcctggccaacatggtgaaaacctatctctactaaaaatacaaaaattagccaggcgtgttggcacacgcttgtaatcccagctactcaggaggccaaggcaggagaatcgcttgaacctggaaggcggaggttgcagtgagacaagatggtgccactgtactccagcctggacgacaagtgagactctgtctcaaaaaaatgaaaaacaaaacagagttccttaggcacagaagttttaccatctggcagctgtgggatgcctgggaagttgcgtgtggatcttttacggcctcaacctcttacaacttaactggtgcaaacaaatcatatgaccatggtctgctttaagggagcagggaaatgtagggaagaaaatggggcatttagtcactacatttgtctctgtcaccctcaaaatagaaagaaagaaattagctttttttttttttctggagacagagtctcgctctgtcacccaggctagagtgcagtggcatgatcttggctcactgcaacctccgcctcctgggttcaagcgattctcctgcctcagtcgcccaagtagctgggattacaggcacatgccaccgtactcggctaatttttgtatttttagtagagacggggtttcaccatcttggccagactggtctcaaactcctgacctcgtgatccacccacctcagcctcccaaagtgctgggattacaggcatgagccactgtgcccagcctttttaatttaattttattatttttttaaagagacagggtcttgctctgtggccaagcctatagtggagtggcgtgatcatagctcattgcagccttgaactcctgggttcaagccatcctcctgcctcagcctcctaagtaggtgggactacagatgcatgccaccatgtccagctaactttgttttttttttgagacagtgtctctcattgtcgcccaggctgctggagtgcaatggcgcgatctcagctcactgcaacctccacctcccgggttcaagtggttctcctgcctcagcctcccgagtagctgggattacaggcacacaccaccactcctggctaaatttttgtatgtttagtagagaagaggtttcactatgttggccaggctgggctcaaactcctgaccttgggatctgcccacttcggcctcccaaagtgctgggattacaggcatgagccactgcacctggccccagctaactttttaaagtgtgtgtgtgtgtgtgtgtgtgtgtgtgtgtgtgtgtgtgtgtagacaaggtctcgctgtgttgcccaggctggccttgaactcctggccttgagtgagcctcccacctcaacctcccgaggtgctgaggttacaaatgtgagctactgcacctggcactagaaattagcttttatttacactttctaagcattcacactgtgcctggttcaggtcttacattctctttagactctcagcaatgctgtgaggtagctttgctgatggagaaacaaactgtgtctcagagacattaaggaacttatgcaagatgccatgctgaagaaatgaattagtagctgtgccaaaatttcactccacatcctatacttcttattttattattattattatttttgaggcagagtctccctgtgtcgcccaggctggaatgcagtggcgtgatcttggctcactgcaacctctgcctcccaggttccagcgattctcctgcctcagcctcctgagttgctgggattacaggtgcccaccaccacacccggctaatttttgtatttttagtggagacagggtttcaccatgttggtcaggctggtctcgaactcctgacctcgtgatctgcccacctcagcctcccaaagtgctggaattacaggtgtgagccaccatgctgggccctttattattatttttagatggagtcttgctctgtcacccaggctagagtacagtggcacagtctcggctcactacaaccgtcacctgggctcaagtgattctcctgcctcagcctcccgagtagctaggattacaggtatgtgccaccatgcctggctaatttttgtatttttaattaattaattaattaattaatttttttgagacagagttttgctcttgttacccaggctggagtgcagtggcacaatctcggctcactgcaacctctgcctcctgggttcagatgattctgcctcagtctctgaagtagctgggattacaggcatgcgccaccaagcctggcaaatttttgtgttattagtagagacggggtttcactatattggccaggctggtctcgaactcctggcctcaagtgatccacctgcctcagcttcccaaagtgttgggattacaggcgtaagccaccatgcccggcctcacatcatatatttctaccgggggagagaaagagtcagaaaaaaagagaagcatacatggaggaaggagagagaaggccagaggtcagctctgcacacgccggtgctgagaggtgatgctgcctcacctgcctgagccctgggagcagtcaggttccagctcacctgcgtgaggtgctcccagaggactttcacatcaggccagacacatgcatctttggagacacattttgacgtcaggcatgaacgctgagtgacaagtatgagtttgggtctttttcgtcataggctatgatgctgcaggggcaaccaagactcccctgggacacacgcttgtgagctaatggaccagaaagggtgtgatcctcatagtcgcttccttctctgtgcccccagtagcttgttctggcctctgttacaggtcttgccacccaactccaactcccctgcctatggctgcctttgtttacctgccgtcatctgatctctgcatccccagtgccctggacagggtctggccctgaagagccctcaggaaaggctctttggtgagacagatggacagttctggcaaaaacctgtatgtgctggggctacaggtgttgggggtgggagcagtgggaggcagagggctgagatgagccgaggcccagccgcggcagccatgtgaccttgggattgtcccatcctgtctctcaacctctgatagtggtgtggggtgtaaagtgatctcagcggagcccgggcacgatggctcacatctgtattctcagcactttgggaggccgaggcaggtggatcacttgaggtcagaagtttgagaccagcctggacaacatggtgaaaccgcgtctctattgaaaatagaaaaattagctgggcacggtgacgggcacctgtagtcccagctactcaggaggctgaggcacgagaatcacttgaacctgagaggcagaggttgcagtgagccaagattgcagcactgcactccagcctgggtgacagagtgagactgtctctaaaaaaaaaaaaaaagtagtctcagattctctgggattttctgggattttcggatccgtcttcaccctctgggcatagttgacccttgggaagggaacagacagcgatcttcagtttcacaaggggactaagctcaactgttcattccacgtcccccccaaccccacagcctgaggctgtccgtgtcataccccatagggagctctgaagcccggtcttggggttcacaggccagcctcagcagagacattgaggacagtgggggctccaggtcagacttgcacaggcaggtccctgcacaggcagctttgcggtggcgggaagggctggagacagccctcacccgcccgccctggccctgccgtcagcagctgcagggaagaggaccgggcgcatttatagaattcctgcctgcaaaggccatgcagttgttttaaattagcatacaaatcgacattagtgtagtacatctgttgttaatccacatcccggtggaacggagatgccaacacgccttttattaggcacgtcgatcccataatgtcctttctccctgcctttgtcttctatcagagtccgtaatgggttccaggatgtcttttattttgctatggaccacgtttcctcctgcccagcggatcagaaacgtaatggattccaggatggaatttatgttcctttggaatcagaccctgtacgatgaattctaaagccttcgggcaaatctccagggaggccgtggccctgtgtttgcccccatggtcatcagacaggcaccgggaacccgggcacagtcccagggctggagggggaggaagggagcctgggccgacagctcccaattaagggaattccaggcaggcgtgggaggagaggccaggggtgctggtggagacagacagggaagctgggaagatgcagggcggggaggagggggcacagatattctagaaacccaggaaccggcagcaccagtgtttctggggctggtcacagacactggacaccagtttgcgaggtcctggagaaaaggaccttgaccctgagtatcccagcaggcctggggaggagggcagggtgttgtgagccagagactgcccttggggctaaccaggccgggactaagatacccagctttaccctttgctcatggcatggccctggagagtcactgtctcttgctgaggcttggattccatagcctgcaccccatcaccccgtgtcagcaccaagggctccccagccagcatgcctcctctgcctgctaccaggccttcaaccagtttcctcgggttctttcaaccccctctctcacgacatggctctcggtgccctccctgccatcttggctccttctagggcacactcgaggggccccatctctctcaagagaaggactcaaaccatccatgaagctggggctgtggagggcagggtccaggactctcctcccacctctgagatgccgcgctcctgtgcaaacctgagaccctcggccactctggccaccactgtgtccccagggcctccagtcctccagccagccctgtggttggccaccctgcccgtaagataagcccacgccctgtcactggggctggaggggctctgagcagaaaagatcaccttcaggggcaggtttggcccccaccacaacactgattttccagaccacaaagtgaacccaccctgcacccaccggctatcacagtatcgttttttattttgttatagagatggggtctcactatattgcccaggctggtctcaaactactacagtgtcttttacattgaaggctttaaaaaaattgtgattaggctgggcgcagtggctcacgcctataatcccaggactttggaaggtcaaggcaggcagatcacgtgaggtcagtagttcaagaccaccctggccaacatggtgaaacccccatctctactgaaaaaaaaacaaaacaaaaattaggcagatgtggtggcgggtgcctgtaatcctagctactgggaggctgaggcacaagaatcgcttgaaccctggaggcagaggttgcagtgagctaagatcgcgccactacactccagccttggtgacagagtgagactctgtctcaaaaaaaaaaagtaattaaatatacataaaatacattttaacattttaatccgtttttaattttatttaatatatatatatatatatatatatatatacacacacattttttttttccagagtctaactctgtcacccaggctggagtgcagtggcgcaatctcagctcactgcagtctctgcttcctgggttcaagtgattctcctgcctcagcctcctgagtagctgggattataggtgcccgccaccacgcccggctattttttgtattttcagtagagacagggtttcaccatgttagccaggctggtctcgaacccctgacctcaggtgatcctccctcctcggcctcccaaagcgctaggattacaggcgtaagccaccgcgcccgaactttaaccagttttaagcgttcaattcagccgtgttaggtaccgtcacactgtcgtccagccatctccactgtccatcttcagaactttttcattgtcccaattaaattgcagacttttaaaggaggaaaaaaagtttattgtgtgtgtcctgtctagcgcactcttccaggttagttgtaccttttattgtctttgagccagtttacagctctgtaaagttgtgcagtaatcatgagaatggatttttgtccacgttcctgtaagttaattgtgtccggtggaatgcaattggatattgccctggggacaaacctgttttgcgtctatttgtaaattcacagcagcattccgtgtttgcctgcaagattccgtgcttctacgaatttgcctttgaaccgcccatggcatctgtctgctttgttccctctttgattaatgtgttaaataaaatctttgacacatgttcattttctacttgtatgagagccgtgattttttttttcctcttgtgggaatcagtcctttaacaacaggactttagtctgtgggattggaggagctgtggtttaacccctgagattcctcagccaaaggcactgtcccacatgaagttagaatatgtggagtccagctagggaaagaggtgccagatatattccatcctctgtcaccctaagagcaaatgacagtgattctgtgctcagcctgaccagagctgcaagagacctgagagcctctctccaactggctcatgttacaggaacagggtcctgatccagacgccaagagaggattcttggatttcacacaagaaacaattcatagctcacctcagctttgaactcctgggctcaagagatcctccttcctcagcctcctaagtagctggaggtatgcaccaccacactcggctattttctttctttttctttctttctttctttctttctttctttctttctttctttctttctttctttctttcttccttccttccttccttcctttctttctttctttctgtctttctttctttcattctttctttctctctctctttctctctttctttcttgtctctctttctttctttctttctttctttctttctttctttctttctttctttctttctttctttctttctttctttctttctttctttctttctttctttctttctttctttctttctttctttctttctttctttctttctttctttctttctttctttctttcttgtctctctctctctctttctttctttctttctttctgatggagacttgcactattgcccaggctggagtgcaatggcccgatctcggctcactgcaacctccgcctcccaggttccagtgattctactgtctcagcctctcaagtagctgggactacaggcacctgccaccacacatgggtaatttttgtatttttcagtagagatggggtttcaccatattggccaggctggtctcgaactcctgacctcgtgatctgcccgcctcggactcccaaagtgctggaattacaggtgtgagccaccgtgccgggcctttttaaaatttttaagtagagacaaagtctcagtctggctatgttgcccaagttggcctcaaactcctgagctcaagcgatcctaccaccagggcctcccaaagtgctgggattacaggaatgagcattgtgcccggccaacagtccatttttatgggcggcccatgataaagcagagaggcaggccaggcacagtggctcacacctgtaatcccagcactttgggaggccaaggtgggaggatcacctgaagtcgggagttcgagaccagcctgaccaacatggtgaaactcatctctactaaaactacaaaaattagctgggtatggtggcacaagcctgtaatcccacctactcgagaggctgaggcacaagaatcactcgaacccaggaggtggagataacagtgagcggagattgcaccattgcactccagcctgggtaacacagtgagactctatctcaaaaaaaaaggtcgggcactatggaccatggctcatgcctgtaatgccagcactttgggaggccaaggtgggcggaccacctgaggtcaggagttcgagaccagcctggacaacatggtgaaacgctgtctctactaaaaatacaaaaattagccaggcatggtggtgggcacctgtaatcccagctactcaggaggctgagacaggagaattacgtgaggttgcagtgagctgagatcacgccactgcactccagcctagggacagagaatggctctgtctcaaaaaaaaaaaaaaaaattagctgggcatagtggcacatgcctgtattcccagctactcaggaggctgaggcacaaacattgcttgaatgtgtgaggcaaaaaaaaaaagcactattaccttaagccctgtgagcctcaattttctcacctgaaaaatggggatgattgtgcatgctcccccctgcacggcatggtcagctgtgtttgaagccaccttcaactagatcacgagagctggttttgtgtattgcctcccaactcccgtgcaggggtgtcgtattggtggcttgaaattggccatgctgggagtatttacaccatggaaattgacagacactacagagagctggttgttaaacacttaccagcacaccattggtggccatcccaaatgtgtggttgtgttacaagaaaggggtcccaatagagaccccaagagagggttcttggatctcacacaagaaagaattgagggcaagtccacagtgcaaagcaaaagcaagtttatgaagaaagtacaggaataaaagaagggctactccatagacagagcagccctgaggggtgctggttgcccatttttatggttatttcttgatgatatgctaaacaaggggtggattattcatgcctcccctttttagaccatatagggtaacttcctggtgttgccatggcatttgtaaactgtcatggtgctggtgggagtgtagcggtgaggacgaccagaggtcactctcatcgccatcttggttttggtgggttttggccggtttctttactgcaaactgttttatcagcaaggtttttatgacctgtatcttgtgctgacctcctatctcatcctgtgacttagaatgctttaaccatctgggaatgcacgcagtagatctcagcctcattttgcctagctcctatttaagatggacttgctctggttcacattcttctgatagttggaggacctggcatttgggatgcatgtcccctctgaggtgtgggaactttggtacaacaggatgggtggacaggctggggtcctctggggaaaatcctgctgggatggaatgatgagggcagggtgctcacctggaggccaagacagtgggggccagaggaagccgctggtaagcctggatgttgaatttaagagggtgagaactgaatcctcttggaagtgacatttcctgctctttcctcttgtccagacagtagaatcttgacggaaaactactgttattttcccttaagaaaaagcaatagataaaaataatagcaaaaatcacacggaacatgatgaggatttgccactgtttcttggggagcctctaggtatgaggtgtggtgggcaaaccatggccatcaactactgtcaaaattattattttactttaaaacaattatttattattttttaaaatagagttgcaggccgggcgcggtggctcatgcctgtaatctcagcactttgggagactgaggcaggaggatcacctgaggtcaggagttcaagatcagcctggccaacacggagaaaccccatctctactaaaaatacaaaaattagctgggtgtggtggtgggcgcctgtaatctcagctactcaggaggctgaggcagaagaattgcttgaatcccggaggtggaggttgcagtgagctgagatcatgccactgcactccagcccgggcaacagagcaagactctgtctcaaaaaataaataaataaataaataaataaataaataaataaataaataaataataaaaatagagatggggtcttgttctgttgcccaggctggagtgcagtggtgtgattacagctcactgcagcttccagctcctgggctcaagtggtcctcccatctcagcctccaaagtagctagagctacaggcgtgcaccaccacgcccagctaatttttgataggggtcttgctgtgttgcccaggctggtctcaaactcctgggctcaagtgatccttcactttggcctcctggagtgctgggattagaagtgtgagccaccacacctggcccattgtcagatttagtcctcaaacaagatggaaatcatcattcccctttcacagaggagaataagaatggggaagagaggttactttattcagggacattcagccgggaaatgtcagagccaggatctgtctcaagccaaagtgtgtctttccccatctcactgcaagaagctaggacggaccaggctgcccacccccttccccctgcccttgcctccctccccaccccgcccactctatcagactggccactcttccctccttcctccatgcttaggccccagtactccacccttaccccttcagtgtttgcctggcaggctctagtccatctgcaaaggctcagctcagaagtccccgcctccatgaagccctcctgactactgggttcctgcagagctggcttttgccattagttcaagtcctcaccacactaggtgagaacagctgtcaccttggccagggctcttcgcttgtggacctctttggccgtctgctgaatcctgtagactcttactcagaacggtatttttaagtgcataaaatgagctatgaggattatcaatgaccatgaaatacagtgcatcggaattttgttttaaaaaatcaaattatggccgggcgcggtagctcacgcctgtaatcctggcactttgggaggccaaggtggaggatcacgaggtcaggagattgagaccatcctggctaacacagtgaaaccccatctctactaaaaaaaaaaaaaaaaaaaaaaaaaattagccgggcgtggtggcgggcgtctgtagtcccagctacttgggaggctgaggcaggagaatggcgggaacccgggaggtggagcttgtagtgagctgagatcgtgcctctgcactccagcctgggcaacagagcgagactctgtctcaaaaaaaaaaaaaaaatacagaatgatgagtgtgtttctttcctaacgcaaacagcaagatcccacagtaaggctgacaactttcagaatgttggagtagaaatgagcgggaaaggtatttcaagacagtggcaataattgtgtgaattcgattgggaacgaagacacaggtacttctacttctattgcattgtcgttttgttttgttttgttttgtttgagacagagtctctctgttgcccaggctggagtgcagtggtgttagctcactgcaaactccgctgtctggcttcaagcaattctccttcctcagcctcccgagtagctgggattccaggcacttgccaccatgcccggctaatttttgtatttttagtagggatagggtttcaccatgttgaccaggctggtctcgaactcctgacctcaagtgatctgctggccatagtctcccagaatgcagggattacagatgtgagccactgcgcctggctgtctattgcattgttgatgttgttgttactacattcataataggaagagatgctaaatcgcagtttggtgaaagtaaaggcgtagttctatttcctatcaaagttcacccatccctgatttctatccttggaccctggctaagagcctaggttacagactcagagccccttgaggggcaggattgagtttcgtctgcatttccagccaggtttgcacattgcagacaagctgactacagccaatcatgcaggtttggtgaatgggtgagagagtgaattaagtcaaggaagccacagcagggggcccagcccgctcctcctccagtcccagctcttccagctgcacttgtttaatggtatgaacgtgacttggcttggtcccggcgccatggctgggagcacaggctgcccagagcgtacactgcaggttggaagcgagaccctctctctgaatcagtgtctgaatgtgtgctgcctagagttggtcgtgattcatctcctctatggggagaggggctgccttcatctcagccctgggcttccttccccgtggcttccaaaccctccccctggcgaaaggcagcctgaaggagctgctgcggtttaagaaagtaattgacctgatattattctggcctggagaaaaagatcctgagtgttgtcttaaagaggcattacgttatctgctgagaatgtcaggagatcagggggatcggtgcccccctcccacctcaggtagaggagccatcagtcccagctggaacccaacacacagggctagagctttatctgcctgaggcagccaggatgtccggcagaacaggtgctggagaccctggtagtcagagctttccaaaacatgttgacttgatttccctctctttccaagagaagctgtcgagcaattcaagcttccagggcacctctggcggggggatttggtgcatgggcacaggcaggggctacgtatgggcagcctggggaatttttttttttttttaagatggagtctcgctctgtcgcccaggctggagtgcagtggcatgatctcggcttactgcaagctccgcctcccaggttcacgccattctcctgcctcggcctcccgagtagctaggactacaggcacccaccaccatgccaggctatttttattttttatttttttatttttagttgagacggggtttcaccatgttagccagaatggtctcaatctcctgaccttgtgatccgcccacctcggcctcccaaagtgctgggattacaggcatgagccaccgcgcccggccagcgtagggtatttttgccaccacatctggcatctggtcactctgtgcctagggccttcaaagtcctcacacataaccagaaacgtggctcaaggccgggcgcagtggctcacacctgtaagcccagcactttgggaggccgaggcgggatgatcacacgaacccaggaatttgagaccagcttgggcaacatagtaagaccctgtctctacaaaaaataaaaaaaattagccaggcctgcggtaccagccacttgggaggctgaggcaagaggatcacttgagcccaggagattgaggctgcagtgaaccatgattacaacactgcactccagcctaggcagcaaagcgagaccctgtctcagggaaaaaaataaaaaaggcggcttagcatgactaggcatggcccagttcccagcagcccacgtctcctggcaaaccggatgttgcatttcccaagaccatctgcttccatccagagtggagaactcctactggtcagagtctaaaggcagctgattcctggaccagtcggctgtggccagggccatggggttaatgcccgggtaactgaataggttcattgcccaatgcacacagcaggtcaatttaccaagacaccggattgcagcagagaaaaaggtttaatcatagcgtcactaaatgaggagatgggaggaaacctcaaatctatctccctgaggagtttggggctggggtttgggggttttggagtgggctgaagtgtggagatggttgatgggtggaagagtgcagggcgaggtcctgggactgagaggggaagaagctgtgttctacgctcatcctcttcctctgtggggtcttcaaactccacaggaaaggggtgcagatctagaccccaagagagggttcttggacaggggcggtggctcacccctgtaattgggaggccaaggcggatggatcacttgagccctggagtttgacaccaggctggccaacatggcaaaaacccatctctaccaaaaatacaaaaaattcccaggcgtgatggcgcgtgcctgtaatcccagctactcaggaggctgaggcaggaggatcacttgaacctgggaggtggaggttgcagtgagccgagatagtgccattcaacctgggcaacacagtgagaccctgtctcaaagaaaaaaaaaaaaaagaattcagggtgagtctgtaaagcgaaagtaagtttattaagaaagtagaagaataaagtccaggcccaatggctcacgcctgtaatcccagcattttgggaggccgaggcgggcagatcacttgaggtcaggagttcgagaccagcctggccaacatggtgaaactccgtctctactaaaaatacaaaaattagctgggtgcagtggtgtgtgcctgtagtcccagctacttgggaggctgaggcaggagaatcacctgaacccgggaggcagaggttgcagtgagccaagatcaggccattacactccatcctggtggacaagagcaaaactccatctcaaaaaacacaaacagaaatagttctggaaacatgacatgtgacccagggagcgggaggctcctcctgtgtcaagttcaccctattttgactaacatgtactgagcaccttgaaacccaggcgctgggctgagcctcttaaaggtatttaaccctggccacatgcagtggctcatgcctgcaatcccagcactttggaaggtcaagaagggtagattccttgagcccaggagttcgagaccagcctcggcaacatagcaaaatcccgtctctacaaaaaatacaaaaaattggccaggtgtggtggtgcatgcctgtagtcccagctactcaggaggctgaggtgggaagattacttgagctcaggaggctgaggctgcagtgagctgtcattgcacgattacaccccagcctcggcaacagagcaagaccctgcctcagaaaaaaaataaataaataaaaggccaggcgcagtggctcacatctgtaatcccagcactttggcagcccaaggtggaaggatcacttgagccaagaagttcaagaccagcttgggcaacatagctaggccccatcttacaaaaacattttttaaaaatttgctaggtgtggtgtcatgcacctgtaatcccagctacttgggaggctgaggcaggaggagcacttgagcccagatgtttgaagcttcagggagctttgattgcaccaccgcgctctagcctgggcaacagagcgagaccctatattcatgagtgttgcaatgagccaagtagtggaggttggcttttgaaggcagaaaaggactgagaaaagctaacacagagaacaaaaagccaattggtcatttcaaagttacttttcttgtaaaggttgaagcagaggatggcttcttcatcatgcaggctaaaactggccagtttggctattgtctctctccccggatttctcagcaggtcggataaggatcttagtttctttttggtgatgtgaatcttagcatgagtgactccattttggtttggtctgttggagcctagggcaggagttcagtccaaaccaatgacctctttcttatcagtttcatgtaacacagaaaaagtaaagccaaggctgcccctagtgctcagttcctcggggctccccctggacacccaacatcctgcctttggggacctcagagttacaccagaatgatagagagaggagacccaggtgtgcacagcccgcagagtgtggcatgagcactgcgcaagaattgggagccccggtttctcacactggctctgagcaccttggtgagccttgagtaagtgtccgatgcctctaagcgtttgtttgcctttctttgcatgagaaacagtgaccctgccggcgacaccaaggctgtggatgcatgtagtggagtctccactctgcacactctggatttatttcgtgatgttgcttttcatttggagaaggtctttgaaacaagcaagcagtgagatgttcttctagacatgtatgttgcaggctttggtgaaattcaacaggatgttttcccaagtcaaaggctattgttgttgggagacgcaggctggagaggatttccccagggtttgcaaaggcgagggaggcttggtgctggctccccaccgcgcgcggcacccctgagaatctggtcttcatcgagcgctctcaggcacggcatgtaagccgatccccgcacaaaactgtgcattaatgaaagttttgacaaagagatttcattttggagctcacgttccctgaagggtttgtaataattgtacttgaaatggagccattcggcctcaatgctttccagattgggggcgcgaggcatagcccatcccgggaaggtcggctggggagggggaggccgcaagaggtgccttggctggagttcgcggggatccctggcactggctgacctggggactgtgtgtccacagcctcgaccttctgcatcctcccagccatcacaaggtgggcgttaggactcttgatttaaagctgagcacagggctgggcacattggcccacatctatactcccagcactttgggaggccaaggtgggaggattacttgagcttgggagtttgagaccagcctgggcaacatgatgagatcctgtctctacaaaatatataaaaattagccatggccgggtgcggtggctcacacctgtaatcccagcactttgggaggccgaggtgggtggatcacctgaaggtcaggagttcgagaccagcctggccaacctggtgaaaccccgtctctactaaaaatacaaaaattggctgggcatggtggcgcatgcctgtaataccagctattctggaggctgaggcaggagaatcacttgaacctgggaggtggaggttacagtgagctgagattgcaccactacactccagcctgagtgacagagggaaactctgtctcaaaaataataataaaaataatattaaaaaataaaaataaaaaaattagccaggcatggttgcacatacctgtggtcctagctaatctggaggctgaggcaggaggatcacttgagctcagaaggtggaggctgcagtgagccatgttgttcacatcactgcactccaacctgggtgatagagggagtccctgccttaaaaaaaaaaaaaaaaacacctttgttatggtttcctgtgctccctttaaaatgtattcaggcacagtgggtaggggcagtgttctacccttacccttgagtggaaactggacattcccataaccatttgacagtcagttgaagtcataagctatgatgcatcaattagctgtcttgttctatggaataagcaaaactccaaacttggttcaggattgaacctgccccttctgcatttggggcctgctattgtggctgtttggagtaggctggggcatgcgtgccttctctgctattgcaacgtccccgcctctctcgccacccttcctagcctttccagggttgaagcggggattgccgggagggggggcaagttgagcaggacatctgtacttgctgtggtctctcctcctctctgggctacaaggctcatagctgcctttctctttggagggacacccctacccccatctcgatcccaaacacttggcaagtgcacttccttctggccgttgcttatggttttttcaacatccaggagtttggagaccacctcccaacttctcctctgctgatgtctgttcattacactggacaggaggtgatgccctggccagcttgctgtctgcatggcctgcatctgatctaaaataccggaccgggcgcggtgcctcatgtctgtaaacccagcacactggcaggccgaggcgggcagatcacctgaggtcaggagttcgagaccagcctggctagcatggtgaaaccccatacctaaaaaaaaccccacaaaaattagctgggcgtggtggtgggcacctgtagtcccagctacttgggaggctgaggcgggagaatcacttgaactccagaggctgaagctgcagtgagccgagatcgcgccattgcaccccagcctcggcaacagagcgagacgctgtctcaataaataaaaaaataaataaatagataaaaaaagaaaagtgccgtgattgtctaaatgaggttgttagaaatgcttaggaaccaccgggcggtggctcacgcctgtaatcccagcactttgagaggccaaggcgggcggatcacgaggtcaggagttcaagaccagcctggccaacacggtgaaaccctgtctctactaaaaatacaaaaaaagtttagccgggcatggtggtaggcgcctgtaatcccagctactagggaggctgaggcaggagaatcgcttgtactgggaaggcggaggttgcagtgagccaagatcgagccattgcacttcagcctgggctacagggcgagactccgtctcaaaaaaaaaaaaaaaagaaaagaaaagaaaagaaaaaaaaaaaaaaaagaaatgcttaggaacctgccagttggaataatcctgtggaatcagggagtaagtgggttgggggccacgagagtcattagctaggagacacgcacacatccccatgtcggccccaggcctcttccagctcccatggccactgtgttgggcctggggtacctaaatgcccccacagcagtggtggggcaaggccaggaggagctcagaggtgagactccttgaagatagccagtttcttcagctccaatatcttcccctgcttcttccatattcaccagacaccgcctccaggaagccttccctggtctgtccagatggaagccaggttcctccaggagctgcccctcttttcagcccttgtcactctctgcctgttgtttctgccccaggcctgtatcctttgcgctgtgtcacactccatttgagcaagatggccactgggttcatccccatggtgcccagcacagggctttgtccaaaggggtgctcagactcttggaggtgcatgctcatagaaagtatgtgtgtgtgagtgtgcgccatgggctgtgtgtgtacatgagctgtgtacaagcgtggactatgtgtgcaaacacaggttgtgtatacaaacagctgagtttgtgtgcgtgtgtgtgcatgcatgggccctgtgtatacatgggctgtgtgtgtgcatagtgagtacatgtacatgggctgcgtgtgcagctccaaaatcttccgccctttcttccggattcaccagacacctcctccaggaagcgttccctggtctttccagagatggaagccaggctccctagaaaaatctagttcaaaactatgcttgaaggccgggtgcggtggctgacgcctataatcccagcactttgggaggctggggcaggcagatcacctgagttgaagaccagcctggccaacaggacgaaaccttgtctctactaaaattacaaaaattatctgagcatggtgccacatgcctgtaatcccagctactcaggaggctgaggcgggggaatcacttgaatctgggaggcgaaagttgcagtgagccgagatcgcaccactgcactccagcctgggcgacagagcaagactcagtctcaaacaacaacaacaacaaacaacaacaacaacaaaaaccagctatgctcaagaaaaatacacacggaatatattgccccttccaaagcctttgaggtcatttggcccaatcccctcttgttctaatggggaaactgaggttccaagaagggattgggctttctatactaacaggtcccagactcagaaactcctgccaagctggaggctaaggcccctcagggactggcaggtgctgtggagaacacaggaccggggccggagttgggctggagctgggctggagccccactgtcaggggggacccaggaaaggggctgttccactgcagcctgggagggtggctggattgggagccccctcatctgacccagtgtgggtgggtggctcagcccatgggagtctcagctcacagggtctagggacgcatgcccccctcttgttgccatgctccccaagcggctgtccaatctcttcttgggcacttacaggaacgggcactccctccttcccggggctgcctggctctgtgctgaaagctcattctctaaggggcgggagctgctctacatggtgtccgcccagtgactttgggtcccaaggtggggcccatctgctgcctcctccttctcagggtgagctgcccagtccctctgtggctccccagggcccagcctgcctgctgcccccagaaccttctccagctcatctaccattgtgaagaatagagcctgggcctcatatacgcagttactcctgttacatgcctttgttgtgatttcttctctcatcagtgatgcaccttcctcccaggccccagaactgggtgttggggcaaggtctgtggggtcccctctcgcctctgttctctaacaatgcatggtgctggtgacaacaggacggtcaccacctcctggtttgtatgtctcagaaatgatggttggaaaatgaaatataaacagcacttctcaaactgtcccacgtgcaggagtcaccctggggggtcctatttaaatgcagattaggattgataggtctgggacagggcctgagtgtcgccctaccctgccctgccttgtcacccaggctggagttcagtggtgcgatcatcactcaattgcagcctcaaattcctgggctcaagggatcctccagcctcagcctcccaggtagctgagactacaggtgtacatcaccacacctggctaatgttcgtatttttttagaagcagggtcttgctatgttgtccaggctagtcttgacctcccggcctctggtgatcatcccgcctcagcctcccaaagtgctgggattacaggcgtgagccactgtgcccagctaagggtctgcatggctcacaaagccccagcacttgcggacagggggtctgaaccacacaagattgcctcaagggaaggtgctggaacttttgtttcagtcctgaagtcacaggcactggtcaggtttgtgagcagggaggtgacacctccaagggacatgagtagggagcaatggccattctcctccttggagagtcccttgttagaacctaggcctgccacttcctgtttcacagtagttcagtatttacagtaacttccaggaaggggaccatgtgtcacgcctgagctgaccctttctctctgctgcgagctcaggatgtgggcaggcgaccctgagcccagcagggccctccatctgcaggtgtcccccagctccccagtgtccctgagctcactaccccagctgagccccaacacctctttttttttctttggggacacagtcttactccatcacccaggctggagtgcagtggtgcaatctcggctcactgcaacctctgtctcctgggttcaagcgactctcctgtctcagcctcctgagcagctggaattacaggcgcgtgccaccacaccccactaatttttgtatttttagtagagacggggtttcaccattttggccaggctgctctcaaactcctgacctcaaatgatctgctcgcctcggcctcccaaactgctgggattacaggcatgagccacggtgcccggcccactggcaccacctctttgccccatgctgacccctctcatgttgggattagggaccagggccaacctcctcccctgtctatgctcgcctgattcggggacttccgcctcgctcctctccactccagaggcaccagggcttctgtctgagctgtgaccccaaagttgctgttgacaactgacatgtgtcccgggtcctgtgatttagaaaacatctcacctctgcctccgccatctcattggtccttctccagggcacccagaggctggcattgttatgaggatttatgtgaattttttacttccttgtcgtccacacgatgctgctgagttcagagcgattcagtgaattttccaccgtcaccggccatgaaaggccagagcctggactcttggttgttgcccagactgtgtgtgtgtgtgtgtgtatgtgtgtgtgtatgcctgtgtgtgtctgtgtccatttatgtgtgtgggctgggcacggtggctcacgcctgtaatcccaactttgggaggctgaggcgggcagatcccttgaggtcaggagttccagaccagcctgaccaatatggtgagaccccatctctactaaaaatacaaaaaattagccgggtatggtggcgaacgcctgtaatcccagctattccagaggctgagggaggaggatggcttgaaccagtgagcagagatggcgctattgcactcagcctgggtgaaaaaaaaaagttatgtgtgtggatgaatgcacgtgggtctgggtgtgcacgtgtgtagatccatgttgggtgggtgtgcccgtgtatgtgagcactctctgtgattgtgcagaagtgtgtatgtgtgttgtgtgtgtgcatgactgtgagtgtgcatgaatgtgtatgagtgtgttgtgtgtatgcatgagtgtgatgggtgtgtgggcactctgtgtgtgcatgggtgcatgtgtgtgcctaggtgtgtgcatgagtatgaccactccatgtgtgtgcatgactgtgaatttactttgtttttgtgtgtacatgagtatgtgtgtatacttttttttttggatggaaagaggagtttgttaaggagtattaactcacaggatcacgaggtcccacaataggccgtctgcaagctgaggagcaaggaagccagtccgagttccaaagctgaagaactggtagtccgatgttcgagggcaggaagcatccagcatgggagaaggatataggctggaagcctaggccagtctagtcttttcacattcttctgcgtgctttgtgttttggccacaccggcagctgattagatggtgcccacccagattgaggggggtggggtctgcctttcccagtccactgactcaaatgttaatctcctttggcaacaccctcacagacacacccaggatcaatactttgcatccttcaatccaatcaagttgacactcagtattaaccatcacagctgccttctcttataagacggggaaactgaggcccaacagcccagagatggacagacacttgcctaagatgacacagtggtattacagactagaccctgagtctcctggtccctcccagctcgttacaccttcgaggaccctaggacaggagaagccacactctaagctagaacccatcctcacaccacagcccttgaattctccttctgtcctttccctctgcccgaatggggtcagtggagggaatggactctgggtgaaatcacacccattcagagcctttgggacaaatatttgagagtcaccaattacctgatcatcaaagacatgcctttaacttcctgactgtcccggttgtttggggcggccaggaggccccctggaatccctactgtcactggcatattgcaagcacatgttttctgcacacagagctgctcacaataaaccaacgctgaaaagcacattaaaatgaatcggagaagagagagtcactttgtaacatgctttattttattttgtttttgccttggaaaggagcatgttttggctgccaatgaaagagctggtgggggcctcttagcagaaaccaaacgggtccagattagacctacccagcccaccccctgggacagtggctctggctccagggagctgagaggggccccgagaccaggggtgagctgcagggctggtctagaaactggagatcccgggtaccagccctgagctctgggacactggatcccttttctccttttacctagcctccgtgttcctaactgcagaagagattccctgactgtatttgctccttctgattagtcagtgggcaccacggtccctaaggagagtgcatttctcataacagctctgcaagatggtttggaccatccggggatttccagccagagtgctgttattttgcatggattggtcacaagctgagattcatacctttctgtccaatccctctccaacttccctcttaggtgtgctgtctgcagccttctcctccctgcacacatccaaaagcaactcctccccactccctagaaccactccttttttttttccccctcactctattgcccaggctggagtgtggtgatgtgatctcggctcaccgcaacctccgcctcccgggttcaagcgattctctggcctcagcctcccgagtagctgggactacaggtgtgtaccaccacgcctggctaattttcgtatttttagcagagacagagtttcaccacgttggccaggctggtctcaaacgcctggcctcaagtgatccgcctgcctcggcctcccaaagtactgggattacagatgtgagccaccgcgcccggctttgcctagaaccacttctaattctccttgctcagtgaaaaacactactccgtctagccaatctgccgttgaaatcagaaacctcaaagcctcaactctctccttgtgaccctgttgcaagggatccccaacatcccgtggattcttctgtctctacagccctctctaatccatctcctcttttctgcccctcctggctttgttttttgttgggtggggggagcaggagacagaatcttaccctgttgccctggctggagtgcagtggtgtgatcacagttcactgcaacctccacctccccgcctcaggtgatcctcccacttccccatcctgagtagctgggaccacaggcacacgccaccatgcctaatttttagtgtttgtaatagagatggggtttctccgtgttgctcaggctggtctccaactcccgggattaagtgatcctccctcctccacttcccaaaggttgggattactggcgtgagccaccacaaagtggcccattttcttaccttagatctcacccacctatcagaactgtctcagcaacctccggtctctccccaccaagagcaagcagaaatctaaacattccccttccctgtttgagacccttctggactttccaccccacctggatatcagccaaatagcaccgccgctggtccctgtggtttctttgtgcagattaaggaaaaagcgccccttcctcaaggcacgtgactgccatctgctggaaaactgccgtaatatatataaaattatgaggaccatgatatgatggcgccctctagggttgtgcaaacacagcatcctgaatcccacagcctcctggctttcaagagcctgatggccctccagcctcatgtcttccactccttgtgcctgctcacatcttctcttccactgatcacaagctgtttgaggctctccaaacacactggagcatggaggtggagaatgtggactttggagacagaatcccagctccgtcatgtaactgttacaaaattccttaacctggccaggcgcggtggcccatgcctataatccgaacagttttggaagcctaggagggaggattgcttgaggccaggagttcaagaccagcttgggcaacacagcgagaccccatctctacaaaaaatagaaaaatcatccaggcgtggtgcacacctgtagtcccagctcctcaggaggctgaggtgggaggatcgcttgagcccaggagtttgaggctgcagtgagtcatgatcacaccactgtactccagactgaacaacagagataaaaccctgtcaaaaaaaaaaaaaagatgatggtcttaacatttagggtggcatgaaccaacaaccctcccttcccacccctccttgataaacagatgaaacattggcccctctctcctaaagcatgcccgggcacagagaatcttatttacaggaaccctcagaggattctcccatcactcacgaaacctgaccgtaaggtctttcagctcagatgaaggaggagagacccctaatctttgctgggtgtcatttcacatgtggaagtggtcacttttcaaattcaggtctttaccttcccacctgtattagttcgttttgtgttgctataaaggaatacttgaggctgggtaatgtatacagaaaagaggtttgttccagctactcagccaggaggctgaggcgggaggatcctttgagcccaggaggtcgaagctgcagtgagctatgatcgtaccactgcactctagtctgagtgaggtttacttggctcacagttctgcaagcctggcaccagcatttgctcagcttctggtgaggcctcaggaagcgtttactagtggcagaaggtgaagggggagctgatgcgtcgcatagcaaaagagggagccagagatgggggaggaagaggtgccagctctttaagacaaccaggaggctgggcatggtggttcgtgtctgtaatcccagcactttgggaggccgaggtgggcggatgatttgaggtcaggagtttgagaccagcccggccaacatgatgaaacccacttctctactaaaaatacaaaagttaaccagacgtggtagcaggcgcctgtaatcccagctgctcaggaggctgaggcaggagaatagcttgaacctgggaggcgggggttgcagtaagctgagatcgtgccactgtactccagctcaggctacagactgagaccctgtctcaaaaaaaagaaaaaagaaaagaagaacagaaaacagcctctgattccctccctcctccttgcacctagagcaatggcatctcactaaggctggtaaactcactaatgggatgccagtctggccagggatcactggttcttgctgccagatgaagagtggggctgcagaggtacagggcagggttcattcccacccccagaatggtctaggcccggccaacacgggtgagttgaggcccccagcagctcagggtttggcttcctggcctctttcagcactgggggctcttttattttttttttgacggggcctcactctgtcacctaggctggagtgcagtggtgcgagcttggatcactgcaactcctgcctcccaggttcaagtgcttcttctgcctcagtctcctgagtagctgggactacaggtgtgcaccaccacgcacggctaatttttgtatttttagtagaaacggggtttcaccatgttggccaggctggtctcgaactcctgacctcaggtgatctgccaatctcagcctcccaaagtactgggattataggcataagccatcgcgcccagtcttttttttttttttaagagggtctcactctgtcacccaggctggagtgcagtggtgcaatcatggcttactgcagcctccaattcctggactcaagtgatcctcccacttcagcctcctgagtagctgggactacaggcaatcatcaccaagcccagataatttttgaaatttttttgtagagatgtagggatctcactatgttgccagggtggtctcaaactcctgggctcaagcaatcctcccatcttggctttccaaaatgctgggattacaggcgtgagccactgcacccggcctctcagaggagccttttaaagatgtaaatgagatcatgaaatcgccctccctgaaactcagtaattccgttcactgtgataaaagtcccctcctgggccctgcaggtaaggctgcacctcatcccatgtcacacacacctttgctcactacctgccagccttttccctgcctcagggcctttgcacctgctattcctgccttctgacacagctgcagagacagggcgagcctggggcttggggctgagtcaggctcactgcagcctcaaattcctgggctccagtgatcctcctacctcagcttcccatgtagctgggactacaggtgagcaccaccatgcccagctaattttttaattttttgtagagaatgaggctgggagggggtctcacgatgttgtccaggctggcctcaaactcttggcttcaagagagcctcctgctttggcctcccagaacattgggattacaggcgtgagccactgtgtctggctaatgggggcttctctgagcgagccacacaaggtgattcagagcacttgtgcatctcacttttttctttttctttctttcttttttttttttttttttttgagacggagtctcgctctgtcgcccaggctggagtgcagtggcacgatgtcggctcactgcaagctccacctcccaggttcacgcgattctcctgcctcagcctcccgagtagctgggactacaggcgcccaccaccatgcctggctaagttttttgtatttttagtagagacaggggtttcaccatgttagccaggatggtctcgatctcctagcctcatgatccacccgcctcggcctcccaaagtgctgggattacaggcgtgagccaccgcacccggcccatctcacttttttcaaaagtattcccatctgagttcaagtcgacatcaggtggtggcgcacgggcagaggccctctccctgcctcccttggcctggccacaccaaaccctttagaaggctttgacttgggaaagcataacccgctggactcggtttcagggctgggtctcctggatgctcaatgtgaatgctactaactgaactcccagaacaaatcctgattctcaagggcaaaagtggcctggctggtccaggggctgagcccttgtgggttccgttaagctatcctaagaaaaggcggctcagagccctgctctaggctgaaggcagacaggacctgctggtccctggccatggtagtcaccaagcgccacacgtggacaagaacgtttcaagtcccaggacataggattgtcccctgatctggccagtgtggctgatagtattcatgtgactacttgcaaccttacaaaaaggggcccatcagaagtgtttccccacaggccaacaaaagggaggaccccggttctgctgaagtccaattctgccaggactgtaggtgggaggattgcataagcacgggagtttgagaccagcctgggcaacatagtaagactccatctctacaaaaccccccaaaattagctgggcatggtggtgcacacctgtagtcccagctactcaggaggctgaggcgggagaattgcttgagcctacttaggagtttgaagctgcagtgagctatgatcacaccactgcactccagcctgggcaacagagtgagaccctgtctctaaaagtaataataataaataaaatgaaagacacaaccgaattcataaggcaggaatgtgctctaggtgccccagttaccagaagctaaggaagcagagggtttcgctgctggtgctgtggtcaccgtggaggtcggggtggagtgagaatattggtcttggtttacccctgagtcagcacaggggaggaggttgggctcctctgttgctgagttagggctatgacttagtgcaagaggcaactcaggaaagcccactggctcatggaggcaacaagaaaacttgtccatcttctgtgtactctggatggggaaaatttggctggaaaaaatcaaaacctagccaggtgtggtggctcacgcctgtaatcccagcactttgggaggccaaggtgggaggatcacttgagaccaggggttcgagatgagcttgggcaacatactgagagccctgtctctacaaaaaaataaaaaattagccagtgtgcggcatgtgcctgcctgtagtccaagctactagggaggctgaggcaggagggtcgcctgagtccaggaggttgaggctgcagtgagctatgatcgtgccactgcactccagcctgggcaatagagcaagaccctgtctcaaaaaaacagaaacaaaaccttggcctctacttcccacaaattggccctacctctgtgaccaccaaatattcagttggagctataaatgatttaggcacaaacccccaaataagatagctattcaaatccagcagtgcaccaaaaaagtaataggtccttaccatgtagttcttcagaaaatctgtttatgtaatccacctcattcacagattagaagataatagagtttgatgaacttcaacacctatgcatgatgaaaactcttgctaaactaggaaaagaaagaagcttcttggcacatagatcctggctgctgcactccccagaaagcattgcactagtgtgagacattaaaagcctccctttttacaattttattattattattattattattattttgagatgaagtctcgctctgtcgcccagactagagtgcaatggcatgattttggctcactgcaacctccgcctcctgggttcaagcaattctcctgtctcagcctctagagtagctgggattacaggcatgcgccaccacacccggctaatttttttgtatttttgtagagacagggtttcaccatgttggccaggctggtctcgaactcctgacctcaagtgatccaccctccttggccccccaaagtgctgggattacaggcataagccaccacgcccagcctctatttattttatttatttttatttttatttatttatttattctgagacagagtcgcccacgccactgagtgcagcagcgtgatcttggctcactgcaacctctgcctcctgtgttcaagtgattctcatgcctcagcctcctgagtagctgagactacaggcatgtgtcaccgtgcccagctaatttttgtatttttgtatttttgtatttttttagtagagatggggttttgccgtgttggccaggctggtctcaagctcttggcctcaagtgatccacctgtctcagcctcacaaagtgctgggattacaggtgtgagccaccatgcctggccagtagcctccctttaaggtcatgaatgggatttggaggtagttgtcacaacttctacccagcattgcctttcagatcctaacctgtgcaatatgtggagttaaaggaataaaaggcaaattggaaacatttttatgacaaaaggcagtgttaccacagcacaaacacatgctacagattgggaggagatattcgcaaagcatgaaattgacgacgggctggtattggaaatacggcagaaagaactcctatgcatcaaaatgaaaaagacagaacaacctaataggaaaacgggtcaagggcatgaatgggtatttcccagagtggggaaacagaaatggctcaaaaacctgtgaaaagatgtccagtctcattaacaatgtagaaaatgcaaatttaaaccacaacaaggctcggcacggtggctcactcctgtaatcccagcactttgggaggccggggtgggtggatcatttgaggtcaggagttcaagaccagcctggccaatatggtgaaaccctgtccctactaaaaacacaaaaaaattagccgggcgtggtggcgggtgcctgtagtcccagctactcgggaagttgaggcaggagaattgcttgaacccaggaggcagaggctgcagtgggccaagatcacgccactgcactccagcctgggtgacagagtgagaccctgtctcaaaaaaataaaaataaaaataaaaacaataaaaaaaataaaccacaacgagattctgtttcacacccaccagattggcagagctgctgaggttttggacagctgcctctctgggccctggggtctggaggaggaggggtgttggatgagtcaggggacccagggttgtccccaacaaccctattagggaggtttattccttccagctggggctggccggagagcaggggacagtgagctatggctagcgaggcagtgctgtttgggtcttaccccaggctctgggggtgggtggggctgatccactgatgtcaggacccccctccaagacagctagatgtgtctttggctgcagcgcctgggcccagcctgcagaactggcgggcaggagagaaggagaaaggggatgtggggtaaccgggcaaggctgcccttcccttgtacttggacagtctcctcctcgcagagaatctgcatctccagctacccatccgccaccaccatatccctaaagctcagagaggctgaagtggggagatctaggctcccttcccggctcctcccatgctccagcccagctgtgagcagagagcaggcatcagacactgaggccagcctctggttgtcccaagttctttcaatggctttgcttctggcctgaacatcctcccatctgcaccttcgtgagtccagctgggctcccagaagcctgggataagaccagtgtggacgccagccctgcccacggggcaggagctttcctggttgctccagaccagtgtctgggtgccgataaacaaggcagacaagagccccaatttagtagcctcactctgtgcctgaacagagtcttctgtctccttcttggaacctgcacacaaacggtgcctctctgatcaaggagaaattggtgtttctggattcgagaccctctcttactataaatatttattttttttttgagacagggtctcaacagagactctgttgcccaggctggagtgcagtggcgcgatcggctcgctgcaacctacaacttctggttcaagtgattctcctgcctcagcctcctgaatagctaggactacaggtgtgtgccaccacactcagctaatttttgtatttttagtagagacagggttttgccatgttggccaggctggtctggaactgctggcttcaagtgatctgcccgccttggtctcccaaagtgctgggattacaggcatgagccaccatgtctggctcttttttttttttctttttttgagacagagtctctttctgtcacccaggctagagtgcagtgggttgatccctcggcttgctgcaagctttgcctccctggctcaagtgattctcatgcctcagcctcccaagtagctgggattacaggtgtgtgccaccacaaccaggtaatttttgtattattggtagagacaaggttttgctaggttgcccaggctggtcttgaacttctggcctccagtgatctgcccacttcagcctcccaaagtgctgggattacaggcatgagctgctgcacccggccagaccctctcttaccttttctgggcttggccatctctctcccgtccttcactgtggggacagaactacctctcaggcatctggaaggcgagggggatgctttgtaacgcatcgtgccccctgtggaactgaggattaattcttactttggtgtaaataactgagggggaagtaaggagttgctgccctgggagggtgaacctggttttagccctgggttggccaccattcaaatgtgtgattgtggccgtgagccacttaacatccagatatcttttctaatctgtacgaagaaagggctgagtgagatcattctaagatccttcttgtctttacaactgtatgggagatttgcttttttgttgttttttgttttgttttgttttgtttttttagagagagaaagagagttttgctctgttgcccagactggagtgcagtggcaatagtcatagctcactgcagccttgacctccttagctcaagcaatcctcccacctcagcctctcgaatagccgggactacaggtgcgcaccaccatgcatggctagttttaattttttttttagagatggggtctcactaggttgccccacctagtctcaaactcctgggctcaagtgatcctccggcctcagctcccaaagtgctgtgattataggcataagctagtgcacctggtgagatttgctttttaatataagagtacaaattacagctgtcttttctcagccatgcagtctagtcccacattctctaaccagttcaggggcccaggagacggctttgatcattcgtgtcttaagggccaaacaactgaggttcagagagccgaaaaactttctcagggtcacacagcgtgtcgggggcagggcccagagagatgactaggccttaagctattaggcaaccactgtaaaatcctgcacagaggccgtcatgttgttcgaaggcattttaaagaactattcggggcagcaatacacagaaagtctccctaagaaagagccagatcgtgtttgggtgatttcccaggctggaaaatccaggcaagtggaagaaaaaattcatccttggtgaaggtcggtgcctggtaaggggaggggccttgtcgagtgctcctcggattaccatggcaactgcctcctgccaggaaaggtgtgatcctgagtctgaccctgagactcaaggagtctccttcacttgccccgtgattcttcccttcctgtctccttcacccatcccatctcccgcctgagctgacatcactgccctagggaagctgagcccaggctgccaaatgccaccaagcaggtagcttccgtgtgagcgcagtattccccagagatgtggatggatctccttcacctgttcctccgttgggtgtctaggaacctgggcaatggggctctgacacctgcctgcccatctgtattggtccgttttcacgttgctgataaagacatacccaagattgggcaatttacagaaaaaaagaggtttaatggacttacagctccacgtggctgggggagcctcacaatcactgcgaggtgacttgctcctccttgccttccgccatgattgtgagacttccccagccacgagagagcttgtgctgggtgcagggaaactcccacttatataatcatcagatctcgcgagacttactcactatcacgagaacggcatgagaaagacctgccccatgattcaattagctcccactgggtccctcccacaacatgtgggaattcaagatgagatttgggtgaggacacagccaaaccatttcaccatctcttgcccatcttgatcccaggggatagaagatagctgggctggaagacagggttggggtgctccagggcttcccccactgcagtcagagaagcttcccttctccccgcatttttttttttttttttttttttttttttttttgagatgaggtcttgctctgtgtcccaggctggagtgcagtggtgcaatcatagctcactacagcttcgaactcctggactcaagcgatcctcccacctcggcctcccgagtagctgggactacaggcatgcaccacccaggcctagcttgttctaaaaaactttgagagacgatgtcttgctaagttgcttaggctagtcttgaacttcttggctcaagagattctcccacctctacctcccaaagtactgggattacaggtgtgagccactgcacccagcctgtcttttgtttttaaaactctgctgccatttctctctgaaagccccaatggccagagaaccttgcccgcatcttgctgtatttttgggaatttgtctgttccttgagaggcgattgcctcctcctgagccttgaccagtgggtgctacaggaagatgaggcctcacctagtcccaaggctgtgggtgcccctcagccctctggggttcagagtgcctggcagtgtcaggccgctccccaccccaccacagcctggaggctccaaggctgccagctttgtttcatgaccctttgaaccttgaccttgggcttggagcaccattaagacaaattctttcccagtgatgaagagcaatggcagcgccaactccccgtgtccaagtgggtcaggaaccacagagtccgtctccccctgcacttggtgtcatctttcaggcccaggcggggccagctgccagctttgcggggccctggagttatttatgatttctttctggatgaggaagaaagggttagagcacttgaagcaataacttcagatgaacaatgcgatcctcagaaatccacccaagagaagcaattgaatcgctgaaaccggcaagataaacatgtacagtgatgttcccctctcctggtatccttgctgccccaaacaactgctgggactgatcacttatttttgttgcaatgaaatccccgtcaagtcctgagggacattcctggaagacttgaaatctctccaccgagcacattgtaacccagcttccttcatccaagcatccccagctgtggggaccccaatctgtccccaacggagggccaagaagtacttgatcctgaaagagtctcgtccctctatactcacaccttcattctggggacatctcccattcatggctggtctgaaggaaagctggtctatggaacagtgttgctgataaattaatatattaatttaatcaaacagacctgccatgacctgttacacttgcctgtccagaagaggcgagctaaactcatctccaggtaatctgtctggcaggtgacacaggtacagatatggccccaggaggtgtcaggatctgggcactaatgctcatgcacctttttgggagctctcccggatgttacagttctaactcactgactcctgaggtttccaaagtggcccaaagcaatcaggagccacaaattctttttttagtttttcccctagagacagggtctcgctctgtggcccaggctggagtgcagtagtgtcatcatagctcactgctgcctccaacttctgggctcaagcgatcattccacctcagcctctccaacaaaaggaaccaaagtgagcattaggaggctgcagagggagaggctgccgggccctgctggtggctccctgccactctgcacaggctgctgaggccaggggacaggcttcctgctctatgcatgtgcaccttctgagatcccactcagccactgccagctgggggacactgaacagggagcggggtcaggcactgggaactgccctgtgcatcctcaggcagagcacagccctctctgtgcctcagccacccatagatcagaggcagggaccacctggacactcttttaaagcccgttcaacctcgtcattctgagtcagtaactaacggagctagaagtcacgtcatctgggcgtccagtgttccctcctctctcctcgggaaaaggagctgagttttgcttgctgagagcagatggatcacatcaccgcggctcattctcaagcttccatggtgaaatgtgatcccctgtgaagcatcccaggccctccagtccaggcagggctacaggatgagcagccagatgccctggttccatttcagctcatctgctccctctcagtggccctcagttttcctccacaataaaatggggcaataatcccctggtctattgcctggtccagatctttaccctcagcctgcagggagtgtccttatctttagtcccagctgtttatccagggaggatgtgcaggaagggacaagctctctgtgtgcatgctgagtagagaccaccattgctacatccagaagtccccccggagcatcataagctgaagatggggtctgaaggtctcagggtacgctcttgagtcaagcccacccaacacctgcctggggcaggcagggcagctcagctagagacggtgcagaacacagggtccttggggaccctcccagcctcctgatagcagagccttttatagccaaatcattttggagagagactcatttaagaactggccaggtgcaatggctcatacctgtaatccctacactttgagaggccgaggtgggagaattgcttgcggccaggagacgcgaccaccctgggcaacatactgagacttcgtctgtacaaaaaaatttttaaaaattagctgggcatggtggtgcacacctgtactcccagctactcaggaggcaaaggtgggaggaagagaaccaggttgacagacaagcacagacacatacacacacacacacacacacacacacacacccccgtgttcttgcatgtttttgctccagcagggggacatgtggagtggtcttccttttgctcccctctcatgctccttccccagcagcagggccctgactctctctataagcccctttatgttttttctggacttagtggaaatgggaaacagctgctgggggctgcagggagaagcagttcccatgcacagtaaggaagcctcaccagatggctgatcttgatcttggacttcccagcccccagagctgtgaggaaataaacttctgttctttataaattacccagtgtattagcctgtcttcacactgctataaagatactacctcagactgggtaattgacgaagaaaagaggcccaactgactcacaactctacatggctggggaggcctcaggaaacttacaatcatggtggaaggcaaaggggaagcaaggcgtgtcttcacaaggcagcaggagagagaatgtgtgcagggggaactgccactttttaaaccatcagatctcataagaactccttcactatcacaaaaacagcacggggagaccacccccatgatccagtcacctcccaccgtgtccctcccttgatacatggggattacaattcgagatgagatttgggtggggacacagagccaaaccatattaccctatctcaggtatttggttctcataatgcaaaatagactgagacaggtggatatacaaaaagtgatcccatccagggtgctaaattctgtaagccagttgtgtacagggtgcatggcaattggtgggaaggtgggtgcctaagtgcccttggggtggtcaaggaaggcttcctgaaagaggtggtgctagctgaccaatgcaggtgtgagggagggttgggagccatttctagatgagagtacaagactggtaaaggcttaggagagcaagaggtgcacagagcatggcaagtaggccacagcagcagcacatagggtgacaaggttggattggcatttgaggacaattaagagaacactttggcatgtttattacaaactgatcatgcctgtgtaaccagcacccacattaacaaagaacgttctcatgatcttgaaagccctcttcttgcctctttcaactgtgactctccccacgggtaaccactcacctgaattccaacaccttagactcttccgcttgtttctgaacttcagataaatggaatcagacagtaggtacttgtttgagtctgtccgccttcacctgacgtgttctgtgagactcgtccacactgttgcatgtggtttgcctactgttctgaccgtgttgcatttcattttgtgatatgcaatttatttatccagttggccattaataggaatttgggctgtttctaattttgggttattctgagcaatgctgccatgaacgttcttgtgcatgcctttcagtgaacatatttattcattttgtgaatgaatttcgtgcctgtcttgttctctcatctagaagtggctcccaaccctccctcacacccgcattggtcagctggctcctaattaagcaccacctcctccaggaagccttccttgaccactccaagggaacttaggcacccaccttctcgccaattgccttgcacctgtgcccaactggcttacagcacttagccctctggatgggataacttttcgtatatccatctgtctcagtctgttttgtgctactagaacaaaatattggacactgggtaatttataaggaacagaagtttatttcctcacagctctgggggctgagaagtctaagatcaaaatcaggcatctggtgaggcttcctcaccatgtttgggaacagcttctcctgcagcccccagcaactatttcccatttccactaagtctagaaaaagcagagaggggcttccactggagtaacagggacttaagacagagatcaggaagatgtttgatgctgaagtttattatatcctggcttgtattttcatgggaagggaggagatatctgggaatggagttgttgtgtcatagagcgggcttatattcagccttattagagactgccaaaggggttttaaaagtggttgtaccattgatactcccacccgcagtgtatgacagacagttccagttgctccgcatcctctctaatacttggttaaaaaaaaaaaaaagagtaactgttagtctttttaatatcagccattctagtggctatgtgggagtatcacattgtggtttaatttacatttccctgatatggcaaatgaacttgaccccctcttcatatgatcattggccatttggagctcttattttgtgcatacacatattccaagaatcctcttccagttggtgatatacttcttcattcattctcttaatggtgtcttttgatgaaaagaaattctttttttttttttttgaggtggagttttgctcttgttgcccagtctggagtgcaatggcacgatctcggctcaccacaacctccgcctcccgggttcaagccattctcctgcctcagtctcccgagtagctgggattacaggcatgcgccaccatgcctggctaattttgtatttttagtagagatgaggtttcactatgttggccaggctggtctcaaactcctgacctcaaataatccacctgcctcagcctcccaaagtgctggaattacaggcgtgagccaccacacctggcccgagaaattcttaattttaatgtggtctactttatcaatttttttaaatggtaatgcttcttgcatcctgcttaagaactctattttgaggtcatataggtagtcacctatgttttcttccaaatgctgtatttttttaccctttatgtttagatctacaatccaactggaattgacttttgcacgtggtatggattaggagtcagattcttttacttttctttttcatttgtatatccaattgaccagcaccatttattgatatgtctatcctttgtcttctatactgcatttgcgcctttttcataagccaagtgatgtgtaagtgtggatctatttgtctaactttgtaccatccatctgtctcgtgtcttaattactatagttttgtaacaaggtctcaattctagtagtataaatcttttacttttgttcttcttcaagactgccttgactagtcttggacatttgtattttcatatacattttggaatcaatcggacaatttccaccaaaaaaaaaagtctactgggattttgactgggattgcattgactctatagatcaactggaagaatttatatatatttatttatttattttcaaaaacaacaattgtggccaggcacagtggctcatacctgtaatcccagcactttgggaggctcaagtgggcggatcactttaggtcaggagttcgagaccagcatgaccaacatggtgaaaccctgtctctactaaaaatacaaaaaattagccgggcatggtggtgggtggctgtaatctcagctactcgtgaggctgaggcactagagttgcttgaacccaggaggcagaggttgcagtgagctaagatggcatcactgcactccagcctgggtgacagagtgagactctgtctcaaagaaaaaaaaaaaaacgactattgcagtgacatcgatgattaatcacctgtactccccctactgctaagggaaaaaccttctatacagttgagttacaaaggaaaatcaagacaatttatcaggcacctacagccagaaaatgctctgttgtttccagaggtatagacctgacatgtttgatgtcccagcgtaacacaccaacccagtggtatagacactgacatgttcaatgtactagtgtaacacaccagctgcaatttttactgggatggggagaattaacatctttataatattgagtcttccaatccatgaacatagtatatctttccatttatttagttatttaatttctctcagtggtgttttatagttttcaggagatttagtcctatgtaatttcatactttatgatgcttttgtacatggtatcacttaatttctttttctatttgcttgtcgtaggtaggaatatgattgatttttgtaaactgtctttatattccagccaccttgctaaactagcttaataattctataacagtagtttttcattagatcttgctggggggaagatgctttggcctgtggtccagccatggtgcaagacccatcaaccttgaataagggttggatgtggaggcagagagggagaaaaacagactctgccagccaagtcaacagaacccccagggttatagacagactttgtccatgcccagtcatggtccaggcacttgctttcatatcattgagaatgggtgccccagagaagaatcttatgaatcttatgatttgtgagtgtgtggcatggcctttgatgccagctttctaagagccaggtggagcaagagtgctgagatagttcccactcagtatccatagtttgacttcattcttttttttttttttttttttttttttttgagacagagtcttgctctgtcacccaggctggaatgcagtggcgtgatctcagctctctacaacctctgtctcctgggttcaagccattctcctgcctcagcctcttgagtagctgggactacaggcgtgtgccgccatgcccagctaattttttgtatttttaatagaaacggggtttcactgtgttagccaggatggtcttgatctcctgaagtcgtgatctgccctcctcagcctcccaaagtgctgagattacaggtgtgagccactgagcctggcctctgacttcactgtttttttggttttttttttttgagatggagtctctctctgtcacccaggctggagtgcagtggcatgatcttggctcactgcaagctccgcctcccgggttcaagcaattctcctgcctcagcctcctgagtagctgggactacaggtgcccaccatcacgcccggctaattttttgtatttttagtagagacggggtttcactgtgttagccaggatggtctcgatctcctgacctcgtgatccgcccaccttggcctcccaaagtgctgggattacaggtgtgagccactgcacctggcacttcattcttacttaagttagaaagtgaccaaacgtagagactttcttcctttgacccccctcctacatggcagtccagcctttacactgacaccccaatgctaccctgctggctcacctctcaatgggattttgataatggggatccagccagtctccttggggacagccacagtgggccatgctgccctcctattggccatggtatctttttagctggagcagaactgcgttttctttttcttttcttttcctttttcttttttttttgagacagagtttcgctcttgttgcccaggctggagtgcaatggcgtgatctcggctcactgcaacctccgcctcctgggttcaagcgattctcctgcttcagcctcccgagtagttgggattacaggtgcccgccaccacatccagctaatttttgtatttttagtagagacggggtctctccatgttggccaggctggtcttgacctctcaacctcagatgatccacccacctcaactgcccaaagtgctgggattataagcataagccactgctcccagccttctggatggatttttaaggatcgcctccagctgggccctggttggggtggcctgctggtggcacttgccctgcacatgccctctgcctgcagacccctctgagacctctcacagagggagctgggcctctggggacaggaccatccatgtgccttgcctcccactgggatcttgtggctcaagtagactccagctgcctctttccatttccctgcaataaccaactcctgccctatctgcaaatcccctctcagggcccaggccttgggaatccagcctcatttgggaggtgggtcctgaattctgggagcagagccatcaccaggagcagtgctgaccaaaggcagatggcaggtggacttgacaactgttgtcctgctgtgggtgggcagagcccggaagtgagaggccgaggaggaggtcaccggtggcaagagtgaagagtcctggagcctgaagccactggagctgatccagtgtaaaccccctttatagatgggaaaactgaggtgtggagagagagagggcgtctcaagccacacggtgagttcctggccaacttagacccaggtctctatagttctctttacaatgaacacaccgcacaatcaactctctctctcttttgagacagcgtctcaaaaggacactacatctccagcccaggctggagtgcagtggcacaatgacaactcactgcagcctccacctcccaggctcaagcaatcctcccacctcagcctcctgagtagctaggattacaggcacacgccaccatatctagctaattttaaaattttttctagagacggggtcctgccatgttgccccgactggtctccaactcctgggcccaagcgatcctcccaccttgacctcccaaagggctgggatgacacgcatgagccaccccacctggcctgctctctctctctatgtctctgtctgtctctttctcttttctttttcttttttctttttatttttttctctttttgagatggagtctagctctgttgccagactggagtgcagtggcacgatctcggctcactgaaacctctgcctcccaggttcaagcaattctcctgcctcagcctcccgagtagcttggattacaggcacgcaccaccacgtccagctgatttttttttttttgtatttttagtagcgacggggtttcaccatgttggccaggatggtcttgatctcttaacctcgtgatccgcccacctcagcctcccaaagtgcttggattacaggcgtgagccaccacgccagcctgtgtctttcacacacacacttgcttgtgcacccacaaacacagactagtttgcctggtacgttgacacttccaacatacacctattggcaaaggtttaccccgctggtttctgtgtgggtcctagacgctgggaaaggcactgtggccccaggtgctccagggccagtgtgttctcggaggggccaggcatttgggacacttcataatcctggaaagttagcgaccacatcgtagagtagttcgggcagggcctcctctggtcacagagccaggagggggcaggatcagcacccccatcaccatttccatgtttccagcactccagtgaataatcaaagaaagttaaacaaacatgctttaattgcctgtcgatgacagatgccaagggaatgaaaatcccgtccggttctggagcgcctgcccggggatgggggtggtgtggggagtccgagctggctgggcctctagggcctcaccacagctggggagctggacccaccccacaacccccatgtccaccgttggccaagctgctcctcacctgccaagcagggtgcccagtgccagagcaaactgggcccaggcccagcataatttccagaaataggtctttgagagagctgggcctccccctccatccgctgaacttccaccatgcaggggatcctatttgttgcctcaggcccttgaaacactctgctcaaggcccctaaaagcctccagattgtgcagtttgcccagagttcctggacaggccagggctgtcatttgtaacttccccatgtccacctcctcctcctcttccctcaggccccaagggtggggtggtgtcttcctgtgtggctcgagctggagagttgcttttcccttccctccccttccctctcctcccctcctctcccctcctgtcctctcccttcccctcccctctctgacagggtctggctctgttgcccaaactgtagtgcagtggcgccaacatggctcactgcagcctcaaccttctggactcaggtgatcctcctgcctcagcctccaaagtagctgagactactggcacgcaccaccatgcctggctaacttttgtatctttttgtacagacagggtctcactgtgttcaccaggctgatctcaaactcccgggctcaagcgatccacccacctcaacctcccaaagtacagggattccagccatgagccaccacacccatccttcttttcttttttaaatatgttattttattttaaggctaggtgctgtggctcacgcctgtcatctcagctctttgggaggccaagccgggtggatcacttgaggtcaggagttcgagaccagcctggccaacacagcgaaaccctatctctactaaaaatacaaaaattagccaggcacggtggcacgtgactgtagtcccagctacttgggaggctgaggcaggagaatcacttgaaccccggtggcaaaggttacagtgagccaagattgtaccactgcacttcagcccaggcaacagagcaagattctgtgtcaaaagaaaattattttatgttagattcagggggttatatgtgcttgtttgttacatgcataatagtagggattgggcttgtagtgcacccatcacccaaatattttttgttttttgtttttgaaacggagttttgctctcttggccaggctggagtgcgatggcttgatcttggctcactgcagcctctgcctcccgggttcaagcgatcctcgtgcctcagcctccctagtagctgggattttaggcatctgccaccacacctggctaatatttgtatttttagtagagacagggtttcaccatgttggccaggctggtctcgaactcctgatcctctcacctcggcctcccaaagtgctgagattacaggcgtgagccaccatgcccggcctcatcacccaaatgttgaacactgtaccagagagattatttttcaatcctcataccccatctttatgtccatatataccccttgttcagctcctacttataggtgagaacatgcaatatttgatcttctgcttctgagtttgttcgctcagaatgacaacctccagctgcgtccatgttgctgcaaaggacatgattttattctttttcatggctgtgtaatattctacagtgtatatgcacctcattttctttatccaatccaccattggtggacgcttaggttccatcttgctttttccaagtgatcctggtcaacccacagaacacagctactagagaggggtcatgcatctctgctttcaagtagacaacccctgaaggcaggcattcgggtctgtgcagccctgaccctctccccaccagtattagagtgttggcacagtgtcatccagtcgcaggaacatccacagagccttcgggtggatgagggatgattagaggtagaggagaggaggtggacagatggggagcagggtgaatgtataggtgggtagatgggggtgtttagggctggggtagcttaaggtgtaggatgggtagctgggtgggtgagtgaataggtgaacaaatggaaccctgttcattttgatctctgcctttcccattaaggacttctttcagccgcacaggaatcattggttgtgtaagtttaagaggaaggcactaggctgggcgtggtggctctcacttgtaatcccagcactttgggaggctgaggtgggcggatcccttgaggtcagaagttcgagaccagcctgggcaacatggtaaaaccccgtctctactaaaaatacacaactagccgggcgtggtgatgcgtgcctgtaatcctagctacccgggaggctgaggcaggagaatcacttgaacttgaggcggaggttgcagtgagcaagattgcatcactgtactccagcctgggtgacaagagtgagactctgtctttaaaaaaaaaaaaaaaaaaaaaaaaagcaggcactgaaagccccctggacgccagggccttgttgactggggacttcctggaggctggcctttcagggactccaccgtttcatcagggatgttcccaaatgtcagcgtcggtgggtctttcctctttggcaggcccctgtttccagggaggactccctcctctgccccatctggggcattttgagccccaggagagccagtggctcccagtctccatccccgccttgggtttgcaaggctggctggtgcacctggctgcatgcaccttgcaaaatagtatttgcattgttcatctgccaagaggtccctccgcctttccctttgctttgtggattttataccttttttatttcttgtttttttttgttttttgtttttttgtttttttgttttgagaagaagtctcactctgtcacccaggctggagtgcagtggtgcgatctcggctcactgcaagctctgcctcctggcttcatgccagtctcctgcctcagcctcccgagtagctgagactacaggcgcccgccaccatgcctggctaattttttgtattttttagtagagacggggtttcaccatgttagccaggattgtctcgatctcctgacctcatgatcctcccgccttggcctcccaaagtgctgggattataggcgtgagccaccacacccggcctacctttttatttctttatcagccctttcctgagaggaaacagaagggaacctgtgttcaatccaccatgtttaactagaaaaccacatccctgtatcatgtgtctttggtgaagtcctgcctggtcccagagtcagaaaactgtatatattcctctagttgtttgaatgttcagtgtttatacctcagtcttcaatctgttttatgcatcagaggtactgacaaggttttatggaggagaaagagttctattccttaacaaatgcttataaatcactgatttgggccagccaggggtagaagggagggaaggagggagaggggccctctgctaggccacatgtcactgaggagcagcgagtagggtgttgccccctcttgacccgagactgagcaccctgagggtacagcctcgaccacctattcccagggtcctgagactccccccaactccccgtggtttctccccaaacatctattgcagaggaatcgccctttgttttttgtttttttttttaaggacagggaacatttcaaggtgatttgcgttcgatgacaaagacggggatagctccaagaacaagggggaggctgacagtgtcggggggccgtggactgtgcgtgtgggctgcagttctcacctctcccaagcaggatcgtggtcagccccagcacgcagagtgggagctattcagttacccaaatacctcttaggcatctgtttaacagtgatggggatgtgcagggtcaggctttgaaatgagctgaagaaagagactttaggcatcccctgacttctagagcaataaaagctctttagaacagctttgaaccatctatttcatcattaaagagctccaggtctcgggcctcgggggagacagacataaaaaggtaattacagcccagagagatgtgctcttgggcggggtcagcatcacaaggctcctaattggccttccgggctccagtccctcccacttccatccactgcacactctgctgccagagtgagcatctacaaatgcaaacttgacctcgaatttcacccgcctaagaccctccagtgacctacagacactgccacagcccttcccaggcccctggtgttagagatccttgacctttccagccttggcagtcctcaagtgtgttctgagttggccaacctgccctgttctcactcccctcccagcctcagaaaatgtactctttcagaatgcattcctttttcttttagaatgcatttgctcttctctctgctgaacctggccagctattgtgcatttctcaggtctcatctttgatgccactgcctccaggacgtcctccttgattgtccccctgattggactggctttggcatccccttcctaccctgtgtctattagcccaactccttccccagactctggttctcaaagtcaggggcccacctcactatctgttcatcaattgtcagatattttttgagtctctgctttgtgccagtcactgagattcatgggtgaacacaatagaaaaagacccctgccttcattgtgctcaccagctcatggcatcaccttgtctgaataaacagacagtatagtgtactgcgcgtgctcagaagggaggctcagtggtccagcaggctgcatggaggagggggctctgagggtaaggctttgaaggatgaataggagttttccaggcaaaatgactggagatttctctgcttgcctgcctgcccagaggctatcctggtgactgggctgctgtcttcctagggtctacactctgctctcatataagttcctcttctctttcagaatgcatgaactgcacccggctcagtgacatgagtgagcgactgaccacactggaggccaaggtcagtcgggctggggagtctgggcctggggagctgcctggggaccttgggtggtggagggaggcatcaggcaaccactgggtgtggccgtggaattcccagccccgggtttccaagcaggcttggacagccggtcccaggtactgggtactgttcaggccttggtggctctgggtggccttcttgggctgggaggtcccgggcagcaggctggttttgggcaggtcagaatggtgctgagctcccaggacccgggggctgggaggctggacacccagaagacagtggaaagaggagggagtctctgtccctccagggccactgttcccacctccagaatggggctgggcacagaggaaccgatgggaaaagactccgtggaggaggaactgctgggaagtgaccagcttttggcccagtctataagaacaggactccctaagtggagtcaacccagaggcagaaggaatccacaaaggacaagtaatttacctggcagtgaccccaggcagcactgggcagggagagaggccaagaagggtatgcccagtacaggtgtgttcatgggcaggtgacctgtgggagcacctggggctccatcccacgctccctctgggagacggtggttttgagaacgtttcaggggcagccaccttagggcgatgaagccaggcatctctcctgctcctcactgggtaacacttacccgagggtacctctgtctcagcaggctcatgccagctcctgtggctggagaaagcccttggcagagttgcaggtggccacaggcaaaagccaaagccaggtggggctgaagggtgcgtgtggggcgccaacagtgtctgccccgatggggacaagccccgttctcacccagagggcttggtaagcaggctctggtgtttagccagaggggctcgacctgagggaggacaggtctggagggatgaggcagcctccaaatatctacaaagcctcttgggacagcagggttggctgcactgcctggccccccaggggagagccagcaccaggaggctggaatcacctgagcctgaggcagagctctctccggggaagaactgtggtgaccagagcacgtggcattgtccagagagagtgtgtgaacagggccacgtggcagggaggaccagggacctgagacggtggggctggagccccaggcagcaagaacccctagaagagagcagggccagggtcagccatgcctccacccagaagagcacacatacacacgcatgcatacccacataatacatgtgcacacacatgcacacataggcacctgtgcacacacatctgtgtgcatgtggagacacacatacatatatacacatacagacacacacatttgcacatgtgcacacagacacatgcacacacacaaaaacagggacacacatatgtaatacccatggtcacatgcacggatactcaggcatacatacacacacacacaagcatgcatgtcaatgggcacacatacatatacacacacacacacacacacacatgacacaactgtgcacacattaacacacacagcccttgacaactccacattacccttggccctgacttccgccctgggggttgcaggtgagtgtggcttggagtcagacatttgtgggaccaccacccgccagctgggtgactctctcagagcccccttcctcatctgtagaatggatcagagcatcagccctgcagggctgttgagagcctccagggagatggcagtgggaaccggctttggaaatggtctaatgctgaccaggagtcaaggattagtgctgtcacccacgccagccacgtcactgttcccgccttacagatatgaacacaggtgtgcgggagacatctgtgcagagcaatgacggggagccccacggcatgcattcgcggcttcccttgtcctccagcccttccatgggcgggcagggtctcccagcagcccaggcccctgggcacaggcctgggatgggagagacccagctgctctccttggagtcttagctcttgtggggcaggattggagggctccagggagcaaatgtttccacatgggctgagccggggccaggaccccctagaatgagtataggggaagatgttgagccggtaagcttctggcacctgagattttagaaaaggcagggtccccgagccatgcccagcctgatggacattttcctagtaccggaagcctctgtgtggtttggcacagagcagcagccctggcctcagcccagtattgtgggtgttaaaagtcgcagctctagggtaggatggccacattgccagctgtcccccacccacctggcccacatcctcccatcatgagcaattcctccctgtggtcttcccggccctgacaccctctccaccaagggccccagctccatggcctccagcagcaggcccggggcagagctttgtcctgtgaccctgagtgagaggactgtgtcctctctgtgtgcctcgagggctggagggagggacagcagtgcgtgggaggagcccaggccaagattcccacccttcctccactccatcttggccagcccttccctctggatctcagtcggatggcctggaaaatggaaattggagtcacttcgttttgaggctggtccagagtggggaagctcaggcagctctcgagtggggagctggggttggtagcttgggcctggagtgtgcagagatggggtagctctgcagcccccgtccttttgacagttgtctgcatttctaagtaggggctgggagactcctatcttagctcccccgtcttgtctggagcaccttctggccgcccacctgcccactccatgcccacgtatgttgagagggcctctaggaggtttttttagacaaggtctcgtgctatctcagtgtggtggcgtgatctcagctcactgcaacctctgcctcctgggacaggttcaagtgattctcccgcctcagcctcctgagtagttgggattacaggtgtgatccaccacatccggctaatttttgtatttttagtagagacggggtttccctatgttggccaggctggtctcaaactcctgacctcaagtgatctgctcgccttggcctcccagtgttgggactacaggcatgagccactgtgcctggccccactggcagctttgatggcccagatcagagggccctgagaggcagcggcctggagaggggaagggaacaccagctgggctagttgccaagacagcccagcggcaccagaggccatgccgaggtcaggcgagtctgcaggagccaggacacggagctgggttttcagcttagatcagaggctaggggtcagccagggcagaggctgggatcctagcagggtgaaggcagagccaggacaggagccaggcaggcagatcccagacagggaagcagaaatcagatggcttgcataaaacagcagcaacccagagcctggacactggggcttctgctcccttagacaagaagtctgctttggtatgtcgggaaggaggcaaatgagagaaacctggccaatggtagcttattccataaggacatttattgtttattccacaagaagtccaggagcagaggtggtctcgggattggtttggtgtccaaagaagccaggctcttcgctgacttcttagtgagctggttgatgcctcatgattataaagtggctgctgcagctccaggcatcacatcctcaccttgtatgtaaaggcaggaagtggagggtgaggtgaagcacccaaacagactccttacgtttcatgagcctgtgctggggcaatgtgaccacctcctggttgcaagggagctgggaaactgagtacctggccaaacagaaagggatggctctgcctggctcaggctggtcctgattcctttcctgggtcacatgtacagagtcacaagagggagttctggggcaagagaagaaggggcattgggggccaggcaacccacagagtctgctccatctgctctcccactggtgcagacctagaagctggtccaggatttctgccaccctctattcctgggacaggctggcaggcagaaggccagcagggtaccggggaagattcctgcttgccctcccctctcctgccccgggctttactctctgacctcatggaccacaaacagtacacaagagtcacagaagcctcagagtcccagcagtctctggtgcagagggcagtgtcccggctagtctgccaggccacaatgacatcatcagggccactgcccccgaaggccgtggcctggttttcttggccccacgcccatggctgcccacccgggtgagctcatgcctggacagaaatgggatcagtttctccaggtcagacacagccaggccaggagggctgagacgctggcaggggcagattccaaccagggctcctctgcccaggtctgcaggctctgtgggcaggggtgtcccagtgggaggtgccccatgaaggagagagctaggccttttgtactggctggcaggtcacttcgggggaagccagagctttgcccagaatggggaacactagaggttgcctgtaggaggccaaggcgggacccctccccagatctctccaggcttcaccctgctccctcctcctccaccctagcctccccacaccatccctgcctcctctcatggtcctctacctccacttcccagcccttgggaccaccccctgttaaatatggccatctgagttccccttgggatactgcaacccacccccgccaacttatcaccttcactcccaagcctgcccctctcccgtgcccttgttcgactgggggcatttctactattcccagcagccaggcctgaaaggggagacacactccaaccttcaccccacctcctgcccccagccccaggagcaccagggcctgacgctcctccaaatcccctgcgctggccatcccaggccccttccatcacgtgacctgacagccaccgtcttcttgctcctctccagagcccctaaacttggctgtggcccgtcagcttcttcaggggtgccagtggctggggcaggaatcggaacccttctctcctcctggagattcaggagaacggggtccacccttcactgccgtgtgatctgagccagctgtccccgctctctgtgcctccacgaagctcagccggggttgagacagaactgttgggaggataaactgtggtttggtggatgaggcaccactaggggccccggcctcaccgcccatttgctgggtgatctcaggcaagtcacttgcagtctctgagcctctgtctccacctcatttgtgatgtcgccgcagtgaccctcccagtttcatggacccttctaaggaccagaaaggggaggggctgaaagaattggctctggggggttaaggggccctgggccaggcatccaggccatcggaggactgtgtcccatagaggggtggagggggagcccgttctgcagcccacagcagggcctgagcccagggggcccagccagaaccctgggtgcagggtcagagccctgagcagccgctaagtgcaccctggagacacccctgctggggaggagcccagagcaggccactttgtccccagggatcccaggactgtcccccaggcccaggggcactgcagaactggtgagggagctactcaggcagaccatctgcctgtgcaccatggactctcagctcagcccagcaggtccttcacgcccctcggccccaggacccacccaagttcccagcagggatctccacccaccctgagcctatttctggcacacagcgccccctgctggcctcttcgggggcagcagagactcacggggcctctgagtcctggctctcaagttgtttaaaggaaggagaaagtctcccggtcccgggatctgggtctcagccacctttgactcctgcctccctcaaggagggacagatggggccgcattgcaggctggtcccaagcaatcgtggccacttttgtttttctggaaagtcttctaaaggtcatgtgccacaaggggcctatttatacccaccctttcactctcctccctccctttcttcccttccttttctgtctgtgtgtgtgtgtgtatgtgtgtgtgtgtgtgtgtgtgtgtgcgtatgtgtgtgtgctttttttttctctctctctctttttgtagatgtggtctcgatctgtcacccaggctggagcgcagtggcacaatcataactcactgtagccttgaactcctgggctcagcctcctgagtaactgggactgcaggcgtgtgccaccacgcctggctaattttctttattttttgtagagatgggggtctcactgtgttgcccaggctggtctcaaactcctggcctcaagtgatcctccagcctcagcctcttaaagtgctgggattacaggcatgagccaccactcccagccagcacagggactttgacggtgtctgaagggcactccttgaacctgagggtccagaaagactttcctgatgtcagaaggaggagagggctgggatggagggaacctgggccacgagtgaggttctcccactaaggagcgtgacggggcacacacagcgtggacagctgcaggtctcatggggtgcacatgcatgtccctgtgtgtcacgcatgtccctatgtgtcaggcccaactgggacctgactctctatctcctttggcccaggtcctcctgctagaagcagcagaacggccctccagcccggacaacgacctgccagcccccgagagcactccgccgacctggaatgaggacttcctccccgacgccatccctcttgctcaccctgtgccacgacagagaaggcccacgggcccagccggtgagtgagggctgcagagaggacaggctggggcagccgaagggaccttgggcatggcctcccagggcctccctagagaggccacacactagacactctagttccaacatgccatgtggcattttgaaaaattaagctaacagttgaaaatgggtatttcacctaaaagccaggatttctagtttctcttaagaagtagacgatctggtcaggtgcagtggctcatgcctgtaatcccaacactttgggaggccgagaagggtggatcatttgaggtcaggagttcgagaccagcctggccaacatggtgaaaccctgtctctactaaaaatacaaaaattagccaggcgtggaggcaggtgcctgtaatcccagctactcaggaggctgaggcaggagaatcgcttgaacccggaaggcggaggttgcagtgagccgagatcacgccactgcactccagcctgggggacaagagcaaaattccgtctaaaaaaaaaaaaaaaaaagtagaccatctggccgagcatagtggctcactcatgcttgtaatcctagcactttggaaggtcaaggcaggtggatcatttgaggtcaggagttcgagaccaacctgggcaacatggtaaaacccccatttctactgaaaatacaaaaattagcccagcatgattaatcccagctactcctaaggctgaggcatgagaattgcttgagctggggaggtggaggctgtagtgagccaagatcatgccactgcaatccagcctggaagacggggtgaaaccctgtctcaaaaaaatagatgatcttgggcaggtgcagtggctcacacctataatcccagcactttggaaggctgaggtgggaggattgcatgaagccaggagctcaagaccagcctgggcaacatagtgagaccctgtctctacaaaaaattataaaaataaaaatgagaaaattggccatcagggctggcagtccctcatggaaacaaccagctactgggttgccactgtaggtccagtccaggctgtgcagtttgccgcagtccccaccattccctattgtcttacagctcagctactgtcttcagtatctgccctgctccttggcttctgcacttatggcccccagcccagccttgctgggttcaattttgcagcattctgcctggccagggagcaggaacttactgcttcccacctctttctggggtttgctctctgaactctctggctggaattggaggacatctgcccccctgccttcctgccacacttttacaattttattttattttattattttattttgagacaatgtattgctctgtcactgaggctggagcacagtagtatgatcatagttcactgcagccttcatctccgaggctcaggtgatcctcctgcctcagcctcccaagtagttgggactacgagtgcacaccaccacacttggcttttttttttttttttaatttttagtagagacgaggtctcactgcgttgccaggctggtctcaaactcctggccttaagcaatcctcatgcctcggcttcccaaagtgctgggatttacaggtgtgagccaccatgcttggccctggccacattttaaagttaaggggaagaattttccctctgcagattctacctactggtctgggctctgccacctggggctgtaattacctttgctttaatcacaattgtaataatcatagttgcaatcgatgaagccctcctggttgccagacactgaggtggggctttatcctggaggacatttagcaaacaacacctgtctataaggctgaatccaggggttgaaggctgaggtctaccatgagtggtcaggatctgcactgtgccagttattaaatattttcatatcagatatgaaaatatttcaaatacagatataatttttttttttgacatggagtctcactctatcactcaggctggagtgcagtgtcgtgatctcggctcactgcaacctctgcctcctgggctcaagggattcccctgcctcagcctccctaataactgggattacaggcacgcaccaccaagccccgctactttttgcatttttaatacagaaggggttttgtcatgttggccaggctggtcttgaactcctgacctcaaatgatctgccctccttggcctcccaaagtgctgggattacaggtgtgagccagcacacgcagcctaatttttgtatttttagtagagacggggtttcaccatgtcggccaggctggcctcaaactcctgacctcaagtgatccacccgcctcggcctccaaagtgtggaattacaggtgtgagctagcgcacccagcctacagatatcactcttaatcttcacacaaagcttggaagccttgaggttacaggggagacacctgaggctcagagaagttaagtgacacccctggggtcacccagcaagccagcaagctgggggcattttgcctccatgattctctgcccttagagccctttggagggggcgctctccctctgccctctgttctgagtgtctattctgatgctgggttggggagcaggggcagagcagggaggagagatgcatgacacaggtggcctccagtggccagtcccagggccggggaaggagagtagggtatcctgcattcttggaaagggactgaaggctgcgggaggagggccgagctcaggtctcctacgggaagggggacctctctcactctggcccccggcctacccctcgagccgctgtccctaaggtctcacccccagagcgttacctcatgcccacattcttcagatctttcttgggggatggaggaggaggggcttcccatcccaccggggacccaggcccacgaaagcgcatgcctggcaagacctttccaaccaggggaaaatgcagtttcaagaatggccaccaggtggggcacacactctacacatggtgacacctgcagccaacctggattccagagcgcaggtggggctcttccgaggccagcagcccccagccaggccctccccaccataccacagtcccatgcaggcagagtgcaaagggccctaagactcagtgcaggtcccttcatcagatcagcaaactttttttttttttctgagacggtctcgctctgtaagccaagctggaatgcagtggtgtgattatagctcactgcagcccagacctcctgggctcaagccatcctcccacctcaacgtccccagtagctggggccacaggcgtgcaccactatgcccggttaacttttgtatcttttgtagagatggggtctcactatgtggcccaggctggtctcaaactcctgggctcaagtgatcttcctgcctcagcctcctaaggtgctgagcaaacatttttcagcatcctctctgggccagagggagaaaaggctgtcccctggccacacagcaagccttacctctccatctccttgtccacccttggggtttagagatctgtagctgggaagatccatccttcaggacctcctggggcctcctcggaggccacctgttggggagcactttgccacaagcccggttcttgaccctaagcagagagacagcagggtgtgagagagggacctggagctaagcaacttcatctgcagcctggctgtgtgagcttgggcaagggaccaaccttcctgagcctcagtttccccacattgaaaatgggaacgaaagcagttcttagaatcatagatgtttgtaagtgcaaagctggtttgtaagttgtaataaccagctccaaggtgatgtgagtgcctttgcctgtttagggagtcccaggtaggcagggctcctgggggaacgtaggctgacagcccagggggccaggcctggagccactggaggctgggggtccaccatgttctgatgccctgtctccttctctccccagggcccccggggcagacaggaccaccagggcctgcaggcccccccgggtctaaaggtgaccgaggccagacaggagagaagggtccagcggggccgcctggtaagaaaaccccccacatatgtgatgttgtcaacctgcggaaggggctgggctttcttctctactggaacaggcgaggtgtcccacgcacccacagccctgatcttgctgggtaccagaaaaacggggtcttttttttttaattttttgagagggagtctcgctctgttgtccaggctggagtgcagtgatgccatctcggctcattgccacctctgcctcccgggttcaagcaattctcctgcctcagcctcctgagtagctgggattacaggcatgcgccaccacacctggctaattttgtattttcaatagagacaggatttcaccatgttggtcaggctggtctcgaactcctgacctcagatgatccacccaccttggcctcccaaagtgctgggattacaggcgtgagccaccacctcacctggcttttttttttttttttttttgagatggagtcttgtgctgtgtcgcccagactggagcacggtggcacaatctcagctcactgacacctccacctcccaggttcaagcaactgtcctgcctcagcctactgagtaactaggattacaggtgcctgccaccatgcctggctaatttttgtatttttagtagagacagggtttcaccatgttggccaggctggtcttgaactcctgacctcaggtgacctgcctgccttggcctcccaaagtgctgggattacaggggtgagccacaacacctggccaaaacagggtcttcaggggcttcgggtacaggcatgagcatcgaggctgtcaggggccaggagcagttctcagccatttaaacacctccagagaccaccctctcaactcctcctgggtcctgccggggaaggacccctggttcagcaggtacagggccagcccaggatggtggcttatacttggtgttcctgccacagggctgaagtccctgggagggaccaatgggcctctggccagagcctttgctgatttcaccgtccctgcccccctcaccctcccaagctgccactaagtgtcccctctggactgggctgggaagggaagcccatttcatttacaccccaggacacccccaaggaagactgtggatcggaggtcaccactgactgcctgtgggcccctgaccaaccctgtttctttcaaggcctcagtttccccatttgtaagttgcagccacccgccaggctccggctgccacagtgactgttcttttcctcattgcagggctcctggggcctccagggccccgtgggcttcctggagagatggggcgccccggccccccaggaccacccggcccagcaggcaacccaggcccctcaccaaacagcccccagggcgccctctactccctgcagccgcctacagacaaagacagtgagtaatgcccctggggggccaagggagggctgagctacgctgtgttctgggagggatcagccttccttaaaggatcctgggaagtggaccccaccacatgcccatcctgctgcacccaactggctcactcctgcaggcctcctccaggaagccctccatgcagtgtccagggcctgccagtgacgatgacagggaacagcttgggagcaaggcttggtcctggggctaagcatcctcaagtggacccagggctagccccaagccctgcttttggccccaaagtggcctgtctctgcctcagtgctcagctccctgcctttggggttgtgagccccaaagttcactctgctggctgacttggcccagattccctacctggctaccccaccccaccaaggttatcccttattgtacttgttcctcacccgccctcactgcaggtcattcagcaggtgtttagtgagcacctactatgtgcaaggcacaggattttagccactggggacacagcaatgtgcaaaacaaactccggccctcgggggcaccggccagtccaagagagcctctgaacacacagaaatgtccacttctaccttgggaggtggggacaaggaggtgcagagagtggacgggaccaggactctgggcctaagggaccatgaggtagtgggaggccaggcagaggagtccgtgagccctgagaggagcatcatttctggttaagtgtcccggcaactggggaagatttttactttaattttttttgacatagggtctgttgcccaggctggaatgcagtggcgccatcatagctccctgcagcctctcactcctgggctcaagggatcctcccacctcagcctcctgagtagctaggaccctaggcatgtatcgccacatctaactaatttttttttttttttttgagtggagatggggtctcacaatgttgcccaggctggtctggagatgtggtctcactatgttgggcaggctggtcttgaactcctggcctcaagtgatcctccctcctcagcctcccaaagtgctgggagtacaggtgtgagccactgtgcccagcctggggaagggttttatgaggaaggtgatggcattgccctggggccctgggtctggttcaggattggccagggtgaatcaggtgaggggctcatcctggagggccatgggagatgggttgttaaacagactccacccctgctccaggcagtgtggtcgccatgatgtaatcagactccccaggcacagctcagaggggtgggcatggagggcttcctggaggagtgagccagttgggtgcagcaggatgggcctgtgggatggagcctggaagaagatgccagcctggggcattggagaagtgagcagggcagacccagagtctgaagagcctggaatgttctagaaggtatttatgttttatatgaagctgaccgacctggctttccctgctctttgtctgggcctctccgtgctcctctgagcagtgggggcaacagtatctgcagcgggccccagggtgatgggaggagcccccctgggcttcgtgtggcctggctcagggctcagtgccccggaccagcctcccagcactgccaggtctgccccaccagacccctggccgctccgctcttcccacagatggagactcaaggctggcctctgccatcgtggacacagtgctggcaggtgtcccaggaccccggggtccccctggtccaccaggtaagtgaatggtgggctggcctgcattgaggactccatccccccagggctggcctgagccatggggccttgaggggagctggaggtcggctggcggtccatggcttctgggcaatgctggggactgggtctgtcccacccgctgtgtggcaggaaatgaagcccctcgtttcctagtggcagtgcccctgggggactggatgcatgaaacccacgtgattctgctggaataagatgcctgcatgaggctgcccttgcatgggccagagtgggacacacaccagtgggggatggggtcaggacagaggtggcaggaagtccctacctttgaggcagaaaccaaggggttcaaaggggctgggacctggctgtcagtcctggcctgaccttccatcatccacattcctcattgggggaagaatgcagggctgactgccttgtccctttctgcccgggaagggagtcattcattcattcattcatttgtttattcactgattcattcattcttttattcattcatttattcattcattcgttcattcattcattcatttgtccattcattcattcgttcattcattcattcgtttattcattcattcattcatttctctgtgcgtctcacaaacattcattgaacatctgccactacatgtgccagacagtgatctaggttcccggaactcctgaataatcaaaacaaacatcatcgagaaactctcattctggtggaggacaggaatatcatcataaattgtgacttcgacaggatctgagggagctacaagggagaagctggggcgtggcggggaggcgccgtcaaaacgtgacatttcagaagatgctctagggaggagagggagtaagctcagagggtacctgggggccttcaggtgacatgccaggtctctggagaactggacagactcctgacatttgtcccctggagtgcctgtcctcacatgccctctccaaacctgggagccaggccatgctggacagcccaacatgcggctccctgcaccacagggagggatcatgagagaccctccctgggcccgtgtggggtcatgagagaccaagaccttactcttcctagcaggctggagattagtcatgaatctccctccctgagctgggcacacacatgagacccagcccggccctctgggtactccacatcccatggggcagacagacgtgtaaacctcagtggccatgggcggtggctggtttacataagggatttgcctggagaagcagtggaaagctgggaaggcttcctggaagaggtgatgctctgtgtcagactggtaggaaaaccagtaggaaagggtttgctgggagagtggaggaatagggaggctccaggaggaaggacagctttagcagagacgccaggagggtgtctggctggggcagggagggtgggaaggggccgggctgaggacttcaggagccctgaaagggatgtaactgggcttggatttttgagagtgtactcttgggggccataggaagggtcgatgatcaggaggctgttatagtaaccccagcaagagggatgggtcccaggtcccgaggcgggaaagaccggagagacgtaccaggggaccaactggctggggcgtgggagcagtctggacggacttcctcccttgcctgccgggtctcgggattggggctgcgtcgtggacgaggccctgggaggaggaggtgtgggagctgtgggcagccggtggagaggaccctgggctccgaggatggagacctcgttgagagggggtgtgcctccctcctccccacaccattcattcccaaaccctcctttacttcccatggagacagatcaagaacaggtgctggggtgggaggctgggggcgccccctctctggccccaggtgaccatctgtgactctgcccacaggtccccctgggcctcgaggtcccccaggacccccaggaacacctggatcccaggtaaggactttgccattttaggtagggtgtgggaggcggcgggtggcgggtggccttgtctccctaggggagaagaagcacctttttaccagcaagagtcactcaggaaggagccagtcggcctggccggtgagattttattttattttgttttatttatttttaaatttatttttgagatggagtctctctctgtcacccaggctggagtgcagtggcgccatctcagctcatgcaacctccacctcctggattcaagtgattctcctgcctcagcctccggattagccgggaccacaggcgcacgccaccacgcccagctaatttttgtatttttagtaagagatgggatttcaccatgttgcccaggctggtctcgaacatccgacctcaagtaatccatccgcctcagcctcccaaagtgctgggattacaggtgtgagccactgcgcccagccgagattttaattttattagcagcagtgactctttgctgagtatatcctcctcctgttatgccagggaggtgttagcatcactcgcatttcacagatgagctaactgagtcccagagagaccagatgctgcctgaggttgtacagagggtgtaggcagagttgggccaggtcacagaatctctgcctcagcccctcaccttgccctgagaattgcccatggggaggcggcaccccaagcctgactcagcccctaaccccaggttcgccctgcctctgcagctgtcagaagtcaggaagagcaggtacaaaggccctgaggcagggaaaaggctggcaggtagtgagcaatggagtgtgtggtgtcggatgaggcacagtgggcagggccttatctacgggtcccaggtgtgggcttttgttacagtggatggaattattgagtttcagggagggtgattccatgatcttatttacatctttaaaaagctcctctgaggggccaggtgagatggctgacgcctgtaatcccagcactttgggaggctaaggtgggaggatcgcttgagcccgggagtttgagaccagcctgggcaacatagcaagaccccatctctataaaaaatttaaaaattagcctggtgtggtggcgtgcgcctgtagtcccagctacttgggaggctgagatgggaggatggcttgagcccaggagttggaggctgcagtgagctctcatggcaccactgccctccagcctgggtgacagagcaagaccctgtctcattaaaaaaaattaattaattaattaaatatgtaaaaatagaaagtagactcggcatgtctggccaatggaataagtctggtgagaagggcagggaaggctgtagtttcactccctggtgtctgtcaggagcagctgggaggaccagggaggcatttcctgagaaggggaggcttcgggatggggggcaccaggagttccctttggagagagggggagtgggcacctcatggtcagctgggtggcgatgtcaggggacagctggacacgggcctggggctcccgggagccgtctgggctgacatcagcacacgtgggaccctggccatcgctgttagtatcactagttctctccacacaccggaccacctgctccccttctctgcctgacagccgtacgtggcattggcccattttgcaggtgagaagactgagggctcagctggggtccctagtcaatagcagctccaggtggctccaggactggaggcctttgagtctgcccttcccgtgccggccgggccatcctcctctcccttcctcttctgcagactcagagcacagtgggcggggaggggggtggccagagggcactggagacttggccaggaccggcaggcctcacacgcttcctttggttttctgcagggcctggctggagagcgaggcacagtggggccgtccgtaagtgtgggctgtgcagatgggcctgggccactcccaggcagaggctctgatgcaagcccagggcactgggtggcgggggttggtgggggggttcagccctgggtggccctgctggagctcaggcaacagggagggactgagaaaggactcaaatcgcctcctgctgcggggtgaggagggaagcgacctccagagagtgcgctgacagtcctgagtgcctgcagccctggattaatgcactgtgtgaccctggcctttcattcatgcgctgtgtggcctggggccataggttaacatgccgtgtgacctgggaagtcccttcttttctctgaacctcccagaaataggcttagacagccttcctttaatcgactttcttggaaacaagaacttatgagtctcccagcctgaccaacatggtgaaaccctgtctctactaaaaatacaaaaattagctgagtgtggtggtacgcatctgcagtcccagccactctgaaggctgagacagaagaattgcttgaacccggaggcagaggttgcagcgagccaggatcacgccactgcactgcagcctgggtgacagagtgagactccatctcaaaaaaaaaaaaaaaattatgagtatagactcctgcctctagggccaaggagtcaggcgcttccttgatgcccaagcctcactgtaggggtgtggggcggggaggaggagtggagctttgctgagcacctactatgtgctggccacagtggaggtgctctcttcccccacagcgcatgtaagcttcacagcgaccccaagagaccatgctttattatccccgtttgccaaaactggccactaaggctcagagaggttaagtaacttgcccaaagccacacagcgaggcagtggtggagcctggatttgaaccagggagtgtcaagctcccaagccatgcctcctcccgtgcttgtctagtgaccaaacacaacacaggagacacaatgatggcacttctaggtgccaggctctaatctaagctcattgtccctattgattaacttaatcctcctaacaacagatgagatagatactattactgatcccattttacagttgggaaaactgaggcaccaagaagtacagtgacccactcaaggccacacagtagtagctggacatttacatgttactgtgagctgggcatggtggtggctcatacctgtaaccccagtgctttgggaggccaaggcaggaggatcattttgaggccaggagttcaaggccaccctggacaacatagtgagacccacccccatctctataaaaatattaaaaaattagctgggttgtggtggtgcgtgcccatagtcctagttactcaggaggctgaggttggaggatcacttgaacccaggaggtagaggctgcagtgagccatgatcgcgtcactatactccagcctgggcaacagagcaagaccctgtctcaaaaaattggctgggtgcggtggctcacgcctgtaatcccagcactttgggaggccaaggcaggcagatcacctgaagtcaggagttcgagatgagcctggccaacatggtgaaaccccgtctctactacaaatacaaaaattagccagacatggtggcgcatgcctgtaatctcagctactcaggaggctgaggcaggagaatcgcttgaacacaggaggcagagattgcagtgagccgagatcacaacactgcaccccagcctgggtgacaagagtgaaactccatctcaaataaataaataaataaaatacaataaaatatgtgactttgaatctggtattactggccttgtgttggagacagacagcagcccttccaggcaggctactcaatcctggaagggcccaggcatgaacttgccggcttcctagcctgagtctcttctgccccagaagcagaatgaagcacttacagccaaccctggacacttccctgccatgccaggctgagcaggctgtgccccggagccgtggcctcccctgctgtgctcagcccagggcaggagtcccctgggcccagcacccgtttcccaggccctgcctgcccagcctgcccctgactccctgcaggcccccagggaactggagagggtggagaggtgcccccacctcccgttccagtgttgactgtgtgacttgcttcttagggtgaacctggcgtgaagggggaagaaggagagaaagccgccactgcagaggtaaccatggctgcccttcacgttccctcccgcctccttggctgtgagcactgtcacgggagggcaggtgccccacagatctgcgctgaccgtcagccagccccgagctgggtgctgggccaccgggtgtacagggcccctgccctgagaagttcacagccccatgggaactcagctgagtacagcagtgattgcaagagagtgagaaggtggctgggtggggatgccacagagggggtgattggcccttgggggggcttcccgggacagggagaggagtcgcaaacttgtaggaaagacagtctccctggaggaggcgtcaggctgcagagtccctctcaacggaccgggttctcccgtgaatggcgtctcggcatgggcgtgcttacaaggtcaagggtgctgggggactgaaggggacagggctgctggatgtggtagaggatggatggaggaagagggacttgcaaactgggaatctgaggagagaagattggagcaagcggaggctggggccagtgggagggggcagccagggcacgggcttggctgtggggacctgcggcttctgggaggaggaggggaggctgaagctggggtagtggatgaaggggatgaagggctcatctgaggtccaaagtcaaattcctcccctcagctggccctgagctaggtgctgggccaccaggtgtacagggtccctgccctgagaagttcacagcccagtgagggacacagctgaggacagcagtgattgccagagaatgagaaggttgttgcgtgggggtgccactgagatggggccggcagggggggccttgaaagctaaaagcgaaagtgcctgagcagggtttcccttgagtgtgtcaaagctgggtgggcaaaacagctgggagggccagggcgggtccaggggaccttcaggaagtccttgcaagaccagagaaagggaagaggctggaatcaaggccgctgtgaggggtgcaggaggtagtaagaggggctgaggcatgagcctgatacactggtcactcacagcagtactctgagaggtgactgtgaccccctccatttcataacagcaacctgcctggcctgtaatcccagcactttgggaggctgaggtaggagaatcgcttgagcccatgagatcaagaccagcctgggaaacctagcgagaccccatttcttaaaaaaaaaaaaaaaaaaaaaaagtaatgagacaggcgtggtagtgtgtgcttatagtcccagctacttgggaggctgaggcaggaggattgcttgagcccaggaggttgaggctgcagtgaactacaatcgtgccactgtactccagtctgggtgacaaagcaagaccttgtctctaaaacctaaaaaaaccccaaaaaacaaaaacaaaaaaaccaaccacctgtggcttaggaacatgaggctcagccaggtcccttggtctcccctgctccttctctgagttggggacacgacactgacatccctgtcccagaccctgtaattggctcaacttcccattgtctttggtcccctggtgggcagacctttctcctataacccagtaggatgctttttggtttccttttgtttcattttaagctaaattaatctgaacataagacagatctgtcatgttacaccagcaaaaggcacccattctgctgccaactcccagggctgggcaggatggggacagtggctttgtctcctcatcatcacttttcagagtggcctcgacacctgccttctcaataagtcagcaccctgtcttggctgactcaggtgtctctgtgcacaaggtcctctgcttgtgtgcagaccgggcccttgaaatacagactctgccatcacgccagcctgcctgcctgcactttgaaatggtggctttctctgctgtctttcttgcctggcatggccacacctaccctgccccttgcctgctgtttggtggcgagctcttgggcattcaaggaaggaaacaagcaaagaacttcctaccttcgggccctgggataggtgctctgtcctggttagggtattttcaggacatgtgggggaagctgacaggcagctatggtggaaggaaaagctcaggctggaggctgacaggtgtggatctgcagtctggatcggccgctttgccaggctgtgtggccgtggggaggttgcctgccctctctgtgtttcaagctctttgtctgtgaacagggtttgaagccctgtctggcacatagttgatgatgttcagtctatgcttatttgcagtggtgagggtgtcgggtgggaagaggcaggggtggggggctttgaggacacatacactgtcactgtatcaggatggccctgaccccttcctcatggccggccctgaccctgcctgtttcctccccgccagggcgagggggtgcagcagctgagagaggccctgaagatcctggcagagcgagtcctcatcctggagcacatgattgggatccacggtgagcagtgaccaggatcagcgggctgggaatctctctcccctccttcctctcccaatgctgccctcatggctgctgcctagggtctctggtctccctcccttgcccctagtctgaccctccccctcccctgctcaaggaccctcagtggctccctgctgcccttgacagacttccaagtgcatcagcccagtttcccagcccctccctagtatagccatggtgggcagagccctgcccagccatgttgaggcccctcccacctccatgcctttgctcgggccatgcctctgcctggtgaacactgactgccacttcgggacctgctcaaagatctcggcctctgtgaagccttctctgaaccctcctctttgtccctatggtgacataggggaggcttccattccatgctggggtttctgtgaccctctgggagtcccttgtgcagaacagtgaatgatacctctgcagggcctggagtagaggcccatcagcatttgctggaaaatgaatggatgaatgaataggtgaatggacaggtgggtgggtgagtgagtgagtgaacgaatggctggttgcctggatgaatgtatgcatgggtggatgcatagatagatgaatgaatgaatgaatgaattgttgaatggacaggtggataggtggatgagtgagtggatgggtagatgcatggatgaataaatgaatgggtggatggatagatggataaatggatggatggatggatgagtggacaggtgggtgggtgaatgagtgaatggatggatggatggatgatggatgagtgaacaggtgggtggataaatgagtggatggataagtgggcaggtgggtgggtaaatgagtgaatagatgcatggatgaatgaatgaatgggtggatgggcgggtgagtggacaggtaggtgggtgaataagtgagtgaatggatggatggatggatgatagatggatgggtaaatgagtgaatgaatggatagatgcatagataaatgaatgactgagtggatggatggatggatggatggatggatggatggatagatgcatagatgaatcaatgagtggataggtgggtgggtggataagtgagtggatggatgggtggatggatggatggatggatggatggatggatggatggatggatggatggacgggcaggtaaatgagtgaatgaatggatagatgcatagataaatgagtgactgagtgggtggatgaatgggtgaatggatgaatgggtggatacacagatggatgaatgggtcaatggacaggtggatgggtgaatgagtgaatgaatggatggatgcatggatccatgaatgaatgaatgcataaggggctgaaagcctgctgctgccttgcttctccacgctgggcaagagcatctctccgtggccacatatcatgatcaaatgtacccccaagtgttcctaaggctctacctcgagtccaccctcctgctctccttccagatcccctggcctccccagaggaggttctggccaggatgctgccctgagagccaacctcaagatgaagaggggtggcgcccaacccgatggggtccttgctgccctgcttgggcccgaccctggacagaagagcgtggaccaggccagcagcaggaagtgagagcccactgctccaggacaccctatcctggctagagacccagccccagaggcctgagccgccgctgtttcctaaagatgcccccaggggaactgggctccaggcatggatgattgtgaggacatggggggctttggggacagataatgtctccaggggcagggtctggaggggccaacaccctcatcagagccctcctctggcctgtcccctcccctacccccactcccggctggagacggggtctgggtgggctgggtgctgggaatgagaataatcctaatacccatcatttattgagtccctgctgtaactggccctgtccagggaactttcgttacgttgtctcattatttaacccttaggaggtaagcttattatccccacttcacaaggggaccgaggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctgggggagcagcctggactgcagctctcagaggccagggagaccctgaataaatcactgccagccatacggacttgaggaccttgagagagaagcattgggggtgcaagtgtccaccaaaccagataggcatccctggccactgcctcccagtcttgctgagcccacccgctctctctgggtccatcccatccctgagccaggggaggcagcatttcatgggcatgtctatcagaggtgggacttgcagcctctgccccacgagtttgtctctcagtggactctataggtttgctacttttgcatgacacagcaagcccagtgtcccctttgcaagctgcagagagggaaacagagtcccaggcctgctgggaagagatgctcctgcctcccaccttccagagttgggggcctggcaggctccatggcaggcaccaggtccctagcagcccagaacagctctgactggagccctcaaggcctctggggccagggtctccgtgatcagctcagccctggtgttcctctcttgctgggctgggacctgggacacagccacggcagcaaactcagagaattgaaggtgctggcgccaccctggggcactctgtcttcacagcaggagtgactgtctccagtgctcttggtactcctgtttggctgtggcctggtccctctgggccctgggatcttcttctggcccttgaggcaggtctggagaggcagtctctgtcttcatggaggggtggtcagaggcgggcgggaccaccagcctgtagcgttattattatatgtgacaataaaggtgctctccccac

SEQ ID NO: 1793 - DNA, 13944 bp, Homo sapiens
gacaagcttgaagatgcttttattgagaaggagagggactgaacagattcttgacaagcctaggcataaatgctccaggtttgggaaagaggtaaaataaataggtggttactggggaggctccaacacagccagaagggacactgtttgcttcagcctctgggcctgtccattgtttttgctgtgtgagctggggtgtggggtttgctgcaaactgggatccagaagaggaattctcggggctctaatgggtatcagatctgccatcttgcatcagcggggcctggttcttggaggtgtctaagctggtgcctaagggcttatctgaggaaagacaaagattcagatgaggctgatggcaggtgagggatctgcagagcttatgccaccaataagcttggagcctcaaggtaagcctgaatgcatgaagctaagcccctgggggaatatcctgtgcccagcacccgccacactcagttctgccccagggctgggcctgcaggcttttccaactggccctctctctcacccaggagcaccagacactcccaatggttgtcaggaccccagggtgtcctcacccccagcatccttctgacagcctccagccgggacaggattcgtggggcctcctgtggacatagcatctgtagctccccaggtcttatgcgaagtagctggctccccgtcagggacccaagtgtcctcaccgtgctgtgaacaaaacagcaaaagccatccgtggtgggctggaaggaccctgggcctgagcgtttgggcagagacagggctctttgggctcggaggttggggttacagaaaaattcatggagtaggctatctgagattgaaggagtaaagtcagcatttggcttcagccaatttcagaacttccagatttgaaagaagtgctctgggagagaatcttctggctggggaggggcggctaagctggcagctggggttcttcccgagtccactcccctgatccttgctgcctttgccacagcagagctccccacttaatctctaatctaggcttggacacgcctctgctctgtcctctaactcagcagagacggtgctggatcggggtcatgtacaatgtaggccaggttgtatgttctgggtctctgggtttccttggttagccctttacaaagtttctccctccatatcctgtagggccaggcactcacgcagtggagaagttctctgcctgcagccagtctgtgacctcttcaggcctcgagctaagtcgaagcattggaacctagaatcagggggaaccagggatcagagtccatctcatctcacagccaaccacagcccctaacatctgggtcccttctccaggttcccatcaaatcacttctcttactctgtggctttctggtctggcagggagctggtcttgttctctgctctggccccatgataaagttggcacactaagcatgcaataatacggtccgaatcaaaccaagactatctcctctgcttgccactgaatcctccccaccccgacctccaactcaagacttagggctctggatagtccaggctgggtagtacccgagagggtgactggccctgggtcccaggggtccccggctgtaggggctccaggatgttgcttggaatgtagccgctccgtcccgcctcattcttcaccagccaccaccgcttgctgtggtccagaacctgccaagagtcaccacctcagtcccctgagcctctttccagccagccttccctccccacacaaggctttctccctccagctctttcctaccctccttctccctctctaggccacccaccttggcagctccatccctggaccatccacccttggctgcctgtagctcccaccaaccaccacctccttttctagcctatggcccaagcctcacctccagcttctctccctggaccacagtcagttcccgtgggttcctagcttcaaactcgtacaagacttgcattttcagggctggctgggcaggtttggggctggagggcctggagttggggtccccaggctgagggtcatggttgtgtgtcttctcctgaggaaagtgtgaggtgctccctaacctatgacttccccgcctaagaaacagagtcaggatggctggagaatggggcctcagaaattaagcctatgtcccagccctgagattcccctcaggtatctccggcctgcagtctgatggtgacttttgggtttctttagagtttgctggcaggtcagtgttaggtggggctttctgcaggcaggaggggtctgaaatgtcattgatttctgaagacatttccgggagtggaattttctacatctgagttctgccctaagcactttatacttgagtatgggaaatcagaagcatgtgtgggtagtatcatgagaagaagcaatgggagcctaggagggtagaacactgtttttcacccaaggtaggagagggatgtccttgtacatgtttttctggctaaaagagaccctcttggctctcttaagatgtagagagccagagatccaaaggaacagccctgtccctccctccccaggaccacgcagtccctattaagctcagagcataccgaagggaaacagggtcctggtatcctaagggtgcctgtaagggacagaacagagagtgagtaagagcaggaggcagccagcatggtgggagggagctggggtatccgaccacaggcataagcagctcacacacagctgcctcctatcccctttcctgcctcccccagtttacagatacaggtacccacatgcacccacccacccactacttggagatggggcctcagaaattgagcctatgtcccagccctgagagtcccccagaatatctcctgtttgcagtctggtggtgacttttgggtttccatggaatttgctggcttgccagtgttaggtcacactagttgtgtgaccatggtttggatggggagggcagaaactagccagggactagggctgtgggtagggctctatgccaagctccccttacttggctggagggctctggaagttgccagtcatctgagaatgtgggttggtagggcaggggctcatcgcctgtccagtcggccctgaagagggaaacaaagctgagttcacatccactctgtgaactctgatgccaggctgtgggacgcggacagggaggggacgacagggcctagcctcaggaatcttttggctaataggtgacatggtccatgtgcacagatgaaaggccccaggacacccacaaaggagcaagcagttaagcctggacacatcccacggtgcaggtgtctgggggtcaacctcacctctgcccatgaggtaaagatacaccacctccgtaagaacatgatggacacttcattgccctgattgggcatttggattaaagtagtagaactacaagagcttttgggctggccaacaccccaggggtcttgtgcagtatttttctaggctgtttttagtttcccagcagcagatccttttctttctagctaaattgtctgtggatttccacccagtgaagtagacagcagccgagctgctcctgttgactgactctgggatgggctggtccttgcctctcagcctccccctcgcccattacacagggcccaggaggaccatgctgtttgtggccttcaggcttgccctgcttggaatattttccacttgtctgcccagggaatgcccattcatttccttgaagacgttcccctccttgcttcactggggcagaagtaaatattctgctgaacttggtacatccctaggtattgctcttctcacactgcattgctcatgattcttagctctttgtttcttactatatatagatttccttgggggctgtacccctagtacagtggctgatacataggagggagctattaagtgtttattcaatgggaacaaaggaatgattccctcttctcaattttcttaattgtttccttctgtgccttagaaacatgcttgggtcttgaccctaatactactccgtataagctgtcatcctattactttcttcttaccaaatttcttgagaatgtgcctatatcctctgcctatatattcttgtctctgtttctttcattatttctgcaacctggtttctacctctgccattactttattgaagctagtccatttaaaatcctgattgccaaatccaatggccttgtatggtctctgtccttctggatgaccacaacatttagtgttacttatagctttgggtcaatttgccaaaaatcaagttatctaaatataatttgcttgaaattcaactcttttgagggtttttacatttctttaggtattctattttctatgtttctgtctttcatttatttctggttatgttaagaaactaaaaaacatctaagggcacatctgacaatattacatttaaaagtatttatcaattgtacatcattttatgaatactgaagttgttttgcatcttcgtgggtatttaaaaaataatatgtgctaatctgtttttctaaggactcaaattgtagaagtaaggctgggttttgaaacacaaaatggtgtattcgacctggttattcaatgttaaagtggctgaatgaaagaacttgaggccctcttgtttgagtctattgtagaacctctgttttcctctcctgctagtgctagacagataccagagctattcccacagacagtgggagcccagcacagccctaggaactgtgagactggcttattcaggtactcttagtcccagggttttggacaagggaactctggtatgagatgggaggtccagaactgataagtaatttcattttagtgactgcacagacagtgcataaaaatagattgttatgggtggaaacaacccatctgtccatcaacagatgaatacataaataaaatgtgtcatacccataacaatgggatattatccagctataaaaaggaaggcagttctgatagatgaatgaatcgtgaagacattattttaagtgaacaagccacatacgacaggacaaatattgtatgatttcacttatatgaggttcctagaacaggcaacatattctcatagagacagaaagtagaatagaggtttccaagggttgaggagtgggtaatggggaattattgtttaatgggtacagaatttctgtttgggatgatgaaaaagttcttgaaatactgtagataatggtgttggtggcacacattgttaatgaacgtattgccactgaattatacacttaaaacggttaaaatgataaaagtggttaatttcatgctatgtatattataccataataaaaaatagatagttttgaactataattcatgtcttcagacaaactggacacaaaattttgtaaatggggctgaattgaaaagaactggtcatggcggggtgcggcagctcacggctgtaatctcagcactttgggaagccgaggtgggcggatcccttgagctcaggagttcaagaccagcctgagcaacatggtgaaaccccatctctacaaaaaaaatacaaaaaatagccagacatggtggtggcacacaggtggcacacctgtggtcccagctattcgagaaggtgaggtaggaggatcgctggagccaggaggtggaggctgcagtgaggtgagatcatcatgccactgcactccagactgagtgacagagcgagaccttgtctcaaacaaaacagaagtggttattaggcaaataactccaagaaaagactcatttccctgttggcttttctgcttttctaaagccttctctcttggttttcatccctctgctcttcaggttctccttaactctctggaattattctctgtcttcttaaccctttttgcacttgccatgtagaagtttgccaaggcccttgcctcttctttcatggaatagagcaaactatgcttgtcaaggtacgttcaggggctccctctggagtgctccccagtagctgtgcctctagccatcacatctgggcatcccctctcagctgcctggccaccaggcctctgtggaatgttccaaggatgcctcagctcagcgtgcccaagctggttcctcccactcccctggctctcatccgtttggttttttgttttgttttgttttttgagatggagttttgctcctgttgcacacactggagtgcagtggggcgatctcagctcactacaacctccgcctcccaggttcaagtgattctcctgcctcagcctcccaagtagctgggtttacaggcatgcaccactacacccagctaattttgtatatttagaagagacgggttttcaccatgttggccaggatggtctcgaactcctgacctcaggtgatccgcccacctggcctcccagagtgctgggattacaggcatgagccaccgcactggccctgttaggtttttttgtccagctgcccatctcacagttacccctgcagggagtatctctgtctctcttaacctcaggctcattggttgccaagtcttactgatattacatttgcagcatctcttacgtcagtaattcttaaatctggggctggattgagacaaagttttcactttgtccttgacaaaaatgagaaaatattttagtagaaggttgccatctcccttttcttgggaaaaactgttcttttttctgagataacatgtttcagtagtgggtgatggcaagtgtgcacttttcttttgttaataaactgttggcacttagacaaataaaaagttgggaactctctgtagagtcccccaagtagctctgaaatatttctggtttgtgacaacatagagcctggccacctctgatgtcctgcctgatgcctccatgcccctcacccccgattcagttcaggctttgtcttcactcaccggctagtggtccaggctgggcccaaccccatccaaaggttactctcaggtgggcttagacaggactgtagcaggttgatagctttaggggtgaggaggggtgagatcacttgggctgctaggccagcctcagggcacctggccaggatctaggggagagatggaaggtgtcaggaagcctaggctcccacagggcccagtgagggtgggaaaggcccagagtccctggcttcccacttttgcaatggtaggatgttacctcctgcaaggggccccatctgccttgggcctgctgctccttcctgtctcccttagagccttggcgtccttggctctgaccccagctcatctggttccaccctggcccctgctcccccatccccctccaccagctcctttcctctctctactccttcttgacttcagcctgtccgtcttcaccaccctgtcgtcccttgactcacgaagttcagggacttgaagaggatgtgtacgagctcaggggcacttgtctccttcagccaggtggccagccttccctggggacacagagcaatgcctgtcaccacccttcaccccaccccatcttcaccaggtcaccataattgttttatgccttggctggaaggctggcacttcccaaaagtcccaagaggggaggggaggttctagggggagtagatgaagaagaaaaaggcttgggatggttgagtccagacagcagaggattactggggaggaaggggaagaggagaggcctggtgaacttgtggggagccacctaccaggaggttgaagctgtgcttgatcttctggaagcagtcaatgtactgtgcctgggtgagacctgggagaaggggccaagacggtgggccagagatcaccctgagacacccctactcctcttccctggccctcagtactcacctccctggtccttgttttttttcccaaatttcttcttcctgctggtctttgcctgggccttctccagctttcccatgaacagctcaatgtcccttaggacatggttcagcacttcctgggccccaaacaacccatggccttgaacgggcagttgggcccaccctggaactccccacactgccccccgcacccctccccaccacaagccccagcctcaggcccagcctggagtataaacaagcctctctggcctcctggcccaggccctggccatcctgggaccctggcctcctagaaaaagagggagggttggtgtccttccttttcccaggcccagaaagcctcagcaaactcaagaccatccgcagttacctcgtccctctctgggtcctcgggggaagaggaccgccttggaggaggcagagtaaaggcacttggttctcgggcactggtgtggcgtggcaggggccttggggatggtgggaggcctgcagtgtaaggggaccatggacctagatcttagatctttgacttttcatcgaaaccctctccttcacctgcccccatgccccaaacttactgtgctctagggtcctctggtggggctgttctggagggatccccggctccagatagcgtgcctgctccatagggagcggcctttccatagcaggccccctccatctgtcctggcctggctgaaggcctccaagtcgaggtctgctgaggacatggtaggggccacatctttgacaaggttctttggagagaggccctccccacaattctgctccaggacccaggggcaccaccacctctctccaggagtcccaccccctgctccctggtctccttctggacccacccctgactccaccctgcctcatctgcctaccctctgggccctcttgggtcccatctcagtctctgaggacagtctctagtgccctctgggcccagccccttgcctatgcccacctctgtcctggctcctcctcagtccaggcccaggttggttgggccacaacctcctgggtgccccaagatatggggtcagggtctggcccccgaggctgagctgggaggccccataggtgggctgggcagaggctgcctacctttgctccagctcttcctccagagccttctgcaggctggtcttcagtcgctctgcctgggaagcagcagtcaggcaggctaagtgtgtgtgtgtgtgtgtgtgtgtgtgtgtgtgtgtgtggtggggtgatggtcgatgaaccccacccctgaccaatcacccccgaccactcacccccacttcctggcactggaagagcagagtgctagtgcctggcaggcccggctcctgcacggtgatggacaggatggagttgtaggaacatgtgttgagcgccacattcatggcctggatgctgtctaggcggtaagagtccagctcctcctgggccaggtggagaggtcaactgtgaggccaccagagctaggtgtggcttctgggagctcctgaccagctcatcctagccctttggtggcctagggctgaggtgtcatctacctgactcttgtgcctctgtccccagcctctgtcccctgtctcttcctaggcttgggtgtgtgttgtatgtggggagagtggctgccctttggggcatggagggtggagttcaagagctagtgcttgcttccccacagcccaggctggctatcactgggtttgctgggaaggctgaccttggtctcaatgtccagcagctgcagccagccgtccctgacctgcaggatcaagtcttggctccacacccggccctgtgcatccatctcgaacagcttctgcaaggcatcctcgggcccctggactctctgactcccctgcttgcatgtcatcaagtgctgcagggagagggggagtcctaggactgggagaaagctcagagaggtggaccacaggcgtgctgggtagagaaaagcagaagaggaagaagacgtgtcctcggcccccttgaggtaggaggttccaggcttcagataaagcaactttccagggccaatgtgagggacggtgtcgaagcactggggccagggatagggcctccaagtctgagtctgaggggctgcaggaggggtttgaggactctggaggaaggacaggcatggcctttactagtccaggccaggtgaggcagctgggtggtggaggatgtgggctccagccacccaacaaataactcctctggaggtgatacaggaccctcagattctgtccctggcttcctttgttccttttgggaactcagtcccagcccagtcttcctcctcactcacccagcattcctgtctccttctccctggttcatgcctggagatatccatcgtgatctcagtctccgctcaagtccttgcctactgctaggctgaccatccaggagttttttgctgttatccactctcctttaggagccccctcccttctcccagccaaacattaccttcacaaggccccttccacccaggcttcttgtggtagggagatgcagcctgcctcctgccctttgaccccacccccctgcccagggcccagctcttctccctgtgttcgcactgccagcatattcaggggactctggcatcatgagcaaactccatcctcctcttgctctgcctgctgggcctaaaagaagcctcttcccagcctccaccctacagagaagctgagtcctcctggcctctcctcggctggctaggggagctctgcctctgctgccctgtgggacctgctgccctgtgggacctgcagaccatcgccccagctccctccctgcttgttctccattggagccactaacaagtggtggccaggacaggatggcttctaccccagagctccagcctgaccctctgcctgctctccccaccacgcccttgtagcctgtgcttcgccttcaccttggtgtcgacagcccttcaggcacctaaatcttgcagtgcctgcatcatcctccctggtagagccagagactccattctagccttggagcagcctcggagctgctcacagtcaccctggaggcttgggcccaggtgcctcccctctccaacagtggccctctcaatcccccacagggcccaaagatcccaaagatcccacacactcctgcctccagccatgcaaggtcttgggcaatggagcagtgccctggggactcgggcagcagggggttgggagacaggggagggtaggtgggtgggtggttgtaggtgcttcttatcccatcctgctgctacttcttcctgtctggggacaggacactcacccgctcaacctccagccaggcctgctctgttcaatctgaccacccctccccgtccctgacactgagcagatgctctggcaggcttgttggatctgagtccatgcgacatggttgggacaggctgttggcttctggggcagggacttgtgtgaagtgtccatgttctggcagggcggtgggcacatgggaacacttgggtttagttggacactgcccgggggctgcagaggtactcacctccaccctgtgctgcaggagggtgggctctgaggtgaggttctgggagtactccttccggtgcactacaagggcacagagcaaggggcgggaggtgggcagaagaacgaggtgagactcaggcaactgctgggggcagttggtgtgaggaagggggagtggaggatgggacattctgggggctcagtgggagggcacgggagaggggcctgccaggagcttacagtaaatggctctgctgctgggccttgacatgttgacgctgctgaggacggctccctagaacccaaagtgaaccagaggcagccatcagagctggggaaaggtgtaccaggcacagcagggcaggacagttgctattgctctgactgggggcctctgggaccagacccaaagcccctggctccaggggccctttccggagccatctgcagccagcgtcctccactgaggagccctccatcctggctgggcctggaggccccgggctgagggaagggagggtcagggaggccacagcatggctgggcctcagggaaggctccaggcctcccatggtttggctgataaagctcatgccaaggagcccaggaaacctggatggacagggacctgcgttcagatcctatcttgggcctgggtatgaaagatgctggatgagcagagggttctgtagccgaccccgccagaggaggccctcttgttcgaccctgtttcagttctgcaaactgagaggacgctgatgctggctcttcagctgtagaccctctgggaagactgcatgcatgtgtgtgtgtacttatggtggcactgcaggactcgccagtgagctgacctcccccaagtgtctccctaggcctcctggctctttgctttttgtactctgtatcctctgcccaggtcccctcctgaccccaaccctttaaattctagctcaaagatcaccctcttggtgaagccctcctggaccatccaaccccaccctgcccagggtaccctcctaatgctgcactggaccttgtacatttatctccagcaacaatagtcacaatagccaccacggtgctgtgagcctggtgctgagccccttaccaacatcctatcagtttctcctcactgccgtccacttgtacttacttggcgccacgtgcctagcactgttctaacggcgttaccttcagtcactctaatcctcaaaacaacctcacaaggcaggtactggtattgtccccatttaccatatgaggactctgaggctcaaagacggtaacaggcctgaggtcacaaatgaacgtttaatagagagcaacccagatctgtccgattgcaagcttcgtgttttaatggtttataaacatgcctctgccgctgggctgtgcgcagtcacagagggagtctagagaacatacatgttgaaatggagtggaattaaatgtggtgtgtgtgtcccgggtgggggtggtgttagtctgtgcgggtcaagggtatgtgttatccaaatgaggtttgtgggtatccacatgtctacatggtacacctcagttgtgcagaaatactggactaccccgggtaacatgtgagagagcaacccatacccttgtttattaggactgttgtgaaaatgacgtaggatctgataagatgactcagtgtggaaggaaataaactgccagtgaacaattaagggaatgtggaagggacggctggatctctggtttccttgtttgggaggaccccttttctctccaggggtaaggcggggctagaagcctgttccccttccccagcctcccccaacccccattgtaacacttcctgcttctccatgctctccatgcagaagaggaagtgaggtctgcccctggtcagccccactccccactccctcaacaccagggtgggccctgtggggccctctaggtaggtaggtcaaggtggggaaacagctgcagccaaagattccctaccccagggagggaagagggagctggcttggcctgccttgccccttaggggtaggggagctgtgacagcccatttcccccctttaagccctagatgtaggggtttggagcagggaaggccatcacctcatagaccctggggcaagcatcccagaggcccttccggagcctggacctcgctctgctttccagcccaccagccagctgctgagtcccaagcccctccttgggcttgatcccctgggctgcagctgggaacaggctggagacctggcctgggaagccactgagttgcccccacctgccctgagatcccctgtgactgggctgggccccgatcttccctgggggccaggcccttacctgggtgccagtgaaggccgggtgcctggtccccccaggaggctggtcttggagcaggtggtccggtgctggtggtggaaggacagcagcttctctgctagtggccacaggcagagcctgcctttgatgaggttacagaggcagccacgcctgtgctctttggactctggtgggtggggaggcttcctggtcactaaccgc

SEQ ID NO: 1794 - DNA, 13944 bp, Homo sapiens; identical to SEQ ID NO: 1793

SEQ ID NO: 1795 - DNA, 13944 bp, Homo sapiens; identical to SEQ ID NO: 1793
